United States Patent 10,407,724 (METHODS AND COMPOSITIONS FOR SCREENING AND TREATING DEVELOPMENTAL DISORDERS) - sequence listing, part 77

SEQ ID NO: 2074 - DNA, 225662 bp, Homo sapiens
atgcattttctcttagtttaacaagttggaataaaatacacaatttttataaagataaatgtcaagaagaaaaactgaagtatacttccaagcaaaatttattagatgtctattcaagaaaaacacaatgacctttgcttgtaagaattcaaagtcaattacctggaagccaggtatgaatagttttttcttttaaaatcagatacagagagtagaaacagtaatttttcttaaatatgacaggcaacagatattgaagtcttttctcataaatggcatcaaagagaattattcatttatcagcaaagctgcatgcagttgacttaatttcaaacctgaagcctttaaaatatgaagctggttatgaacttgacagaaatcaaggtaggctactcaacgatgtttctttaccttcttcctaatgaaattcccttgtcatcagtcagtagatatgtacatttcatttggcttctacgatcttttaacttcatagatttttgcataaatgctatctgacagaatcacactatctaggggtgcttgtgatctgtgagataaggagaggctagtctgctgaaagtgttgtcgcaggataaagaccaaattaggaaacgcccctgttttctcaacaactagtctgtacaaaaaaagagcaaacatatgtacaaaattctagaggctacgtacattgtgaaaagatcaatatcactgtccatgaaagagatgccataaaaagttttatctgtaaggtgctcaagatccaaagatgaacagttcttatgcaaagtcataagaaatacaaagctagttttcggagcaggtgtaattcaggcactgtgaaccatattaaaccttccaggtcccaatatcattttttaaatttctgcttcagggcagaaaataaaacctgaatgatttaacattgcttctaaaaagtgcctaatttattcctaggaaatattttacacacaccaggaaaatcaggctcaacatattcctgtcctcaaatgtagccaggattctgagttccatagaagaaaaataattattatagtaaaaataattgtagtaatcctaatccttgctaaaaccaactttaatacttgtgatgcttctgtactctatttctataaaataatgtgtgagattctattacatttccataaaatgtacaacatatcatatggattatatgttctcatacaatctcaaatgtgtatgtgtacacacagtgaaatcttacctactagtattgcttacagatactttcaggtgtctgttagaataattctttgcacctctcactaacactgcttttacttacattttttcagataaataaaacactaagagctcattgttcatgatgctgatcattacattttaatataaaatagcgatgcaactttacaacacaatagttttcccctgtagcctagctcagcctcttgtattgtcatgattattaccgaaggcttttatttacttactgtttgcacttctaaaaaatgcaaacaaattgcagaaaaagactcctatttgaaaactcacattcaatcagcaaaatcacactcatccaaattaactcgcctcctcttgctttaaaggttgtaatcactgtgcatattacaacatgtatgtgcaggcaaacaatagctaaagtacagttacagttgtcatattgtgtaaaccaagacactaggcaaacttgtgaaaagaatacacactgccaagcgaagaatatgaaaatgcaaaccacagcattccccaataaacaattttctggtcgtcttgggggagaacatcgcctggggggagatgttgaaatggagccacgaggctggacagcctcctggagacactttttttttttttttttgcctcaaatatttgaccatttttaaatatcatgatttttttctttctgatcccacattttgacgtgtcaaagcttagagcaggaagtaggaatccacactttcacggagggggaccagcctgccatgtcgtccccaggctcacagcagcggcggctactctgctggtggtttggtggcaggtggagatggtgacggcgcattggaaaccgtaaggcatgacaacgggaggcccgcggggtgtttcaggcgcgttgacgcaggtgcatggctggcaggcggcctctacagaaggagggagcgcaattcacagcctcttgacgtagtttccggggaaagtaccaaagaatttggttcttcttgaggtccctgaaaatagaagcgagtcatgaaaggggggtgacaacgatatcagttcatacacatgggcttgaatacttcccatttacaaggcctcggaagacagcaagccccgaggggtttggaaaagaaggcaggcaactcacatgaagcccataggcagacaaaataagcagtgttagctggttgcctgacgctctcactgcccctccggcataaatgctgcgctgccatcgcggcaggctaaacagaaatgctgagcctcccaagctaaagggaaagtcagccctgctgaggaggggggcggaggagctcagtcactgaggctgccacaccagagtcgggggtgagggatcaaggcgaggctgacaggtgacagggtgagtggaaaatcctaagagcaaagcttctcagggaccagcaacccgcgcaacacaggtgcgacatgaagacatcatctgtggcaggctgtcgctgttccaacagttttatcatcttacagaagatcatggtcagtgccacatcatttatttaaaaacagcactgccagagtccttcatcgagtatacaatttttcaacaatttacaaatcattaatgaaaaaaaggattaagcactatttgtgtgtgggagttctatcagtggcatgatttttaacatggtgtgtgtttaaccacacgcacaaatggctatcataattatgttcgcctctggtttcaaataatgtaattccttggacacttcttgtaaaagttggtgcactaaattgctaaattcttctttaggcagcgcagatggaccggataagggtctctcaagcttcatctgtctcctatatcctggcacttactgccttggtttgatggctgtttttctttttccttggctaggcaagccattttacgtttctcctccctcctcctcctccctcctcctcctcctccttgtttttgagatggagtttcgctcttgtcgcccaggctggagtgcagtggcatgatctcggctcactgcaacctctgcctcttgggttcaagcaattctcctgccttagcctcctgagtggctgggattacaggcacctgccaccaagcccagctgattattgtacttttggtagatacggggtttcaccatgttgaccaggctggcctcgaactcctggcctcaggtaatccacccgcctcggcctcccaaagtgctagaattacaggcatgagccaccgcacccggcctttttttcttcttttaatggaaataaaatcagaggcttgtggccgcaccagggcctcaattctttcatgattttgccaccgatggatgtctagagtgagccctcctctcctctcacctttcctctcttccattctctgccctgcagcctgtgtttccttttcacctctttctgtggcccagtgtaaaatacttttgtctacaaatgttttcccagaagacctctcgtctttttttttaggatggtaaagatgaagttgccttttaagtgggaagaatggaacgtctctctgcttccaccacaaactaaagttaaggtgagtcactgaatgttcgggcatctacgtcagacctaggaaacgggagagctgttcacttaatctcactccctctgaaattagattctcactgtggacaactaacattttccacagcacagagcgttgatatttctcttctggggaccatttgttgttgttgttcttagatctcaatctttcctggtttttgctatttaaagaaattgtcttctctcagttgagttggaaataaagctcgcagaaaatcacacatagctgaagcagtgaatactaaactatattaaaaatgcaatagccttgggattacattgtgcatatgaatgtctgaaagatcaaaggcattacgaattcaaaggaagctcggccatcacagcaaaccacgggagtgagcaaactcaagcaaattacaaaatagccgaaggtgcctgaggaagaagcgcacatacccacaaaccagccgtcatcacacttttccatgacatcaatgacatcactttctctgagctccagctcatcttcattcctgggagtatagttatacagagcctgaaaccttaaacaggacaagggaatgtgtttaaaaacatcttgacaccttcatgaaatatagaagatagaacaatattcattcttcctttaacattcctattcttaacaacattctgttgggtggtacaagcctggtaagcatgtaaatagcattctattggatggtacaagcctggtaagcaggtacatagcaatatgtagatcttcacaggcattagaacactctaacaacattttgaaactcacgaggaatatccatgaaaattgtaacattcataaattggattaaaatatgtcaacatgtataagtcagacccgcatttcagttgtccagccatctaacgtctatcatttagacattaaataatagtacaaaatataaaataagtgatatttgtattatttaactgtttaaaaacaagaaggaatcacaattttagctagccataatcagaagcaaataatgggggcttgagaattgaattttcaaaggttctaaatggagatagacaaaatgtgtcagacatgtctttttaatcactctgtgtgaattactatacaaaggaaaattattttttttactaagaggaattctttagatcagtttaatgttatggtttggatcagtgttttctgaggatgtagaattggaagatttgatgtaattagcctatgaagttgagtagatgtattctatgtgcagttattactgattccatttcaagcagactatggacataagtctctttttaaaatgagtcccagaaaaattgtatttgattttaaaactctctcttgaaataattttatataaaaaagaattattgatagaatgctatcactttcctttcccggcctgaattctttgacagcatatactgtggtggaaattgatcaataatgaattcagacactgaatttgtggtaagaaaacaccatacattataataaatagtaacatgggctggtgtttttggaaaatgaaggcgaaattactgtagctgagaaggtcaagaagaatttgataggcagttaacatgaaaacttcttcataatagtactaaaatattaccagtactgtgagggggtttttaaaaattgggaatttgtttctgctgctttctgtaacagtcatgtcattctgctaatgtgagaaaataattaccactttctagggtattttagattttttcatgccaacttaaaaaagttgataatcttgactaccgctccggaacaagaatgatttatttttaattactttatgagtcagaaaataatattttggtagaacaaaactattctatcatttaaactcaaatcttatgtcattaataagcaacagtgacctactggcttccccccgttcatccagcatttggactgggggagctggatagagttggcttcagagaatgcctaacaacatcccctagaaaatattgttttccctggcctggcaccaaagcctgaaatttcaacattagaggcttcttctcctgttaaaacttcatccttccagtagaccttacagccacttatatccttttgagcatgggcttctgaggccttttcttgagagaggggtttgtgattatggggaagggcagagaaaggcagctagcatcccagagtagtggccaaaaagacaggcaggtgtggaatacagaaacgtcacctgatttggatgtttgcatgtggccagctttgctaggggtagtccatttattttgttgcttgtgtaaagaatttgatttggaggctgctcaggtgaaggggtggtatcttttgtgtatctgtggggaaagttcacggtcccttttccagtttcacatttgagagagatggtggttcctgggctgctgttttgatggatacacacggcatttctcactttgggaaaactgattcttttattgagcttctcaggcttgaaccctgcccaggctcatctccacccactcatggagaccggttacctaaggctgcaaacctcagctgctggaaagaatctcaaggtctcagagctaacgcaacaaaattggcacagactcctgcttcatttttgtctgatgaaagccagcatgtttgtccaaatttatttaccattctggtttaattagaccacagaaacaaaaacaaaacaaaagaaaacccacggagttttatggaaacgtaaacacaccttcaggaaatcctcctgcctctcctggctttcaaagccagtgttgcacaatgggaaatgaagacaaatccaatgttaaaaaatgctgttgtgaaagatgtgttggtgaggtgagtgatggtggtggggtaaggatgcctcaaaaagaaaggtgtcttttaaacaggaaatgctgagccagactggaagccctctcgataacttgcaactttttctagaacatatttcactaaaactctgaattgtagtgacataacattatgttcctactttggctcaaaacttatttttaaatgaaagcaactaagcaacaccctaaaatcccactaattcaggctataatcaaatataaatttaataaacaatgttttctaatatacaaatcaggactttgaaaatgtaacatatctttcattcataaacactttgaaagctgtttaatataacatgttggtaatgcaataaacctaaacagccctggaatttattttttatcatgtgatcttatcatcgtttgggtaaataagagaacaaacaaaagctttagaatgacaagtcgtatttagtgttttccagttaagcgatctttttgtttgtttgtttgtttgagacagggtcttgctctgttgcccaggctggagtgcagggccatcatcatggcttattgtagccttgatctccctggcccaagtgatcttcccacctcagcctactaagcagctgggactacaggcgcatgccatcacacctgactaattttttatttttatttttgtagagatggtgttttgctatgttgtccaggctggtcttgaactcctgggttttggccttccaaagtgctgggatttcaggcatagtgactgcacctaaccttcagtgagatttcaaatgattatcactgctaacctgttctttccaaaatacagactttcccgcaacaagaacacttttctgcctgtgctctgtgagagccagtctcatccggagctgctttttgctaagtttcaggtctgtgaggagcaaggaaggacttgatggtgataaaggcaccaggtcatatgccaggacctgccgcaaggaggaggctattgttagcctgttctgctccaggtgagcagagtgtgggcagtgggtcaggatccccagtgtgtgctcagatatgggggacaaggggttaggtccatgaataagccttcccaggggtctcactctcgactcacagtgtgggcagaggccaacaggaagctgataactcctgaacgtctctcagggacaaaatgggcccgaaaaagaaacacacagagagaatcttcaagacaacgtgtgacaccttcaggctgatttaactcatgtatcagaaaggagaaggaatttgaaaggaaagtttgaaaaggcattttcctggtgctgtggaagtaatcgcatgtaactgaataacagtgagtgttttaatactgcccttttcaaatgacccttctaagcatgtaactttggaatgatggaatgatcgctttaggtcttttttacactgaggtccacttttaccgtctcccagtgggtgtaaaagtaaggttagaacatgttctgtatgtctttgaagctcgcagttactcgttacacagccagcagagcagagagggagacagagttatccatcttaggaatcactgaagcattgggaagttttcctagtgtgtcaattaaaatcttctcagagaactatgggttcttttaaaaattagtttctggtcactgtcataaaagatggagagactattacaatttctcgtaatttaagaggcctcatgttagtttgatctttcacgtgcaaagccatacatcttacattttggtacagttgtccattttgtgggtcaaggttagtctcaaatttagaagataagaagaatacttacggttcccccccaccttgaatattttcatgagtaaacacaggacgctgtggctgaaatgaaatgattttcaatgtaatcaatgtttaaactggtactaattaaaagataatttggataatggcatggtacttttcttgacatttaatatttcctgttgtaaaaaaccaagaggaagaaaaaaaccaaataaaagctttctgcaggattaataattaaaatatttaaagggagctttaaattaaagcaaaataagcaaggtcaaatgttttgaacatgtctacaatctagtctgctcaagctttaaggaaaagtcagggtttggtcccattgatttttcaaaggccaggaataaggcaagaacatagacggcaaaccactagaataggaaatatagacaccttcatacaaccttattctccagcgttttctcaaacaagcagaaaataaaccacatttagtttaacagcaaagtatccacactcattctttcaatctttccttcacagacaacattttcacatacagcacagaggaaaatatcaataggcagacatcccatgctacatttgaattaacattttctgttctcaatgtggagagaaaacatgcatttttaaaaagagaaaacagaactttggaatgcaacgaacaatatccgggtaacatgtaacattttaccttagaagagaaacattggtagaaatttccagtgcactgaactctcaaaagagtttcttttctttttaaactaagcatcaagaccagtatctgtaatagatacttataatattggaaatgacaagccttagcatcccatatacccacattaatattttcagtgaatgaaagttaacatgtttgttgaatatataaactcagtgtaatttatattgactacctaaactttaccttttaggggagaaatgcaaacaaatcattcataatccatttcaaaagcatttgcttctaaatgatagctacagggtaaaatcagaatttgcatggcaattatataagtgactgtttgatgactactgaaatagctattagatccatgtccttagactttgggaccagttcttagatttccatagttatgagtggattactgataggctgaaatctcttgctgccaattgtccatagaaaccccactgatccaagcttggatggataattctgaggttcctttcagtctacgagtcaatgattcacccacttcctaaattctttatccaccccctttctatcctacttgtctatctagcataagactaggtactcacagtactaaaactgtaagctctgactcggttaactggaaacctttattaacagtgttcttagaaatttcactcaacagtctgtggatagaatatttaaaactagagtgcgtaagaattactgcacacaattatgacttaagagtgaaatagtttactcctgtaaatcaatatgactactaatgatgtatctattattaaaattggaagatattcatattttaagaaaaattatgactaaccagttttccaaccatcttaaaggtcatttaattcaagatattattaaatcaatttaaatatataagatggtaattgtaagtcattgataagcctgtatcatattacctatttcaagttctcttccagtccaataaaactttatatatgtataaaactttcatgcagaagtaagatttgtatacatcaattgccattaatattattttgtaataactttccagtctttttttctcagtcttctttcttatttcaaatgtctgcagaataatgttctcccacgtgtgtctacatatcatagttttcttaaccattcctctcttttttttttagttttgaagttagaattggtctagtctttttttttttgctatcataaacagcaatgctatacacattttttatgcaaagagctattttcttcttttgaactattctttagaatatattcccaggagtaaaacttctggccaaagagtatgcattaaagccatatgattttgagaatgtacatgttagtcactgaaaaatactgtactcaaaagtaacttgaaaatgtctaatatgccagactgcatatcatataccaagatagctactactctttccccaaaacaatcatagcaccatttgcagtgcataataaagttatgaataagaaaatattatttattcttgtcttaagagaaaatgttgtgtaaaatatatttcattatgctctaaaattggcatccctgttttcacacatttaaaccattttaatattttaaaattgagtaaaagtttcaacttctacatcatggcatccaatgctttgtaaaactggttagtttcatttcattgctcttttgttaaaatgtgaataccactttaaaaatcaaattgttcattaatgtaaaacaatcaacttttaaagtccgtatatccctttttagttatcatcattataattctactagtttaattcctttaactcaacccacctcatcaatcatttaactgaactgtcccattgaccattatgaaaatttggtgattgctgcaaacctgcagcttcctggatcccacgtccatggctggagaacgtatgttcctgtgtggggcagccagcaccgtccttgctttttttttttttttttttttttgagatggagtctcactctgccaccaggctagaggtcagtggtgtgatcttggctcactgcaacctctgcctcccgggttcaagcgattctcctgcctcagcctcccgagtagctgggactacaggcacgcaccaccgtgcccagctaatttttgtatttttagtagagacagggtttcaccatgttagccaggatggtctcgatctcctgaccttgtgatcttcccgccttggcctcctaaagtgctgggattacaggcgtgagtcactgcgcccggcccccgtccttgcttttacctgtttcccaatttctcttttcccttccttcatatctttcaaaccctgcccctctttttacacacaaatcatcagttttctatactgttcacatcctgaggccagaatcaatcaagacttttcgtagcagagaagttgtgtgtgtcttataatggcgagttttagaacttttcaaagcttacctttaacaagaatcacctccatgttaatgtggataactaggagacagttttgaggaaagctgactaattacagtacttgaaatagtttattttaaaggcatttgactagtagggaatgagtagcaagaacagttatctaagacggctcatctgcgtctttctgttttgggcgttaagcaccatataaccttggggatgcctcagcttccctatctctgaaatcaatgagttggacaagatgagggttaatcgggtcccctcagggattccatgaaggatacacatttccacagatgtatttcctctgctgtgtaaaggtgtccgtcatcagttttacacagagagctgggacactgacattgattggttaattctcatgtgtctcggtcacgtaaaaaaaaataatggttacaattcaactccattttgcagaatggtaaaccaaaacccaaagatactggataatttcttaatacgacaaataggtaaaaaacaaacagaaaaagaaacaaaatggtaatttcgatgtgcacgctattgcatgaaagattactatgatggactacttggcctaccttggctaaaatcagcatcttaattttgacgctgaggtaggtgcaaatgtcctataaggtgatgtaaatagattatctggggagactgtctttcgccctttccccttggtgatgtaactcaaatggcaagtcgcttaagcagagatttgtaatgcagctgcactctgtcgccacctagtggtgagcaatggcagcaacaagctgagagttgtttctgctttatctgcccctttttatccaagttcccaaggctggaaaaattttaaaagcctattttaaaggccgcagagtgatgtggaatagacagtcatctgttttcctaaccatgttcttccctccccacgttttaaatttttgagaaagcatcccttgtaaagccaccagcatttttggtccgtgtccatttctattttgactatctgtgcaggcatttccatttcccctaacttcttagcagttttaagataaatatagaacaatatacacttgtgacattcagagaggcttacatgagctgaacctagaaagatggctttcaactgacacattacaatcactgtgctgggcattttgaacaagaattatattatgcttatatttccttgatgaatcttaagagtagaacaagagaaaaatccagtgaagcatgctgcggttttcatcgtatcctaaatatgtatttttttctgtagccctgactatgtaagtatttttctgtagctattttttaatgttgtcaaaaacggatacaaaagagacaagttttaaacacatgctaatttccaaagccagaaccaatcacaagttgctgttcataaggaagctggtttgaaacatcatggagtctgtaacatcagtaaaatatatactttccgatcttagtgagctacagtctgttgaaaagccgtctaatttatcaaagcttctgcagttatctctggaggattagctatatttagtatcaaataattcttaaagaaggattgactgttactttaaacactaatgcaaaaaaatctctgaaagcaatataagcagtgctaaagtgtttttatctttttttataaaatattagttgtcatatttgcccaccagaattcgatgaaattctcctaataataccacgtttatgtttctagaggcttatttttccttcttaaattatgaaggtaaaacacaactttgcataaatctaaaaaaatagaatatttatggttcacacaaacacacgtgtaatctgacatacaaatacataatgtaaaaatcaggcaaaaaataaaaaaaaaaccttaaggggaacacaagcataccatctcgtggacccacaggagggttatagatgggtccttttcactgcaaaagaagcttatgttttgctttggctctggaaggccattcgggggagtctaagagtctctacaaattggcatttctgtctctatggcaacacaaagctctgcctcagcaacaaaatgaggtcttcctatgcaatgcaaaaagcacaaagtggcatgaatgcagaataatatcgacttttctttagaaataaaaaatgaagacttctgtgaaatcaagcccttgagaacttcttgaaatgcagaagcacggccatgcgataggccagtcaaggttgaatccgggtccattaaaacagaaatgaggaaaggaatcctgacttatgtccagatgaaaatttccaaactccttggctgcattccttagaattgatagtaagtaccatttagagtccatgtattttaaagtactgtagatactatggaacgaagtagctaagggaaagtaatttgacctttaagttcaatcagagctggcaagaaataggaagtggatagaatccagacagcagtatggggacaaaaggcagactgagaggatgtagtgcacatcaccagagaaacagaagatgttagacaagaatcatggatttaaaaaaaatccaaattgaatgacacagaagcaaacatgaccggaagtgtgtgagttcggcactgtagatgcttggcaacagttttttctttgcaggagaaacggtgactagaaagcagtgatttagtgtagaaccatgagacagatgtagaccacaaaacacacgacactcttatttgtagagtagagaatctgaccatgtctttgtggagtttggaaacctcacacacacctaaaagggaagcacatcaccaggtggtcgcttcatcttcagggtgtctccagcctcactttaaggccagttcacagcaaagacaactaaggaagagccagccctgggggcgggggaggtggccaggatgcctgccacaaagtgggggcatgctgaccctaccctgtgggaaccgctgagccctctgacaggtgagccgcagaatctcctagacatcactgggctacgaggaggcttacccaggacacatatctcgctttttacgtcagcctggaaaatgtacaagaagttagttagctctcatcttcgtcacacagacttcaggaggagctttcctggctggctttttccatgcacacacagcatgccaaactcctgcacaacagcagggcagggagggtccacagcttctccagctgcttatacagtttccacaccacaggcaccagctgccatcttaacatggcacccacaggcacagcagaaaaaggttcacagaggaaagctggcatagggaagaggccaagaacatataagaaatgttatatctttttttgtcttttatttttttgagacggagtctggctctgtcgcccaggctggagtgcaatggcacagtctcggctcactgcaacctccatctcccgggttcgagcgattctcttgtctcagcctcccgagtagctgggatcacaggcacccgccaccaggcccagctaatttttgtatttttagtagagacaggatttcaccatgttggtcaggctggtcttgaactcctgacctcaagtgatctgcctgcctcgggctcccaaagtgctgggattacaggtgtcagccactgcgcccggccaagaaatgttatgtctttcatagaatgcttagcaattgggttcaagatgctctcaaacctgccctgctttttcatcttattgaagggatgcaaggtgagatagaggagaatttggcttaatgcctgtcaaatttcatggactgtatcagacatttgttggaggcaaaattttctaacacataagaagaaaataaggcctttttggggggaaacatggtgaaatttgatgaactactgaagtgccaacctgtgggctggactgttttggtgttttttttttattttcagagtaagatctttcatatgacagtgagtaagctgaccttcttttgtgtaggttttattttccttccaatagcggacaggatctggcagtgtactgcctggtatttgatctggcttaagagaacttccggaggaataaaacacgcttaaataaaagcatgtggttttctcaactctcatttagaaaagttttcctaattctcagtaatgattgacctcaaatccccagcctctcgggatgaaatgtgtttggcaccgttgcttaagtgtcgtggcagacgatgcttgatgctctccacatccattctcttcttggtcctcagtaatggggccaggctgttgggtaggcacatggccattctggataaagaccacatttcctgacttgtagctggatgtactcatgtcataagctgagaccgaggggatatatgcaattctgggacttggccttcaagggagaaggtgtaatctcccatcttttctccttcctgctggttcgtgtgagaagggaactactcgagctgccacctgggacccatagcggaagcttctctctgaggatggcgatgagcccacatcagatggaaactcctgggttctctgatgactgcggggccaccataccagtcccggacacccttcatttatgtgtaagagcaatatatttctacgttgtttaagctataattattttgagttttctgggactgtgcttatcccagtcttgactaatacaggggttcaatgcatatcagagctcttagagaaaaaaaataaccccatttagcttttagaatgatgtggatcataacagctggaaagagcacgtgaacatattaggaaaaatcagggcctgatttcatgttgaaaaccgtgcgccggggatccccttctgatgggactgctttagggtgacgagacttcctggtgggaccacaaccactgagttacttggaagaaacctaaaaaagagcctctcactctcctcacagagcttccgctgcaacttgagaccacatgcggcaagtctcttgcaaaatagtctctcggatggaaatggaggctcagcttatagaggagctgagatttatactattttttttgagatggagtctcgctctgttgccaggctggagtgcagtggcacggtctcggctcactgcaacctctgcctcccgggttcaagcaattctctgcctcacccttccgagtagctgggattacaggcacctgtcaccacgtccggctaatttttgtatttttggtagagacggggtttcaccatcttggccaggctggtcttgaactcctgaccttgtgatccacccaccttggcctctcaaagtgctgggattacaggcatgagccaccgtgcccagccaatttatactattttttgttatgaaaaaatcattattttaaaagcagatgctcagaagactgggggaaatattggattcagatttatacattaaacataatttatgtatctttcagtcatctgtaatctataaagtggtaggaacttttacgtttatggaagattctggattgcatttacttttatggagattgtcattgtcttagaaaacactttaaagaatgaaattgcactgacttaacatgagttaactaaacaatggttgatggggttgataaaaatgttattacaatgatttcatgcgtgctatactatgtcattaaaacattactaagagtttattttctctttgctttcagtgctgggttatttcttttctttacaatgagcatcagcattcttgaaatggaagaaataaaaaggcttcggactcagattggcagagtttgtaactgggtcagatgcagaattaaactataatggcctaaaattacgagttgattcaatttgtacttaaatttacaagcacaaataacttcagtgaatatattctttcaatgactacaaaatagatttataaggtttaaaaaaactcagtgggagattcaaaaattgagatttcctcctaaataggagataaaacagagaaaatcactttgatttgctggagttagtcagaagtatctcatgtggtcattaaaatattcttttaaaacatagttattgtgaatacctccattctctcatgtcattctgcaaacaacggaaacttaaagaatatacgagaagaattttgttcttgcagaagagtaaacctttttaaatcctggctttgtcctgatgctacgatggtgcgtcctccgtctttccaaattagagaactcagattctaaggctactttccctcttattgactaagcttaaaaaccgaagaacaagttaaaaaaaaagacaagaaataaataccttggccttaaaaataaaaccacagacagaagagaaaaaaagagaaattcttagccttaggcatcatataaagtggcattatttaaaacatttcctaattattttctgccagctaagaaaaaaaacctcaaagagcaaaagcaattaaagtgtttcattttttacaaagttcctttcacgcctaacaggagcacatagatagactatgtcagcgaatgggtttggtggtagtggttttgagattgtataaatggcacttcctaatacagaaccttagctgtattagagccctaaatttttacttatgtgcagaggctctcatttcacattcaaaagactgaatgtgagggtgagctattgtttgaagtctgtcaccttttttccaaaggaaaatgttttaggatcattctgaacatagaaggaaaacatttcagtgatggactaatttcatgctgtggttgtcattaaatctctttccaaggccagtcattaattttgttaaaataattttttaaaaatagtatctttaggttaaataccagcggaactgtcagcctgcaagtctcagagatggatgctttgtgaagtgctacaaaaggatgatccttcccacatcctcatgaatttacgtcacttttgtggaagaacaaggctcaagacagtcaatgccaaagatcatcctgtctccaggctctgctgaacctgccgatcggtgggaaatgacgggagacaatgagtccactgagaggtgatggagaatggcaggcactgagctaagataccttaaatgtgatgcttctcatgctgacggccaactgaaaacaatctcatcattacttcttattatgatatacattttaatttgtttttctcctcaatctgggtatagctgctatgcaaatatgtcttttaaatgtttggatagaggccacgcccatgatgttaaaagttagcaatcagtatttatgtaacttcgtaggtcttgtgagagggcgcaaatctgaatgcatacatcttactaattaagctcattgaagacatgcaataaaccacactcaagatgcagttacctttaattttggtggattgatctcctgttgataagaatatttagggaggagaggaggtgagcagggctgagaaagtgtagagtccaggtcagaaacagaggcgaagagagaatgaaatggaggggaggaaagcaggtggctgggaaagggtgtgggtgcttgctctcccgaagaaaatgacggaggcttaaatatcgaggaaagacgagaggtgattatgcttgtctcagaatgaggttacatgctctttacggaatttcctctcaacttccaacattttaaagttactaataaccttgggaagttatatttatgacaaattttttgctttgaaaccactaacttcctcttttgaatttgattcaaaatccccaatggtatgatcagtttaatttttcgcatgggggtggctggagataggaacacctatattctatcattttctcatatatttatatgatggctccttctaaaagtgaaggaaaaaagtatttaaaaccctgcaatgactgtaacttgcgtgtaaagtaggttgccaactatagtcagcgtgtcacaaagctggggaagccgtggccccgcgtgcagggtgtgagctggtgctgggatgagccggcctagggtactgtctgtgtcagcaaagccacacatctaatcacaccttcagattgattgaattgaaaggaatattagttactgaaataattgatgtagagacacgtttggctccttgcaatgaattatctatctgttattaaataaggtgtttgttttacacaaatgcaggcctggccgggttattttgaaatacaggaactatgaaagaatttgacttggatagtagcgtaataggaaccatcctttctgttatttcataatttctataattgccagtaattatacttgcttcttaattcacagggtacatttgtgggatcaagtttctttttatttttgaaatggagttttgctctttttgcccagaacggagtgcagtggcacaacttcagttcactgcaacctccgcctcccggtttgaagcagttctcctgcctcagcctcccgagtagctgggattacaggcacccaacaccatgtctgactaatttttgtatttttagtggagatgggggttttaccatgttggacaggttggtttcgaactcctgacctcagatgatccaccagccttgggctcccaaagtgctggattacaggcgtaagccaccgcagctggccttaagtttctctttttttttgagatggagtctcgctctgtcacccaggctggagtgcactggcacgatctcagctcattacaacctcctcctcccgggttcaagtgattctcctgcctcagcctcccgagtagctgggattgtaggcacccaccaccacgcctggctagtttttgtatttttggtagtgacggggtttcaccatgttggccaggctgatctcaaattcctgacctcaggtgatctgcctgcctcggcctctggaagtgctggcgttgcaggctcgttttttgttttaagagagaggtttgcaagctaaagtttctggatattttctgcctttgttgattaaaaccactgttcaagattcttcataacatgaagatacagtacccagttcttaagtagtcaatgtgaagtcaacacaaagagaacgacctctttagaaaatcgaaaggggacagaagtgctgtttttcttttctgttgtctttgtttattattagcattattatttttgcaaagtgccgttatgtcaaaggtatggtgtacagtttctcatcctggaataggacaaatttctgggcatcaacttcctcttctctaaagtggggatgataatgtcacacacctcactgggttttgacgattaaagatgtggagtttttagaatagtgtctgatactcagtaagagctccactattagctatcattgttaatattggaagattacaaagactatatcaattacaaagacttttacaatataagtttatggtcctgaagaaaaatgggataatggaattatatcacatatttacatcatttaattaaatatggtgtgttttcatatacccactccacccccatcttatatagtatttgtgttttttgtttaaaaaaatctgttagtcaaaataggtatttattaatatgattaactctaatagctaatcatggtaaggccggttagttcttccataatcagacaaaattaaaatacctcattactgggttttgctgcattgctgtcctccttgggggtcctaggatctgtgggggtggctatggggtgttttaggcagttgggtttctcctcctcctcctcctcttcaatgtgcaggtgtggggtgccctctgacccatcgtggccacaccaccaggcgtctccttcctgaggttctggcggccctctctggatgcctgacacaatcccctcatagatgccctcatcttcctctccaatgaccggaaggggtacaggcaaggaacccacgctggtgcacgcagaggccacaaaattatcccctaggacttctggtgcctttttagggtctgagaagccccttctcatttttctcaactctgcaaagttgctttgagttgtcgttctgggatcctgaagaggctctgcatggtaaggctgggctgcagccgaggccacacccgcgtgagtggaaggtgattcggcaggtgcagtcgctggggacaatgggaggaggacagcaggttcctccttaatttccaggatggcgtcctctaggatggttggtttggcttggtcagctgacaaggttaaagcaccaagcttctccaattcacccaagaagttgtccaggaaacgaggtggtgttggggccaaagggtttgctggtagacatgaggctgtcagggacaaccagccctggccagttccctggagagctcctttatctgagccaggtgagactttgtgggtgggaggaggggctggttcactggaagccaacttggaaatgagcacggattatgaagttaagaaaaaataaactaagaaaataataataatgcatcaaaacatagcgatggagaaatgcagaaaagatgcggtggtgaatatgaaaataattttatgtttaacatagatttgaagacatttagaagatatctagatttgaaggtattttgctgaaatttaaatacataaaatcatttatgttaattagaaaagttacttcacaaatgaaactctactagttttggaaggggtcttaaatgtcaaacaagataaagatgatatagagattaccaggacagtaaaaccttgagagatttatttttatttatttttaattttttaaaaaattttttagagatggagtctcgctgtggcacccaggctggagtgcagtggtgtgatctcggctcactgcaacctctgcctcccaggttcaaacgattttcctgcttcatcctcccgagtagctgggactacaggcgcatgtcaccagtacagctaatttttatatttttagtagagacgggtttcaccatgttggccaggctggtcttgaactcctgacctcgtgacccacccacctcagcctcccaaagtgctggggttacaggtgtgagccaccgcgcctggcccttaagagatttaatgcttacttactttaaactatgttgaaaagatattacaggtttccagatactgacttagtagagtataaatgactccagagaaatgttaatgtagaatgaaaactaatagtgaagtcattttatttcctgaatgtgtgtagtgttctcttgtcctgcaggatagcccaatcttttaaacgctgacaattttctcacttatgtttgcaaggtgattacaacatatgaataaagtattttagatcattatatgttaacaaatttctaagtgaataagttctgaaaactatgtctcaaagacaggaacccatgatcagaatgaagctgagcttacataactacggcttcaaagttttaaaaaatccaaagtaaatatttacatagaaagctcatttgatgctaacgggagggaggacttctgcttcagctcccgttctctttcaaagcttgacatttatgtaaatcagaggaggtatgagttatgaagcttaatcttctgaagtaaaatatacttacttctacatacgtagtattactgatgtattttggatatagtaaatgaaacaatacatttgaaattttatgcaaaggtattaaaagtagttctgataaatatatacaccccatatgtacccataaaaattagaaattaaaaaatgtagttccagaagtgccacttactaacattggaatacgtttatctacccttaccggactagagaaaatgctacctgctatgtgcctaaaagccttgagaagggacctttcactttaggtctctccaggtagatgtctttgatttggaaagaaaaacatctccaaaaagattctggagatacactttccagctgattgtttaggataacactttacacagggaagcagccctcttgctcctggggacttagtgtgtgtgagtgggtgatgcatttcctacttaacttttgactcctgtgtcctatagtaggagtggggtattaattagatttatttagctttttttttttaagtcatcttatcgtgggatgacataaatatcacaaaactcatgtgagcatcttaatacaggattcaggacctgggctgcttagctgctgacacacagtgagactgcacgtgtggtttgcgcctaggtagacagccactcctgttaagtcctgtagatgctgagttttcaatgatataaaccactcaagtctcattcagcagtctacagaagttcccttactagctagagttctagtttataccccttgttacataacacagaagttttcatagttagatttggaaagtctgtgaaatatataataatttcagaccatcaggtttccactttcactttctgttatgccaggaatattatgtagatgagaaagaaagatcttgaattcccttgtcattactgccaccatcaccattgctatctgatgctgcgactacgctgtgccgtcaccaccacagtcaccgaaatacatgtcagcaggttaaactgcttagctttatgatggacttgcttataccgaaagccaaatgaagcatcctggtataactagatcacaaacctatacctataatacaaaacccatacaattattttgttttccaaaagcatcagaattggattctaatgcactaaaagcagaaatatcagaaataaaatcaacatacattttagtctcccctaagacaaagacagtatgtcaagaaatgtgatttaaatgtgtcaccagagtgatttataaattattaatgagttctctgtttgtaaatatcagttagaaaataggttctgtagcgtttagtatattttggatgttatcatttagaaatacattatatttatctttctaaaaatggttgtcacttccgggaagttttcttcattaagcctgtgacatcacagcatggattaccagttgggataaaaccattaagtatttcttcctaattatggacataagcttctcaacatattttttccccagcagtgagcaataaaaaactggttattagtgaaatttgtacatgcctctgtttaaaatctggtattactttaaaaacttgaaaatatattcaattacagttaaattgtattcacatcaaagatgaaaacattgggatcaaaaatattatattgccattaaatattatattaggacatatggaagaatttgttagatgtttaatgagcttttgtacatacatgcttttcttccttacaacattttatttgaaggtacagttgctttgaaatttctgtgatagttatttaaagatgactgaatggtggataagacaaatatatgcatgaagattcttatcttttctctttatcaatagaaaatactgaaggaaggatgctgatctgtaaatgctaaggtctggtaatgaagtaaatatacttaagaagattctggaaaactataaccaatcaagcaaacaaaattggatagtaccaaactcttccatatattatccatgaatacagggttgagggtaattatttgcaactgaaactcagtcttcaaagaggatcacaataaataaaatgccaagacttcagccttctaaaaaaaaatgcctctcttaagatggcagattcttagatcatttcctcatataaaatccttctcaggctcattttcaagaagtagtttaggtcactgggatgctatcttgaaacagttttttcatcggaacatgaagtgacttcacactttagtaacatctgatatgttgattttattttaccagctctcgatggtttagcttttcatgtcctagccttgatctcaattaaaataattaataaattaggcaacttaatacattttttgaatgttgagaagtacttaaaacattttggaagtcattggcaatttaaagttttattcctagaagttaatgagaaaaaagacccttacatgcctttcataaaaagaatataattcatcagaaaaataagaaaaaatttcacattgtgagtacagacaaatagcctttttacattcaccaattaaagaagcaaagcctcttttaaattacgtattgagaaagataatcatctttagcccgctcaagtgaaacagtagaactggcatataactgtcctaaaactgataaaacaaacttgaggacttataataaccgacaacattttcatttaaactaataaacatcttgacttatagactctaattaaaaatttttgctctagctcattttccatataaaaaacttgtatagatttgtcaacctaataacccggtgttcttgtgatatactattttgagatatacatagtattttgtgttgtgtatatttatatttcaaattataaatcacaattgtatatacatgtatgaatatatgattatatttatttatatgtaaagattatattatatacataaaatttacatatataaaaatgaagctttaggaaaaaattatttcagaaaacatttatgtacacaggagtacagatatatatcatacgagacttcatgatactctcgttttctctttctctttcgatattttaacttgaaaatgaaatgagcaaaattaatcattaaatctttatgccagcacctatttgagaaacactgacttatatttactgatgtggcactcacacatgtagaaacataatatgtaaatctctttctctgcaatagatatgatattctaatctaatatcctaaagtcacacaccgattatcttacttggagcttccaatattacattaacatgatagagtatgttcttaccttatttgagctcaagctgtgaatcctatcactagaatagctgtggggtattggagggtcagggtagtcctcagcaccttttgtgttcttcttgacgacctccacataggaaacagggaagatgccttgtctgttggttcctgggattttaccttcataccagttttgatcaactcttttaagaagaataactctatctccctgttatgaatatgagaaaaatgcattagaaacagagatagaataacatgaaaatataattgtcaatgttttctatgaaaaaataggtttccatttgggcaggttttataccttcagtttttgtttaatcaggggagggcaagtaaggtactagtgcttactagaaaaatacacatgatcaacatatatgtaattgaaatgtccattcaggccatcagaatcttccctaaggatgcctgattaatgtgaacgggtttatacttgtttatgctggtattgtgtgaaattatttgtctaagttatttcaaaaagcagaatagtgtaaaaggtaatgtctcaatgacaataggattattttatctctggcaggttcagtgcattggccttctgtaggaagagcttcagaaagtgcaccatagcttgctgtgagggtctgtctgaaatgggttacagaaaacacctctagaagggagaacatcgaatggtacaccgttttctttttttatttctattttttttttttttttgagagggaatctcactctgtcacccgggctggagtgcagtggtgtgatcatggctcactgcaacccgcacctcctgggtttaagaattctcttgcctcagcctaccaagtagctgggattacaggcgcccgccaccaggcccggctaattttttgtattttagcagagataggggtttcaccatgttggtcaggctgatctccaactcctgacctcaagtgatctgaccgcctcggcctcccaaagtgctgggattgcaggcatgagccactgtgcccggccccttttcttctttaatctacatgcgctaagtagtgacagagtgaactaaagggatgggggaaagagagcgccctagaatatcaatagctgtgacaagactggcattcccctggtcttcaccctgacaatggaaacccagcatccatctgagtagttggtgaccattccatacttgtcattaaagatttgaatagaacccttggctttcacaatgatagaactttctagaatcacttccacctgccatgaccgagccagtgctgcagaactcagtttaaactttaactcaaaactacacgtagcctagaagtaggcaggcaagttgatgctaccgggcaaaaactgcagctgcattcagcaggtgatacagaagctcgggcagcggcacctgatggtgtgatggagctgaaacagtcattaatctcagcccaacagggcacccttcttcaggtgctacccaagaagaacttcgaccttgagtagcacttggaagttctctttgtgttgaaacgctggatggttgattttgtgtgcttcaccaccgctgagcagaacatactcaagaaaagtcagtctcaggctggatgcaatcgctcacgcctgtaatcccagcactttgggaggccaaggcgggcggatcatgaggtcaggagttcgagaccagcctggccaacatagtgaaaccccatctctactaaaaatacaaaaattagccgggtgtggtggcgggcacctgtagtcccagctaatcgggaggctgaggtgggagaatcgcttgaacctgggaggcagaggttgcagtgagctgagagcacacattgcactccagcctgggtgacagagtgacactccatctcaaaaaaaaaaaaaaaaaaaaaaagtcagtctccccaaatctgaaaattgcaccgattttctagtataccaagaacaggtagttgctaggctgttgtgtgagctgtaagaggcattggtgaagcctttctgtagaacatggaacaggagacagagttcatgtaatgctctgtggttctcatgctaggtggggcagcccagaggataggaaagaaggaatcggctgatgatgcagaattaagactgatgggagagaatgagacaaggttctgccaggaccagaacaaaccaggactgtggtattgctcttcatcgcacctggctaaggatttcactagtaggtgtgggaggtcctagagccactctaaatattactacctcgcctgtgttgtgtgcagaggcagttacctcaaacaaatatatgtcatatttagaaagcaataagaataattcatttatcattctcaattatgtaaactagcaggttaaaagaggtttttgattgtttttttgtgtttttttttttttttttttttttgagatggaatctcgctcacctgccttggcctcccaaagtgctgggattacaggcgtgagccaccatgcccggcctcgaggcttttgatattattaagaagagatactaggattggatgggctgctagagaaatttgggtcaattatgaggcccaaagaaggatgatccagggaagagcactgcagagatggctcttaaagcggctcccccaagaggaaggatcttctttacctaggaccattcctagattccaagatagaggaagataaggattggaatatcttgtttttaaaagactgaaaaataaggcagcaaaacaacatattttgaagtgtatcaaactgctttttccttttgtgctcccgaatgtataagtccttgattttcagccccatgcccggcttcccagactaagccacagagggagaagcctggtatcccacggggaactcctctaaaaggacacagggaccagcagggaaccgtgactctgggctgccttaaagagtcctttgtagaaaatagggtaaacataaaaatgtctaaagaaaaagataacctattttagttttgaaaatatacagccttttcaaacccactgaagaacaaacaaacaaaaacaaacaaacaaaaaaccagctgggctacctttctcagtgacagctccacatttgtgtctgcgttgaagttgtatttggctatagcttctccgatttctccgggctgggctggcggaggtggtcttgcaggctgtgctttctcaggaggtgtgagtttctatgaaggaaatagtcatttattctcaaatctgcggtgacctttgaaaccaccgccatccaagagagaaagggagaggacctacctctacgtatgagatcgggaagatgcccactctcccgtggtgttctccctcataccaattttgatcaattttcctgaggatgtagacagtatctcctttcttaaatgacaactccctggaagagacacgttgacatggtctttttgtgatgtacagcaataattctcaagatcaacaccctcgctagatctgcatttgtttggcaaatatacttacaatattaaaaaatccaattgatattgagtccgattagataagaatgatccttgcaaattcttagaatgcacttaaaacattataactttagaaatgatttcaaacagagtaagtataaacattccattggatataaatcacagacagattaataagaagtttaaaggaggggacagactcttgctactttaccattagttcagagaagaggcattttgaagcttggaaaaatgatggaatagttctgcactgattttttttttttttgtcctgaagctagttggctagttagttactagccccccagccccttttgatgtactgaagcttacatgaaggaaaacaaatatcatgtagcctcagaatagaagtgccaacaccagaacaaattttatttgtggatctttgaagttggttgacaggtattttaatagaatatcttgataaggaatttattttgtgtaacagaaaagatcttacacttttaattttcagtggggcaagaagaatgtgttttaagtgcaaagacatatgccaatgcttgcctttctatcttttatttacaaaaaataaaaatatttttaagacactatatttttcaattttggctgtttctaagaaaattgtaggtatatttgatttgggtatttataattttaagttataatgacattatgcattttgaataattcacacctaaacttatcaccttcactacatcaatttttcctggcttaatcacccaggtgattaggttggttcattattttgcctccgcaattattcttggatggagggcgattaatttgtatcttctcccaagagcctcattttgcaatacatctgccctcccactctggaatcttctgcattgttttgttcagaattttcattttttaatctttttttaaaaaattttggttcagaattttcagttggatcatttattagtataggccgtttgatggagagagatttatacctgatggagaacacttctcattgattaaaagaattaatcgaaaaaatggtggtatattaaaagaatgatcacacatttagaagtgctaaaatcttcacaattgaaaatgtgttaaattttcagtaaccctaaaaacaaagaagattcatggagctttacattcaaatacagtgcttccttcttttgtgcaaatgcctaatgtaaaaaacagaaaacaaagcaaagcaagatatttaatgttcacaacacaacagtttcatttgtactaggtatgttttgtttctggaaatgagactagctttttaaaatataatatgaacatatgaatcagaggcaaccaatttttcaaagctatgaaaaagactcttttgtatttgtataggttgcatttaaaattttgaagtccttaagacacaggaaagtcttactcttaagttttcaaaactgtgtccctctcatctcagacctagaattttaaagtcccatttgcttttttcccctcacttttatttttatttgtttttgagatggagtcttgctctgtcacccaggctggagtgcagtggtgtgatcttggctcactgcaaccttcacctcccaggttcaagtgattctcccacctcagcctcctgagtagctgggattacaggcacccaccaccacccctggctaatttttgtattttcagtagagacggggtttcaccatgttggccaggctggtctcgaacttctgacctcgagtgatccatctgccttggcctcccaaagtgctgggattacaggcatgagccaccgtgcccagctgctttttaaaattaagacttctcagaagacctcgtgagccttgggtggacacccttcctacttcacatcccctgccattcctcaggtttttatatatttaagaaagctatggattgatttttacaaagaagaaatgaaacgtgtgctccgtaacattattttataaaactgatatgcattgtacaaattgtcacaccatatccacagaacagtagttaggaccggagtacagtagaaacaaagcatcttatttctctaatttgaaaaaaaaagatgtaagcttttcttcaggccagatttaagccatgttcaacatcttaatttctaaacaggatttttcttatctagttcatttcctatctcagcagcattaccaaattctgagtgatttatttatatatgtcttctgccagagacagtttctagagctattaactcatattatatgcatttttatgagtaaattattttggttattatatatatatatattcagtgtaaacaacatataataatttaatgacaatttacaatgaattcaatatctgtcttgaattctactggagaacaaagtttcttaaaggtctgtgcacataggccacaaaaaatctgggcaacaccctcttatatataagtctgcttatgtgcttccgcaaccacatgcctatctgctgagcaaagaataaaggcaaaagaaatattgcaattcaggatggtgaaaacaccgacaccaaaagaccaaaggagaaaactttgctcagaatctctgagctttgcaggctgaggatggagacttcaatacaggaatctttgtactaagttctagtcatcaaccccacaaactatgcttggaatatttggataaataaatgttatcaaattcccccagctagtgttaattactccccaatactttatttatttacttattcattcttttttttgagacagggtcctgctctgttgcccaggctagagtgcagtggcgcaacctcagcttatggcagcgtctacctcccggtgaagcgatccttttgcctcagcctcctgagtagctgggactatacaggtgtatgcccccatgcctagctaatttttgtattttttgtagagacatggttttgccatgttgcccaggctggttttgaactcctgggctcaagccatctgcctgccttggcctcccaaagtgctgggattacaggcatgagccactgtgcctggcccccaatacttcattaattcattattgacacaaaattctaaaaacaaatattcctaaattctttttgtttttcctatcctttagaattcattgtgttctacctaacatgtttaatgtaatttaaaactcagtaattctcaactaaacttaaaataaaaggtaattctgaaggaaccatttaattagagtagattgctgcattgggaattagacctcatttgtaacagatcctactgcaatgcttatctcttaaagcattactaacatttaaaaccaccttaaatcatatgatgagtatttatcttacttacttagatgtctgagccttaaaatcataaacagcttttgcaggcaatttctgaaaaggaagataaacaattagcactaatttaaaatttgaattttctacaagaaagtagtttaatgtgccttaaagaaaaaggaaacctcagggaatcatcaaacatatgtaatgttaatcctgtaagcaatttataaataagtccattcattcttcatttagatatttaagctataataggaatataatagaaggcttattcaccatcatatttaatcttaggaactaaggtagattaatgttataatgagagaataaaatgcctgcagaggtttgcatcctaggcatcattttggctgttacaaaggctcttcctaggataaatgtggagggtcaatggctctatgttctatggagattgacacagctccctctgaatcataataaaaggaccagatgtcataaaagaagtaatcattcccttcattagacacttattaacatattagcaaaaaatattagctcaattatcactgggaggctggttagtgggcaaaagtataggtgtgatcatcttgcattccctagagggctcaggaatccttcaacactctgtccaccagccactcgtcttttagttgtgatgtgatgtgacacgtgcccatcctcaaactctgggggccacagatctccctgaggtaccctgtaccctatagctagctaggccagctcttccttcctcaccaaccaacaatcccttcactccattcttttcccccatgactctggtgaactttaggaatcctggaccatttctaacttctttggggatcccacaggctctggactacatcagacgcctataagatcctctggagcggctaccagtccaagtccagcttttagtttccatccagccgtcatggctccaaggcagtttgagcaagaactctagccccggctcagggccctggacagagttcagttggtgggtggttcccaggggcagtatcccgagaactgggctggttaaaagctctttttagggatcctctccaataaaaggaagccagcaaaaatgatttctgtaggctctgtattgatttacaacacagttgacatcaggctttctcctggaccagcgggccaagaaattgtagaggaaacctattgcctccacgaggtgccctaactcaggacacttttaggtcataatggttaagttcatgggcatcaggtcaagactcggagaagcctcatggccaaaactgggccaccactagggaagacccacagctagggtcagggtgtggactgcttctagggtcagagttgctatgctcaggccccaaggaaaattgtttctagtttctcagtattttcacatttcctgtccgagttcgttactggtttgggataatttttggctggtaagtgctgtatcaagtgtgttgctgtgaaagactccaatgctattaaattaactacctctttttctggagttcctcttctttcccttggtgcacttctccccatgtcagtcaaagtggatgagtaacttctaggggactcacggtctattggaaagaacagggccagtcatggtgagtatccacttaattacaagccaacctgttccgccattttccctggtggccactacttttttccccaaatttggagagacaccgttatcgaacacatgggcataaaactcatagttcattacaaagttgtgaaataagacacaaaacaagagcatttcaaaaggaaaaatatctgaggttgcagaattataattgtctatataaatatgattactacattgctgattaattatattgccacacccagtaagacaatttatagttagagggatttttcatataaattttttccaaagctttctgtttctatgcctttgcttcttatttataattactattataagatttacagaggatggagaatttgaaaatagcaacaatttgtagaaaaagaaacattttgtggagtaatttaagactgtagtaatgaaaaagaaagagataaaaccaaagaaagtatgaggatgacaggagggtggtgatgaacattctccttctgccttactctcccctcttcgctcttcctctgtttttaaatacttattgaatctcaagatgccatgctgtttatctacgaccttcctttgtgcccagatgataaacaccttatcagaaagcaaagaaacaaagagatattgtttcttcttactccaagcaaaaaagggataaacagaaagcatcatgtcagttgccaaattgcttatgaaatattgaattatttttgttcatcttaaagcaaagcataaataatcacattacaaaattttgattgcatgtagttcttaatagtatcttataccttttgcacttacgtgacttacatatggagatgtaactagacattaaatgtattccagtagtctatgttatagaattttatcagtacaactgggtcaatatttgtcaattctttcttttatcccttaaatatatctagttatccagactaacaagaagcattaaaaataaaatttattttatccatctatgaaagaatttaaagtgctgattcataataagaaaacattgttttaggattttgactactttgatgatgtaaattctaagttaatatacttttatgatcatagggcctcataatgatcataaattttaaattactttttctaacccagggaatataagctatttttcacttgggtgaaacacaattggaaagtaaatattttactaaaaaacaaaatacttttaaatgcatttcaaagcccttccaagttacgtttcaaaaatgtactcctatctgcacataaaattgagagatggttatattaggatattaaaagcctggagaaggtagctaatttattaaaaaatgagattctgacacatttcaattagtgaaaattttgaattgtagaaattgattttttaaattctaatttattattttgaagcatgttgcttcagcctaagggtaggcaaagataaacgtaagtgtatagtgtagcaaaagtgaaagcaaacataaagactaagtagatttgtgcaagttaattaacaatcgagccatatttgacactagtatgaactgtgaattatgtctttttttttgtctgagattatattttatactataaattctgaattattaggggtttgaatctcttttctgttatctactctctgtgtgaccttggacgaatttcctttcctctctgggcccaacttccaaaattgaaaatggcttttgaaataacacccatttcataggcctatgccagttttattagataatgtatgtaaagcactctgtagtgtctggtgcatagaagtttctctgttgaccaactttcagcccggaatgttcattccagcctcttaaaatttacgtagtgaacagatgtgctgtaagaattaatgaaaataattggtcacaaatattaaaacaccctgggctgtaagttatataaatctcaaaaatagtcctctgcctttcaattgctatttattcttgtgttgccacttcaaagttatctatgaaaatagagtttagagtcactgttagcctgaatagtgtaattcaaatttcaatacaggactgttttagcagaaagagaaagtgaatgaattaagtaatggaaaagagaaaatgaatacactaaatggtggaaatgggacttttatatatatagcttaaagatacattcacaaaaattttatcaccattgtgtccttgaaatggagaaagctattaaacaaaccctaatttctttgtgtccatcaattactaatcacatatttcagttttgcttcttgaatgttttgatatagtatcttctatatagaatgtgacaaattatttattaactgaatgaatataaagttttaacgttaatataaacatttttaaaaggctatttgtggaactataggttttgattcatgtcacaacgtaatttattgtctcaatgtgagtagtggttgtttcaaccctaatgctgagctacaaaatggccttccctctcgttttcgaaagagtaaatttttgtgaattgatgatcactttaagccacacatcaagtccaaatatcacatgggcaaatgagaaatattcagtaagacatatttgcacaacaagtttttgcttcacaacacataacgacgccaaatggtctcccagctcgggagtgatgagatgttggaatggaaaatgaaagagctggagggtgggtctctgaaccacaaggaaaaagaaagaaaagctcatccaccttggagtgcaccgccacggtcttggtggtggcagctgctgttggctgtgtccacgtcttggaaagaggcactgcggggcattctcccgcagtcattctggtagggtggacaatgaatagcaccatcgggaggcagtgggtggagaggctggtgcagggggctcctcctcagcgctctcagggatgagttcctctcgggaacatctggcagcagctcactgatgaggcggtgcaggatgctgttgtccggcaagctcccccttttcttttcagctttaatttggtcacagatgtctttaagggcagagtccagagcctcaaacacagatgctttacattttgccttttcagtctgtttcttaggagccgaattttttttcctccggaaaggcacaggactgactagaaaagcaagtttagaaaggccagggtccatttcttgccttctgggctcctcggtgttttcgtgtctggctctttcgtgttttaacattgtggtaaatcgagtgtaggaggccgggcacctgcctttgcaggagctgatgaggtggcggtggtggtggtggtggtgatggtggtggtggtggctggatccgtaaaagctttcggaggatgtgaaggaaaagtgatcaaagtcactttcactgcagaaggatgacccctctaggtgaatgtagtcactgtggtcggacacaaccccgtcctggtcgctgtcggaaaactccacgtgtgctcggggctgctcatcgctggtgacttcaatgtgaatgggcaccagggcgttagactggcagcctcgccggccccgagcgggggggccgctttgattttcttcctccagcaaatactcaatggaaaaccgcctcttgggacataggccattttgcggtggttctagggttacgggagacagcatgtcatcccctaaatttggcatggatttggacttctggatcagcttttcgaattcggagatgcgtgtgggcaccatgtcccggggcacctcctccgtggagcactggctccaggcgcgcagcaggtccttgtgctgctgctcgctctcgtactgcagaatcctggacttcacggagcagatcacctcggagttcatcaggtccttgcggttgatgcggtgcattttcttgtacatcttcaggaaccccggggcgttgcgggctgacctgtgtctgatccttgatctgccgttactgcgaacctccgggacgtagggggacccccacgccatggggcagctctccttggagtcctcctcacataacagggagcccatgctttccgacttgactttcgggtccgggaagctatcgcagtcgtcgtttaggagatcgtcacagctccgggatttgattttgggagagacggtttcttccgtgctgctccagatttctgcgttttgccgggccatttgccagccgttcttgaaactaatggctcttggtgagtcccgagggacatccaagtgctgtctgtaagtgctacagtaatctaactcactggaggggttgccgttgagccctgagtaactgcaaagggatggacatattttgctatcatccccaccttttaatccagagcagcgtggtagaagagagacatttggagaagttaaaaggttcacaaagagaggagagcatgtcagtaaagcatcagacagcatagcaaggagaaagcagttagtgtgttttaatctaggtgctgattgttcacacatggagcttcaactctagagaagaaggtctaattctaaagcgagctaatactttttcagtgaatgtagctttgcagagagagttgacaaaactgtgtataagaagcaaccgacgtaagcaaatacacctactcctactgcataattcatacacctttctgacaatattgtttgccaaaacacaatagtgctgcttcagctgatagcatgatctggtagtgaaggtttaacaattagtgtcaaaagtgttatacccttacgcaatttaatagggccggaatttgagcctcatttgattcgtaatgatacataggtgaagaagggtttatacatttacatcgaattaatactctcatgactatatcaaataattttttgtgggttttagattttaaaagctataaggcaaagtattctccaaaattgcaaaatcaaaatgctgtgaactattgctgctaacatttttctagaaaaaaatagctaaagctctttaaacaaacgaatttacctcttaaattgctctacctttaaccttttattaggtacaaaattctcataggaaaactgaatataatgcaaaactttcatcagaggtgcatataccatgctttttttctcggaagagttctttgaaaaatcatttgcaatttgataatagagatctacatttggcctcaattttgaatagctatggaaatgttcttttgctttgctgagtcaactaataaatgaggagccaaattatatctaataggacattttcttcctagaaataaaatctaatggaggaaaatatctctattcaatacttataccttacaatgttctctaaattctttaaaagtagataagcacattaggtagatctgtactgtctgggaaaggaagttgatttaacattccctgtgatgaaacaaatatctacatttatcagaacccttttaacttttggctagtatccaagaataataggtcaatggcatttcatgacctacttgttaccttaagatattcatttgaataagtgagttgaatctgataaggcatctctgctcctcagaggaaagatgtgatggatggggctcacacgccctgaaccatcagctgatatcacagctttacaaggccttaaaagggctaggcatccacctactcagagtccaatcatcacgaccagaataccttttgcacacaaatcagctaccacttttaactaccatgtggcaatggttttagtgactatagttgataggtgtagctgaattggtctggttttatagaaacttacattagagctcaatttctttacacatttcaaaatctctttctcttctctttcaatcccaagatattagaggagattgtggggtcccacatttggtagagccctagctccctgtaggggctggttcaatcctcactctccatctcagaaatattcctgtcctcaaggaataccactaaatggtcttccagaaaccagaaggagtgacttctttcaacagtgagctccctacacttgcagagaggagacgggccatccagaaaaaaaggcttggtgattcctcagtgatatcattatggtttgggaccaattagtcctgactgtgagctgctgtgaattgaccactgtgttacatggcaggaggtggatgctccactgttcatgtgaaggtggcccaaaatatacagcaaatggctaaagaaattaataggtcggatttttttaaaatctagaattgaataattttttaaaaccctccaaaccaatgtatattttagccaacaatttgctctgttgctgcttgtaatttttatcctataaatttgactaatttgctagttgtagaaacattagaaaattttgactatatgtcaatgtttacaaaatacatcttttagtagcctgatgatacattatttgatactttcaatttgtttagaaagggatctatttgggggaaaaaagcattagcagatgctagtcagagttctttaagcaacctaagtggctcgccagcttgagtcagtctgggtgggaagaaggctattgttctaaaactatattttattccagacactgtaggtgagagctggcacatgccactatcactgggccagctttcacacagtgctctaggctaaaacgtaaactagtaaattgttgtgttttcatttactatgctcaccttttgctcttgatggggaagaaggagaagagctagtgaaagactttgtaagagtggtgcttgatcctgggaggtccactcggcctgggctagtcctgctcgcactttgatctcccaagccccgtggtggacccactgcaggctcgctcttcctccgcttcctgaagtcactggccatgcttgcagaactgaaagaaggaatcagatctgtttgattggcactggaggaggttcgggtgtgcaccagaaaaaccggtggaacgtgctagtgacaatggcgtaactcctaaacctctatccccaaaactgcattgctaggaactcatcccttgatgttcaacatgatttctctagaaggatcttttaaaaaatgaatagaccttattatttattttgagatggcttctggctctgtcacccaggctggaagcgcagtggtgcaatcacagctcactgcagccccaaactcctgggctcaagggatactcccgcctcaacctcctgagtagctgggaccacaggtgggtgccacctcacctggctaatttttttaaatttgttatttatgtagagacagagtctcactatgttgcccaggctggtctcaaacccctgagctcaagtaatcctcaagcctcagtctcctgaagtgttgggattacaggcgtgaaccactgtgcccggacaactaaatttttttagggcagttttaggcttacagaaataatgactggaaagtgtagagagtttccttatagtccctttcctcttgcacagtttcccttatcatttacatattcttttggtgggtacattgtcacaattgatgaatctttcctgatgcgtcgtcaccccaagtccatagtttacatttgagttcatgttttgtcttaaacattttaggggttttgagaaatgtataatgatgtgtgtccatcattaatgtgtcaatcatataaaatagtcttcccgccataaaaagcttctgtcctccagcttttcatccctcccttcctcccgctcatcctggcacccactgatctttccacacggcctccacagtttcgccttttcaccatgcccagttgatatcatgcagaatgtggcctctcaggttggcttcctgcactcggtgatacacttttaaggctcctccatgtgttttttgtcacttgatagctcatttctttgtattgctgagtcacattctattattacatggatgcgccacagtttatgtatccattcacctattgaaggacatcttggttgcttccaacttctagcaattataaataatgctcctaagaaaaccacctgctggtttttgtgtgaacctaagtttttaaacatctttgaacgtcaaaattctcctatagtgtaatatgttgattgagaattcagtgctataatttgtatcttgtatcttttctctataaagcggagttctaacaacatgaatatatccagaggggcataccaaatacaggaaataactgaaaaaaaaaaaagacatcaagagaggaaaatctctctcacctcaagggttgcctgcagcttgtcctatcatctctatcatcttagctttagaagatgttatattggaattccaacattttttatttaaataatgaatgaaggctgagtatgatggctcacgtctgtaatcaagtactttgggaggccaaggctggaggatggctcaaggtcaggagtttgagaccagcctggacaacctagtgagactctgtctctacagaaaataaaaaagttagccagttgtgtcatgtgcctgtagtcccagctattcaggaggctgaggtgggaggatagcttgagcacaggagtttgaggctgcagtgagccatgattgcaccactgcactccagcttgggcaacagagcaagaccctgtctcatcagtcagtcaatcaatcagtaccagtaatctggtcagcaaattaactattaaagattccttcccctcagttgcataaaatactgtcaatagtctagaacagcagggagtttctgtcatggttttgagtttgagtacagtatcatttaagaccaatgttaatgaatgaagccacatatggcacagcacactgtgcatgaaatcactggattcttagacaagacttgtgtagacaacagtgataatagcaacagcagcaaccccagctcctatggagcccagcagaatgctatgtgctttctttatgtttttgtcttatttagcccacacagcaaaccgatgaggtatatgctgttatctcagttttacaaatggtaaagtgaatacatgtgtctgggatgtacggaagcaagcggagaggcagacctcagaactggtttgtcctcttctgaagaggatgcatctcctagacctgtttttgctgggactgtcctgtcatgtgagggtctgtgtgtctttacggcaatctgtagattagattaaaactctaaaattcaaatattttaggtgcatagatagaggcagaagataaaaaggaggggttccagagttcctttctcagggatgttattgcagttggatggcactcagaaacccaatttatgattgacccaattcacaaagaaatctacatagaagggtaaattaatgctactagataaatatttgttattgatgttacaatatggctgggagtttgtattattcaatattactattgaactatgtctgaatatgtctgaattttgtgatttgtttttttttttttttttagactgagtcttgctgtgttgccaggctggagtgcagtggtgcaatctcgactcactgcaacctccaccctcccaggctcaagcgattcttctgcctcagcctcctgaatagctgtgactagaggggcatgccaccatgtctagctaatttttgtagttttagtagtgatggggtttcaccatgatggccaggatggtctcaatctcttgacctcatgatcttcccccctcagcctcccaactgctgggattacaggcatgagccaccgtgcctggccatgaattttgtaatattttttaaaaagtgtgatatttaaagctaatggaacttacttcaggcgaactctgagggaagttaggcctagcggtgacaagctatcttgcctcaatttcttttttttctctctccttgccaactgtgtaaacttggtaagttactaagcctaggtgtcactttcctcagagataaagtggggacaatagtatttaaccatagtgttttcttaggattgaatatgttttgtacttatgcctcatttattggtagtattaataacagtatttctgatttgtgtggtcaaagtatgattaacaaatacgtgtataacactttttaatctataatttttttcaaatatattattataagggccatttaacaacattgaaaattagttacttataattcccatctaaagaaaagaaaactgggtataggggactaagggaagagaaggatttctcagtctgtgaaggaatttataattagttcactaattttttagaaattcttgaaatgatcatataaaatgatgctgaaacaaaataaaacaacttcatgaggcatggtacttcaaataaaaatgagtgatacatgatactcattactacttcactgaataattttattgttgaaaaagaaaccactggtatagaatattctgctacaacataataagattcttacctcatgggtctttccaggcttctgtctatagaggactgatacaaggaggcctgttaagataggataatagtaccatgaaaaattttaccgtggcaaaattttgttcacttgtcaacattaaattaggtatcctaaaaagaatattataaaaattgaggttgaaagtaccattcattatgactataaaaatgtcttcccaaagagagatcatgcgacctgatttctacttgggacctatctgctttcccttctgatataatgcattgcagttctctgtgtagctcaaattatccacaacccaagcattgcatggggggaaattaataatattttctcagggacactgaaataagagctaaagttatcctacagcctgaactgcagaatcttacctgttgactgtaaatagaaatttcctacagaaaggaatggtttgatgttttaaaaaatttgtagtcatcattcaatccttataaaacatcacattttaaagtttttgttattgttgttaccaagtattgtcttcagaatgtaacacataagcagaacttaagacaccattcatctgtcaacatagacatgacgtttaaataaaacccacagagtttgacttgaagaaactaaataaagtacctggtacttcaatcaggtaaatagttatacttttacaattaggtgagttcagggctagtttaaaataaatgagctaatgaagcaaaatataacttttttaaagtgcgcttttaaatttttccttcattctgaataatacactgaaatagatagtaagcaaaaatgataatatgaattttttattttccatggcatctgctgggataattgctaaaatatctaaaaggcaagagaggacactgagctatcaagtgtttgaggtgacactgtggtatgatgtccagaaagcacagggagatggctgggtgcagtggctcatgcctgtaatcccagcactttgggaggccaacgcgggtggatcacctgtggtcaggagttcaagatcagcctgaccaacgtggtgaaaccctgtctctactaaatatgaaaaacgagccaggcatggtgacacattcctgttatcccagccacgcaggaggctgaggcaggagaattgcttgaatctgggaggcagaggttgcagcgagtcgagatggcgccactgcactccagcctgggccatgagagtgaaaccccatctcaaaaaaacaaaaacaaaaaacaacaaaaaaacaaaacaaaacaaaacaaaacaaaagtataaagaaagtatagggagatgtataccaagtatagatagttttgcctttggtcatatttgatgatcaattcatcacagataaaatttggtttgatgaagaactggaattctagtttaaaaacatttgtctgtatgaaagcttaaaaatgtcagccagaaaggcaaggtttgacaaatgttgtcttaagttgccatcatctagaaacattttatcagagtattaaacatctacttagtggaaatcaaatctcactttacaaactatttctataactcagttttctattaattggtaaattagcaccaattaatcaattaaaacaatacaattttgcaattctgtatgtatatcagtcttacaaggtcccttttgcataacttacgcttctattaactaatattttaatttaattctatcttactaaatgaaaatggaatcttgtctagaaacaaaagcatctctgcatgagaatattcccatcctccttttagacagaaaaagtggattgtaatatttttagttcctagaaaatatttagatttctaggttctcaacaaatataaaatcaggagaaaagtttggtttgctagtctgatatgtgtacatggttattttaatttgctgagctctgaatcagacactgggaaggtagaaaaatagatactaaatatgaaagaaagcaaacaagtaaaataaaatcagatcgttatattacaattaagaaatattaattctactcgtttgcagaagagcgacactgaagagcctgagagcatcggcgtctgtgcagatcacggctttcgtgggacaccctcacacacagctgatcaccaaaaagtgtgaagttcacaacactcttagaacaaccctacagtgatcagaaaatttgaattgtcaacttataatgagcctaaacaatattgtaatgtgaaataaaacatagtgtaagaactgattgtgttttagggttaggctaagaaactactatttctccttgtactggtttctacattcaaaataaatgaaaaccagttttgcggtttcatgtacactcagagaaagttcagtattaaattgtaagataagagtaaaaaatctagattgatgactgagagaaaaacttgtacaataattgtaagaagtgtactcatcccaaaatgaaaattatctccagaaaagaggttacaaattttaccagttatgatctactatttacatattaccattattttaacacacttagaaggtcaatttagtgaagtacagatactgaatcactctttctgttaagtagctatgagattaaattttgcttaaatatccgtaactgttcttcattaatgccagttttccagttatggattaaaatctatgttattcatggtatataccaggcagttgataaacggtagctaaggtaatgtctaatcaattacatttgtttttaccagaaatgtttaataacaaaaggttattaaagacaaaatccagaaccttaagagaatatattttcttacattctgaaaaactataatgtgaaattaataacatagttaacatatgctattagaatcatacagcaccccctctcaatcccagagataactggcaaatagatcaactactggcaaagtgctttttatgtgttgtttttttttttttgccactaccatcacataatagaatgcatagagttaagtttctactatttttatgcccaagaattattgtgtaatattaattaacagaactcttttcacaggaattcaatagttaacaagaaataatattaagtaagtaatttgtttttaaaagatttatcctctaaatatatatcttggaagtgctgaaaagtgtgatataaaggaaatagcacagaaatgaaggttaagagagatatatttttttttctgccactatcttaccatgtgattttggacttatttcttaaaattattgcactctacttttttttttaactgaaaaatgagtgaattggacatgatgcactctaaattccatttcagttatctatgaaccaactaccttaaaaacaccctagaaatatctgagaaaaatatctgaccacattgaatttcaaaataaattcttgggttgttcatatgttgaaataagactctttctgcagatattaaggtaacataacatacagaatataaccccttgttttatttgattttcttcagattacatgcctgcctgcctggctataaaatgtaagcctttagaaataactgaattcaataacccagaatgttcctgattactctattttaccttttatttaatatataaatattttgatcacttctcagttttaacacacactctgatgtttaccacagggtaaataatttgaaattgcaagttgagacgctagaaatttgcatattttcttgagactctatacctgcaattccagtggtcaccactatgtgtcagtagtacctcctacaacacaacggttctactggttgtgtttcccagttgcacatatttaagacttttaatgaaaataagatatttattgtgttatagtattcacttaagaccacagagcaactaatgtgcaaaaaacagtttatttacttcgttcccatgctagttgcttctaagagttccttgcaaggaggcttttatatagctgatggctagcaaaacagtgccatttctgcttgtgtcttctaatgagtcatttatccactttctaaagtaattttctgcttttctttgcagagagcaggttaacaagcttttgactctgaatcatttctgcctgtatcattctctctttcaaataaaactctgattcaaataaaaatatacattggctgccataaatttttcacctagttgattattataggctcttaagtagagattgcaaacgcatttcattttatatgccaatgataatttgttatagtggctgcctggattacagtgttgaaaaggagtagtcatgtctgtcatgggtatgaaactgggaagttgtgatacacaatttccaggtatttgccagccctattcttgactgataatacaatccgtaagttgtatttaggaaaatgaaagaacaaaaataaattttagaaatatatgggacataggcatctgattatccacactccaagcattataatagaatggttctaagaagccttcttgtagtattttactctgtctcataaaaagaggtggttaatatatgcactaagactaatacttttgatttttaattttcacgctgctgaataccagaactacatagaatagtataactagcagttgtggttggaatgattcttcacccagagtccagagatagccaacaactctggtataattaatgtccaggcaatgatactggatgcaacataatgatgcaaagatagatattttttcaaaaatagcttagacattacagagaattgtaaaacacagatgtgcagaatcacagtcacagcctctaagggagatatctgaaaaagagagaataacgtgtttttacctcattgaaaacaccagaagaatgatcttgaacatagtccagaggctttttaggaggctgggtgtagacgcaccacagaagcagaagtgtagggatggaatggaggagagtcaatggcagcaaggaatgaacatgtggaaaaggtgacaacagttagaaattgagtgttgacagcaccagctacacaaacagaatgacatgaatggagcaaaatgggggcagctgggaggaagtgtgcaacgtctgcaaatattctcaagcactgggaaaattggctagtgttcaattagtatatttataaattcattttgtcaaatttcattagcactcctagtctctggccacagaggaatgcaaggtaaattaaagaaacattaaaggagcaagtggatagcatgctggtgagtttccatgtgtgactgaaaatgattatggaaaatgctgataacttaggctcagtacagaatagtccctataagctttctttttgaattattttattttattttattttatttttttgagacagggtttcactctgtcacccaggctggagtgtagtgacaccgtctcagctcactgcaatctctgccaccagggttcaagtgattctcccacctcagccccctgagtagctgggattacaggcgtacgccaccatgcccagctaatttttgtatttttagtagagaaggggtttcaccatgttggccaggctggtctcgaacccctgacctcaagtgttccgtctgcctcagcctcccaaaatgctgggattacaggtgtgagtcaccacgcctggccgtccctataaactttctaaccaacagcaacaatacatataaaataaagctagagaatgtttttccttgaaataaaatacatttacattcacactaagatacaaatgagaaaaaatgagagaaaacattcctcctatgagataataaccctaagaaaaatcctttggtttatattcgtttacagtcacttttgattcagttcaataagctaccttgagtctaaccaagtctcctttgcagtttaatggacaaaagagactaccatcaccaatcagtaaaccatatatggtccatatgcaagtatataaatcagcatatggtatagaaatggttatatcctgatttctaaaaaaactatcagtgtaattggtaggttatttaagagtctaaaacgcataaaaacgtgtgtaactgacacacatcaaatgcactgctgttggtggatacagttcctaatcagggaagttgttaactgaacctccagttgactattttttttttttttttttgagatggagtctcactctgtcgcccaggctggagtgcagtggcgtgatcccagctcactgcaatctccgcctcccaggttcaagcgattctcctgcctcggtctcccaagtagctgggactacaggcacccgccaccatgcccaactaatgtttgtatttttagcagagacggggtttcaccatgttggccagaatggtctcaatctgttgatttcgtgatccgcctgcctcggcctcccaaagtgctgggattacaggtgtgagccaccgtgctcggcctcaagttgactctttatcccaaacaggctaagcaataaggcccaacctctgggcttcctctggcgggagtctggggattagagaagctgtgatggctttcactagcaagtctggaaattaagatccacaggacttcctgatttttttctttccttatatccctaatggtaaactaggtacagtcatgtgttgcataatgacgtttccgtcaacgatgcacctatatatgatggtggtcctatgggattataagactgtatttttaccatgccttttctatgtttagatatgtttaggtacacaaatacctaccattgcattacagttgcctacagtatggagtgcaggaacctgctgtacaggtttgtagcccaggagcaacgggccatagcacacagcctaggcgtgtagcaggctctagcatctgggtttgtgtaagtactctgcgatgtttgcacaatggcaagtccacctgatgacacatttctcagaacccgtccacatccttaagcaacacgtgactgtattttgtagtgggattactctggcagtatattatagtgagaactgcccagagattttcatttttctttaacaggctctgcgtttaacttcttactctgccatttactattttgtgcacattacttaacccctccagtccccattttcttcttcttggcgggacatcaggaggcctcgaggagataatgaagacagaagcccgcactctccaggtgcctgatgtttgctcagcaaacaggactcaatgtcaaggtgctcttctgcttgaactagaccaaatagactgtaaacaaatacaaatcttctatacagctgtaataattgtctgaatattccatcacagaaactacctcaagattttgaacttgtaatgaattagatgtaaagaaatcttaatgaatgacctacaaaccacataggaaatgtctgagcacatttgaccatttggtacagaaatgaatctggactacgctgtaccaagtgtgtgtatacattatgcattcggcctttgttctctgaatgacacccacgtctactgataattgtattttagaaatcaaacagtatactcctagttttcttatattaatagtctagcctcacttaccgggcgtccaaactccagttctgaaaagaatttataccagggctcattttctaaatctatgtcatctggatttatgcgatcagtctagagcagatgtgaaggaaaagggaaggaaaaggcacactgagcaaagtgagggaaacgctgtgtggcatgaaaaactcacgcgcgcattgacacgcaaacatgcatcaactctcaccccacgaacctcagcaggagagaacggaggaagtaaagtaaaacgagtagcatgaggatgtgaaggcgagctccatggcagggggtccctagctgtttcctgcgtccatcgtttctgattggcataagttgtgggcaactcttgcttgagttgatccacttacgcttgaggcatgaactatggaccactctctgcggcagcgagactgggtctggctggcacgcctgatgtttggaataggctcaacccagtcaccaaatagctcttttgggcgagtcacttcatcgtccctgccctcattggtggctagcagtcccagcatgggagcccgcagtctgcagacaattcactcgggtgcaggcaggtggtaagcctgggatggggaagggtgcgggaggggtgggaagacaggcgagctggggggagggggacagggcattggggggctctcaggggcctgtggatgagaagattctggggcctggatgggtgcgagcgggacccgggggagtgggagtcgccaggctctgagcaagcaagggctgcacctgcacctctgccgggcatgaagaaaggtaaggaaggaaggagctcacccgggtgggagacagagccggggcgcgcgagcttggtgtgggggcgccactccggggcggaggggaggggctaccagtgacttctccgagtcgggagctagaaagaggcttccggccaggttcccttggaacaggtgtcggagttgttgggagagggggctgcaagaaagaggggtgcagaaactggttcattagatggaggctctgggcggaaccgcgaggacaccctggcagcgcgctgtgcctgcgttaggccgggaggggagaggcctccggacggcgaagtgtccctagggacccagacgcctcgggagcgatccgggccgctgcgaagccctgcccaccaggagtggatccccaggattcacctcccggctgcctgctctgagctgagaaggggatctggttcttcacaataccgtggatggcggggaaggggagggagcctggggtaaaatcccatcttggtttcctcgatgttctaatttagagaaaaagccagttttataattgacctgcttccctgcagaggtttctgaatgttgtttttaagatgaaaaaactagcagtgttaatataaacagttggagaaaatacatacaattattctagtaatagaaaacagatgtagagtgtttaccttacccagcagtgtccttaatattttcaaataatacatggctgactagattgatttaggctgctgattttgtagtaaatctaagagcttaaagtactatatacaagttattacttctttgataattactatatgacactaattaaatgtggtacaattgaagagtacagtatcttaagtcagaaaaaaaattctaagaaaaattatatggttccctaaaagccattcactctggctaggagaggagctgtgactcccaagacatattctaggaggactattaagtgctcactgcttcagaacaattcaatatcatttgcttacaattcttaaagaaactcagggacttaaactgaatagcgacatcttggttgtgaaaaaaatgctatgtaaccttcgcagtgctgggagcttgaaatgttccatattccaacaaaagccatgattttgacattgttctactgttttattgactcgttgcatttacaagttttgctaatgatacacagtctacacttactaataaattatactcacagtgtttttagtgatgtgactttgtttcaatattttataataaaagattataggagtaattacagacaatgatagaaaagtttgaggcatcgtgacaaaatagtgcaaaagcctaagttatccaaaagatgtagtgatcataattataaagactgtgtagtgtccctgggaaatgcttacaatgagataccaagcagtcaaaacggaatctaaccacgcacctgtacagtagttacaaaggtattacaaagcttgtctctgcatgaacacagtaaagaagtcacacatacacaaacgactacaatggtgttctggtattgcgactgtttgttttttctttcttttaaatattattttgctttattgttgtaatgttatttttgtaataaataaattcagagagaacatcctactattagacataggaaaatgcctagaaatcttgagatatttttccttctttatgccagtattatatttggtttacacctcagaagtaatagtgaaattggtagagacaaaatattctagtaaccaatttgctattttctgttgaatttaaaaatttaattcaatttatatttgattcaatagttgcaatagtattaattgagattttaatgtccataaaatactatttttctccaattattatttagatcattatagatgcataattgttcgtgaaatggctttgctggagctggtttttagggtaactgacaggagagagaatttccagtaatttctcttctgtttagagagacatactatttcttctacaggaaaactaacctctgactcttttaaacttcatagtttctaatgttacacactgaatgatatcattaattattataacttctgttttcaagaatagtattttgttttgccaaggggagatagaaacttctcttagaggaaacgaatctgtttaagaaacattatgaacagcagagggcagccaacttactaaatgaataagacttgttagctatgtagcttcactttgactcccacattaagaaaatatgtaacaaatggatataccaagtcctgatttatagtaatgcatctctatgatagaatatggaaaaggaagcagaatatctaccatcttgcatcataccttagaatggcagttttccatgaattatgcttttgtttatttaaatagtcaatttatagttacaatgggcaactatctagaatgcatgccaatagaaattagcagagaaaacacccaaaacaatgatagctggtaattatcgataactttggaatgcaatgaaaggcacatgtttgagcagagttgtgttaaaggaagtgttagtggcagaactagaattttctctttgctgtggttgccgtattgaatcttttaagtcatgcaataattaaatgtcctatggtgacctggaggcactgctaaggaacacagaagcctcgcaacagtcagtgacacacatacagatggtcagtcaacagatggatatacacacaaatcactaatctcagtaatttaacactttccatgtggaacatggacattcctttgagtacagcactaatattaacactcagaaactcatttaggaggtatgattatggtttactctaattgctcataaaaggcaaaagagcaaagatactgatatgcatctttctagccttggtgtgatttttttgttgttgtttcttttcattaaaaaaaaaaaaaaacccaccagcaaacctccgtttaaaactaactttgttagtcatcagtgcaagaggacgtgttcaagaaaagctacaactataaatcacaagtgatccttacttaaaagctaccaagggtgaacaactttaaaaattttagtgttttctataatttaaaagcatttaattgcttttgtggttatcgagattccactaagtattctcagtgaggcatgtgctttctatacgttgttctaaacaaaaagaagtgccagggctattttgtttttcaaattacgctcattccattttaagttttaatgacattgactaccgtgttttatatttattgtggtttcacaataaatgctatatacattattagttgggataattcttaatggtcatcagatgaaactccttaaatttttatagttaagtattgactgacaatctttattgataaagaagcttaagttcattaagggtttaagttgcatttcaactctgctacagtgttttcaatgactattttcttctgcttttatcattatgttcaagtttagttattgtaggttagggtaacattttcatatattttttttttactttatcaagcatacagaggtcctaaacaaatgctttattaatttttttttttaaatttaacattactcacctacaaacatatccaatgcaatgggatataaaggttttagtaatataatcccagcagagtttttatgattgtctcatggaaaaattaaattgtggaaatacggttctgatttgtggttcgagtcagttcaaggcaaattcctggtgactgctaagtacttttccagatcaaacattaggcccaattaattaacatttctaaatttacagtcacatgagtatttatgagcttcaaaaaagtgcgctcacttttactttccctgttaaagaacataaacgcatatgccactgattcctaaggaagatctctttgccagggtcttgggaagatttttgttcaaacagtactacccccctgccttctctgtatcccagggaatcgtggaattatgagtcactactaatagcagtgtgtcaaacccctccaagaatgttttgagacccactgggccttttgcactagaaatatataggcttcatggataaacaacagaacaaggattcagtccctcaccaactttttccactgactgcaagggtgaaacctgtgttccttcattcacttagaaattccacgaatgcatattcactgaacacctgctacaggccaggcatcgtcccaggtgttgggatacaactggtggaccagtcacagccctcgccttcaagaagctcaagatctcatgaggaacacagtgtgccatgggcacacagcagggagagcctccaacctaatgcagaggagtcaggcacattccctgggggaggtgggactgtgctgggacctggaggatgggatagaattctccatgtgaaggaagaggtggtggggagagcttttcctggtggggaggtgcagcctttacagaggcccagcaatgcgggaattgaaagttctctgtgcagctggaacctagcgaggcagggagggtgggaggagagatgaggctggagaggtcagctggagcccagtcacaggtcttctataaattatgctcagggtttcagattttgctcgaaggacagtgaagagccagagaaaattttgagctggaggttttataaagattttctaaagattgccttcgctgtggtgtggagactagactggagaggtagggaaatgaatcaggtggctgtcactgtagcccaggcacggacaattgtgggccagaagagaggagcagcagtggcacttctcctggcaggcgacactgagtccactgcaggagaggggaaaacccaagatgaccctttggaaaagtgggcagatggagaggccatgtagagattcaaaagagcaacacagaattgcccaggtgttgtgtatatttttcaaaaattgaaaatgaaaagagcaaaggaatgcttccaaggcatcttggagtcaaaagacatgagaatgcatgaataagaccttgatacccctcagcgctggccatcgctgcgacgccactctcattcagcacgcctgctcttcaacctctagcctgtattttcaacacttcagaatcttatgtaaactatatcagtacgcggccagtctctacatcaccacggcccacttggctctttttgttttctaatttatagaggcaattgaaacgaagtcaggactaatttttttaaaaagatgatgagctggtcctacactggaaaggctggccaacatgtcccatatggccagctcaaaccattctgcttaaggctggtcctctccaaaattgtttaggagggttaacatttttggttctttctatttctccataagatagccattctcacttccttccaagtttctaagttccttctacttatcttctcctgtggctgcagagacctatccacactcgaatctctgtcacactcatggctccagagtttcctgtcttacaaccagtcacatctactggtcctgtgtggtaactacttagggcctaagtttctgataaagtaaatcaagtatactttattgtaaattagccaataaataaattaatttatactgcaaaatcatcaaataagggaatcaaataactgctacttcaatgtgtttcctgctcagccacacctggagtggctgtacagcagcgaccaagtgcaccaggcatcagtatgcctgggctcaactcctagttctggctcccaccatgtgtccctggggcaaggcgagctaatgtgtgtttcagtctcttcatctgtaacatggaaatgccatgtgtctgcttaatagggctgctggaaactttacatgagataaggcataaattactaattacagcgcctggcatatagtgagtgctcaataaagatttacaatgattgctattgctattattattgctattgtaaaacgaggagtctttaaagtcttttttaacccaaagacaagagtaatgtgacaatttcaataacaatgatagggtcaatgtataaaccctaaagggagcaaagggagggttttttaggtgtgcgtctgttttaaccatataagaggctgtttactttgcacaaactcagatctagtcttgcatagatattaaatgatagacttgaagttcctcaaggtagagagtgtgtcctgttccccgctgtgcacctcacataaagcctggcatgtagctggtgctcagtcagttttactgaatgactaaataatagaaacatcgtggtgggagagcgtctaaaaccaatcctgtttcctgacaccacggctaccaaagcattccaataccattaccatgttcgttatcctaagagtctcataaattactagaaagatcattaaaattttgttatttaatttaaatctgagatatattatttcactgttttcaattttctgcaatgatgacattgtgtttcactcaattctcattctggaaatttcagagtagcatgatactcaatcacagaaactagtaaatgggttacaagtttgcaatggtgcctgcaaatcagtgattttttttttctttcagtttttcttttgtagtcctgttactctaaaagatatgagttatttaaagaaagggtaagaaggcttagacaaatatcatgtatgaattatctgatgataaggttttgaacatgcttctccagaacacaaccgcaaacacagggtttcaaagactcaatcaaggacactcatgttgggtgtggcaaggctagagtttccaattaaaccacagggctggccttggattatatatgagtgtgatttcttggagactcttgaaggagctccacaaagaaaactctctttttcctgttcactgacacctaaaattcttttaaagcaaaaatgagagtaaattgcaattgattgcaaatgttttcctagaagtaggcttggaaggagatgcagaggaactgtggagtttcaaagaaaatcctgaggacactgatttctgaggggaagcaaaggacatgcaagggagtattggggaatcaaaaccaaagaaggccaagggaagacctatgtgtgaacctgcgcttcgaggaggcaagtggttcttcttaagtgtatagatatttttgtttgcatataattaaataattggaaaaaatcctgcaaagtgaaatataatcttgatccattagaatgacaatcaatcaggaagcttgaggcttggtaacctgaggagggatttaataagaagcaattaaaacaacttgttatgaaaagggcatttggaaaattctcccttcatccaaagaaatattaaaaagccaatatggaaaacaagggatggaactgcctgggtccatgtatattggggagattaattaatgatttttctcattagcaagctatgatagcaattaagtattgcacttatgaacttttttaaaagttaaactctgattaatgattaggcacagttagagttacatgcaaatgaatcttgcatataaatatatatatgtgtgtgcatacacatgtgtatatatgtgtatgtatatacacctgcatgtgtgtgtgtatatatatatatataaatacacacacatacacacacacatacacttgtatttggtcagtaaagacaatatattagaacatgtatctttcaattctgagatgagatgtacaaatcattatacaaaataaacatgatttctaagtgattacctttgtgacaaaaattgctaatgggtctgaaattcaggtttattggggagccctgggagcccagcgagctggcatattctgtttaatgacaagtgcttactggtctttcatgctgaagaattgatgacttgccaggttcatattcaaaaatactccttggctcagaccgaaattttcttgtgtccacttttctgtctggaggatcccagtcatgcctagaaataaacaataaatcacacattaaaataatcctttttgcttaaagcaattgtgtaaaaccagttatctgttttcaacattacttttagcatagttttaaaaaaaatctctcaggataaaaagttaacctgtgaaaaataccacattcccccgccactggctccaaaagtcacatgaggggtttgtagacgcgcagagagtgagtccctgggttcctaatggcagctgtgtatatttgtgcttaaaataggtggcagtatgctctgctgaactatgagcatttaacccaccactttgtgacctttgggatccttgatccaaagtgacaaggagtaatgcacacaccatgtttgatcttatttcttgaagtgggatcatcgcttgggaagagcacagaagtgtcatgtgggttggcgtgcaccagagcaggcagtgtggaacaggaggtcgtcttttggtgtgagccttgaaaaaccagagtcaaacatctcattcatgggaaccagcacttttcccccaaggaatatcttccaagaggctgtcagaagacttacgaaggaaagcttcaaaaaagggtttcacaaaattaagcttttctaggctactgagctaaagaagaaggcttctttttttttttttttttcgagacagagtcttcctctgttgcccaggctggagtgcagtggtgtgatcacagctcgctgccatctcactcaaactcctgggctcaagccatcctctctcctcagcctcccaggggccatgatttttaggaggaaggattttctgactgtagataggggtaattctgcttccatggaatggaatgaaattcttgctccatggcccgttggaaatagaaatactctaagagacagaattagggacaagccctagctttctactaaattcatgactgatatggagcaagaccccttaaactttctcagtcttcatttttttccatttgtgtaaaacacagacagcaataatgtgttgttcttccttgcagaggagttttgagcattacatgagataatacatatgaaagccatatggaattttttaggaggttatcatatgttttaatgagatatttaattttaacaaaacatatcagatgggtaatacctttaaatcaaaacgttaattttggttattttttgatgacaaagataacaatttgtgtctagaaaactgtttctcaattttaaggcctcacataattcatcctgaggagattggtattaaaatgagacccctttcacacacgatgtgtgtgttttggtgggatgctgtgccctatatgatcatcaattactctattataaaatttttatttgttttttttttttagtgaagatgggatttcgccatgttggccaggccagtcttgaacctctggcctcaggcaatccacacaccatggcttcccaaaatgctgggactggctgggtgcagtgactcacgcctgtaatcctagcactttgggaagccaaggtgggtggatcacgaggtcaggagttaagaccatcctggccaaggtggtgaaacaccatacaaaaattagccgggcgtggtggctggtgcctgtaatcccagctacttggtaattgcttgaacccgggagtcggaggttgcagtgagacaagatcacaccattgcactccagcctgggtaacagagtgagactccatttaaaaaaaaaaaaagtgctgggactacaggcatgagccaccacgcctggcctgatcatcaattactcttaatggtacaatagggtgttgaatacaatttttctggaatgggtatgataacacttaataaccagtattaataagaaataatttttatattcttatttattaattgctaggatagcataggccttgggtttaatcagagctgagcttggaccctggcttggacataacgagctgcatgagctgagtaagttcctaccattttctaaactgcagtttcttcctctttaaaatagaaagtatctcactgggttgttctcggaatcaaatgatatgacacagaaaaagcacttagcctagtgcttggcttgtaatgagcgctcaatgaaggttacctataagtagaagtattagtcataatcccagtaaaaataacacaataaaaaagtgtttataaatttttattttcatgtagatagtttgtataaaaatatttcagtggagaaaggaaaactcgtattagcttgaaaaactggtagaaacaagtcacagacacttattaactaatgcctcattatgatttttgaataactttccctgctttcaaaaatgtctcttattaatagacctggggaaacagaaaatgaactgcatagcctgtaacctggtatgccaaaggaagtacatgtccattatttctatttacttgtctcttatatgtatgtattgatcaaaaagcagaaaatgtgtccatattacttcaagtctaatttagggcactccagtatcatgaaagaagacagggaaaacatttgctacaatcccagcagaggaggtcaatatggtatatgtatagactagcaagattacacatccgctctctctgtggcaggtgcactgattcttctactgaatgccatgtagacttatttttatcctaagcgaaacataggccaccctggggggaaatgccttacttttctgttgaagaccgatctcttggtcgaagcggcgggactggaggtggaacatgtgggggaggcactggggaggacgcatccttaaaggcattggggctgttgtcggagtggcttttggaaagaggtctgtaggtttgggtctttgcagcagggtgtgactgagcactgtagggtgggttgtacagacctatcatgacaaaaaacaaaagcagacaaaaaacagaagcaaatcacctcttaaaaatgaattaaattatttgtccccctcaaaatagccaatgattgcatagaaattattatcaataagcatattcataatgcatacattagaaggtagtttcttaatttattaatattaatgtactaatttccattaatttattaattacaaatttattctgtacctaagccctgattacagtaaatctttgtcaattatttcagaactagtaataattcagactggtactaggaatagacttataagcactcagcaaattttctcttcaattgtatacactaagaaaatagttcagttttcagagcaagattaaaaacggaactgtttccaaatatcttctaatactttaaaaaccctgatttacatatgaaaattgacatgctaattgtagtcaaacaaaatattgcacacagttgtgtttataaagtgctgtgcaaggtacaaggaaacatgagtcctcaatatgcttagagtgcacctgggaaaatcagacacaaatagaattatgatggaaaataattggtaaaagataataaagaccaaatgaagaaaacacatagtaagaattaaaggatgctagtaggtggtagattgctcagagaaggtattatggaacccacgagtccagagtcagccctgaatgagtttcggtgagcagggcaagaggggagcagggatggtatagaaaaaaaggcagaaaagtgcaaggtgtgaagccatggcttgcacggttagtagagagcaaagagactagctgcagttgactcgtccactgatcaaatgatcagcttgtagggctgtacaaagtaatatatcactgctgttccattcactaatcactaatgtgacacaaacctcaatattaaaacagttataaaaattctaaattttcctgcacccaatcattggagctaattctatttgtacccgttcgcttctcctgaaagtccatgcacatttccacagcaaatgaaaagagacaacatctacacttacagttttgcttggattcaacagtcggacttcaacttttgagctaaataaaggaggtgagtttggtgggcgtgggagcagggatgaaattaagggaaacatctttgtgggcctgaagctatcagtggggcgagccaagacttaaacccagagggcttgctgagtttgttctactgattttccctctatcaatttgtctttggagataggagcacaatcccaaatagttaaagggcctgaatgtggtctccaggggtgcagaacaggaggatcatgcgaccccaggctgcccagaggaccccaagtgaggttgcagctgctgaaggggaggggagcagtgccagcctccgagcctggtctaaagaaagaagaaaaaaaatagttgtgcacctgtcctgagcctgtgactgggcagggagaggagccctgggcagaatcccgaggcaacactcaggagaaagtgatgaagggaaaaacatttgtcaggggtccctccttccagcctgcagacccctgcacgagataccaaggctcgccaatccaagtggcagtgcctggaactgaagccattctattgtgaccactggcaattctgagtcagaaaagtggccccgccaagggggatttttaaactctttcaatgaatggttgcattttggagcaaaaggcagggacaaggtcacagaatactttgtttgacttgtttttggtgaagtgtatctgaaagatcttacacaattgtaatcattctctctgctgataaaagatctttatcttattttgtaccctgggttacagtgtgtcctttcagcctatccttcacactttggttaaacattcctgaagctgagaataaaccaacagtgggaatgaatgagataaaccagtattagttctcatttccatgagaaaagtcaatccttttgttatgcacgctctgagaaaagaaaagaaatcctcctcctaatatatgaactgaaaacatgtgctcaaacagaaggggaaaaaaggtgaccgtgtcgttcttccaaacattgctgagcataaaatagtcattgcgagcaaggaaacccatcctacctgcattgtatgtataaggagtattatacatgtctgtgtcatcatctagaaaatgaaacataaatattatggtaatatagattgtcaccaaaggacaacgagacagcagaacttcagacaaacaacagaaatttgttagaaaagcaacgtatttttcctagttcataatgccattttctttctttttttctttttttttaagagacagggttttaccctgtcgtccagtctggagtgcagtggtgatcattgcttactgcagcctccaaacctccaacccctgggctcaaatcattctcccacattagccttctgagtagctgggattacaggtgtgtgccaccacaggcctctgcaaactgcccttttttatctgtaacatattcgtcttgctgccctcttcgtagcatgcaaagtcaggcccttgtcctcgcttccccagaaacctctctgctctggatcgcaaatttcctttactaagtgctttagtggtctcctgtctacagagcaggctcaggcagacccgcgcaggctcactctcctgatgagagcagacaggggtggacagaggaacaatgtgtttttcacccaggcaacacaccaatttagactgtggacaggggaggatggagggctgaggccagagtgcctggttgtcctccatggggaggcttcttggcagctcaggtgggaggcagaggcacagggatctgtcaccggaggggtgacagaaggagaacaggaggcatgctgaaaagaaaggggacacggagtttgctggggtcttgacattgtgtgtgaatcaaaccgatgcaaaagacgaatgtagtcccttcaacccacaaggacctcatcagaaagcagagcagcagacatacccggcttgtgcaccatgtgaatttgcttaaacatcgtcttgtaccagtccttgggccggtcgactgtctgtaatgaagagagcgtccaatggttacaaactggcttccaatcaacatcgcttctcagtgttttcatttctctattttatgttcttaataacagagtcccattctgtgataaaatgttctgactctttgctatggcttcatgacagtttcagcaatttacttagttatgtgtgcagtttgtaaacatatggccttgtgtttgaatttaggctgagttggaacattagatgctatggttttattttttcaagttatagctgtaccctgcactagagagttgatatttgcacaaatatataaagttcacttaatgtaagttattgttgtactaatttgtttaactccttttggtagataatgatcattatccttagatgctttttattgaatgttctgtaagacagtgttttcagaattaactggggaatatttttgactcaaattgtattctgatcagtgtggctctagagaaataaatttgctatttactagtctaagctactaaaatactgaatgtagtaggcatcccagagtcctacggaaaatttaagaatgtagatattgcttcaaaaatgctaatatgataacagagtgtatacaacatttgctcggctaaaattgtaggttccttgagagtagaagtccttacggatccaggcgtcggacatgaggggagcagtaggctgtagtggaaagatgaaattaatgtagagtcttgaactaagattcaaatcttggttccttaaattgctgcttaatacaccctagcaatacgaatctgggcaagtcatgtcaccttcttgagcctcagttttctcctctctaaagtgacataattatatctaaatcataggattgttatggaaatcgaatgagacaatgtatacacaagacctagaacaatgcctagaatataacaactactcaataaataataacactagggaactgcaaatatttgtagaatgaaataatgaatgaacgtagcctattggatagagctctgcctttctggatacctgtaaaagtagacacatgcttttataatcgtactcacagattttgcttggcaagatcttaccccaactctctgagagctacctgggcaacaggcttgatgattctgcttatagtaactaaacacaccagacgttccaagacagatctcgatttaaaaacttctgttaggactgatacgaaagcattcttatacttactagactgagctttgggttagattttattgcctgatctttttttccccagaaatgtggtcactgcatttttcctctggacattaagggttttgtgctatatctaaatttattttgacctctgagaatatattattctgaaaaatcaccccaaatacaggttaacatgaagggccacttgacttcgttatgagtcagctcttcattctcggctctttctccatggaagagttgaggttattgattgactattcagtcaaaggacgggacatggtggaagggattgcagtggtgaagcaaaggtctattatttgctggttcaaagttgctaaacatgtatctttcaagaaagtttatttttataaaggactgatttctctttcattaaacctcatttcttttactgtaccaaagcaacagaaaatacaacatagtgttgtgcaaaaatgttttcctggacgtgctgatggcaacaaggaagcctactaagtaagtcctatcactgtatatggcaatacatgttgacagacaggtttttttttcttcacttgctggagggcctatatcaggtaggatctcacagtgatgccatctgctagctttatatggtgagcacaaagatgccagaaaatgccctgctggcaaagggaaatatgaagctggaaaaataaaatacgaaaactctatgtccctttctaaaagaagtactctaagcatttaaagttccttttgtaaatgccatcatggagatcgctatgcctaaggctgagaataagaaaatagtctactcaaatttcaggaagtttacttttgtacgtaaaatcattttgcatgaaaaatagctactagcaattcactatgccgttttttctacaaccttgactaaatagacctgaatttttacattcctacagttttcaaaacatcagaactctacactgatttaacacgcagagatttcaaaaaagataaaaaaggacatattttctacatagcagtatacagtgactctgttctatttttttctccttttcagttttgaaaatactcaaacaagtgttatattggaagtagaagaaaagaatcttgtatttcacttaactagctggccttaatgacacaatctcatgggagctgagccctggcgatttttgttgttttgaagaacagcactgaaaggttcacatagatgtcccaggtcacatgagagagggcaatctggagagctgattccctgcattaaaatagctcaaaagtactgtttgttgactcttggctttctagagtttctggatgactttacaaaattctgtttcctcggcataggctggctgtctaaaacgatactgcagcatggtacattgtgacagtaccgcctttggcaaatacactgaatctgatcatcattactttctacacatgagaaagaaaaacaaccttggagagtcttggcctgctgtggctcagagacagcctgacttgacatttataaccacagctatacatggggatgtactctggagggctgtatagtcagtgtaagaggagagtcctcatagacctggaccttctttgtcaagttttaaaggtccaagtaagacaacaattgtgcataaaaattacagttccttataaggaacttctgcattggttatattgtgttttctattttatagaagggaaactggcattaaatgtttagtgtgtttgcttatgcatacccaaacgtgcttttgatttggcagttgataaacattttaaaaattttaagatgatttaattttcatcaaccatctctagcatctcagtttttccttttgaaactaaccaggcaaagtctggttagttaaggaaattatgtcttataaaggaagaaaacatggaccaggcttgcatgtccattatatatcatttattgacctaaaaacatacccagatatctttgataaaatcctctcagacagaatctataactacatagaatcagggctttcttaattttgtctatactatgcctcaagtgccagttacacaaaaccaatgacaccatttctgtctgactgtctatccctatataattagaagaaagtttcaaatttaaccattttgagtcagaaatcttagaagggaaatgaacaagaaaacatcatcaccagaaacatgtaatcatcataaaatgaagaatattggtcataatccctgaacttttctttggcacataaatatggcaatcgtcagtttcaagacagattgttagaatgtcatatcacattcaacgtttcctcaatctaaagagtctaaaaccccagtaactgctgtacagatttactttttggctttcaattgtaatatagatgctgagaataatccattttaaactcttctgtctgtatataaaacacataatccccatataagaatgtaaagtcaaggagagaagaaaatccccacactttatcgttagttctttttgactgtttccaatcttaccacggctttttttttttttttcctgctctctttcccattctttgcctctatcccttattgtcttggctgcccaggtctgcattccaggggagcagctcttggccacaccccagctttacatgggtcttgctgcaaagtatatgcagctgcagtccctccccgcatggcccccaacttcacctgcaaaggtgttgttgctttcatcctgtccccggcttccttctcccggctggcacaagccttctcttccagtggacttggtcagccagctgctgcctgcccaggctctcagaagctgcctctgctactgctgcgttttgccggaaggggctgcccagatacactgagcaatgctttggcagagttttaaaacttaaaaaaaaatccaaacactttcacttatcatcccaggagagctctcagcaggcacggctgaagagggacattaaaatgtgtatttttcttcagacagcttttcctttccatgacattaactctcttcactccaatcatctcacctcccaactcccaaatcacagcttccaatctcccggtgttaacacacatctatttcaaaaaacgaacacatcactgctttattcgcaatgcatgtgggaattcaatgcagccaaagaatttccattgtcttgttccttctcttttctctctattgccctaagcctccttggtaaaaggtaaaagaaaaacaaacaaacaaacaaactaaaccacacaacacagttttaccatttaacaaaatcgcaatgttcatgatgtttcattcaaatggaaaaacagattgtgtaattctctcccatcaacagctttctttctctgccacacacagcataacattcatgagaagtcggatggcacggagggcaatcctccttatataagaccctaggaatgcacaaagccgtggacaatccgtcctttgtggagtctgtgcacagccccagacagacgcacacgctggcatttcctaccgttctaattgctgtggggattccggattcatccacgggcccgatccctgggtaatgcggggctttgatgactgtcactctcttctcttcctctgaggatcggtacagggggatagagctgctggtggtgccatccagagactgcgcatgctggggatatgtgtctgtggaatctgcacagaaaatttggtaacatggaacgtattcgttgcacagggaatcataaattcatgtgtcttgttgtatatttatgccaactgtaacacagagaccatattgccatcactgtcccttttaactcatttactttccatctgagctggtggaaactgtgtaggtgtgcggggaacagacctataccaacaagggcctcaccattttatgaagaaggctgagggaagaatggcatttgttaaatgactgtgtggaggcctctgagttaggaagtgctctaaatgcattatctcttcttatccttccagtaatctttgagggagggcaggatagggggagcaagaaccagtgttatagataaggggcaggagctgagacaagttcagtaatttccctcaggtcatcatttacatcaatattattcttgtgatactgctactactattatttataggttttgaaatgtatttccagacaaagacatgactgttgagtcagtaacagtgatttcataaaaatgaagcaaaaccaaaaatcacttaaaaaaatcttcacatccaagcctttggacatgaaagcttctgaataaataaatgctgtaaaattattagtacgatttcctatgtgcatttttaccttaaaatatcaaaaactatgactttttactctttgatgacaaaaactgccctaaggatataatttagatgaggcttatcgagttcttcatgttttttagtaacttctagaatactttcagaagcaacagagtacagacatgcagtatatagtccatttacttctaatacacaggaattttaaaaaaatcatcattattaccgttcctctggtatgattaataatatgcctttatatttttctgcaattaatttgaaaatgttggtgacaaagaatgacactttgtatatactctttatatcatggtttgtcaggactgccactcagaaagtcctttaaggtggaaatgaaaaaaattctcatgtttcagggtgggactcattgatatcattatgtgtatatgatatatatcatgtataaatgtatttttcatgaaaaatttgtataaaataagtaagctttttttttttttttttgagatggagtctcgctctgtcacccagctggagtgcagtggtgtggtctcaacctcagcctcctgggttcaagcgattctcctgcctcagcctccagagtagctgggactacaggtgcgtgccaccatgcctgtacaaaaaatttttgtacaaaatacaaacaattttttgtatttttagtagagacggggtttcaccatgctagctaggatggtcctgatctcctgacctcatgatccgcccgcctcggcctcccaaagtgctgggattacaggcgtgagccaccgtggccggccataaggaagctttttaagaaattttaactcatcaatataagggtaattaaaattcagatctctctgaggtaaaatccattgtaacatttgtaactgctattactatgattatgactattttcaatttagtttgcatcagaaagtcatttttaatacattttttgatgaagaatggataaggctagttataaaactgctttatgtgcagtttatgtgctggatggtgacataaaatgtccctgaataaacgaacagcatcatagcctttcaacactgaatcagtgctggggaaggaggtgtgctggctgctgtcaaagaagacatggtggttgaagtcccgggttgtagtttctttccccctgctactggccccttgaatgtgaaaataacattcaagctagtccttatttttacttctttattttttttgagacggagtcttgctcagtcacccaggctggagtgcagtggcgcgatctcggctcactgcaagctccacctcctgggttcacgccgttctcctgcctcagcctcccgagtagctgggactacaggtgcccgccatcacgcccagctaatttttttttttgtatttttagtagagacggggtttcaccatgttggccagactggcctcgatctcctgacctcgtgatccacccgcctcggccttccaaagtgctgggattacaggcgtgagccaccgcgcccggctaagctagtccttattaagacacggtgagatatttgacactaattgactttctatttaattccaaaaaggacttgagtgggcctccatgatactagtatttttattagcgacgaatgttttttgaacaccagcatgtgcaaagtcctactctaagcaaggagaatcaactctgccttcacatctgatccattacattctatgaacccataccttatgcaatataagttaaccctttattttattattctcatatatggtccactagctgtcatcttagcaatcttttgtcctaaactaagtgtaaaattcatctagggcaaggtagatgtacatattcctccgaaaccttatcacagcactggccagctggaatttgttcagtgtttacattgggaatttcttcccatgcagaatattttatatgtaaaatctacttatcaatatattctaaaatcaaagcctatctacattcaagtatttttgttgttgttgttgggtggggatagggacaaaactgcattcactaagacaggcaatgagacagagtcaggctttgttaataattatttgggaaaaagctgtggctagaataatttgtcgagttttactttatatgtgtgtaaatgcatagttccattttaaacaatctagatataatggacttccattataacaccacactatgggctgattgttaaagggcaaaatttcggcataaaccagttttactttcttaactctaaaaggacatcattgtaggattcacagatgatcctcaggcatagcatcagcgaaggcacagatatatttagactttaataagtcccgcggctacctttaaagttttatagttatagagctttggttgacctcagaagctgagttccaccatgcacatgctggatggtgacataaaacatccctgaataaacgaacagcatcatagcctctcaatactgaatcagtgctggggaaggaggtgcactgtctgtgtcaaagaagacatggtggttcaagtcctgggttttagtttctttccccctgttgctggcccctgtggccagaggaccaggcctctccttttctgggaggtgcaggatggtgctgctgtcctgagaattcccctctgctccctgctgtcctagaagcttcctagtgagtcgacatcatggaaacttgtacagcctgaattcctatgatagttcaatttcgtattttttttgatattttaggtttttaagttacatttttacaaactaagaaatatttatgggccgggcacggtggctcatgcctgtaatcccagcacttagggaggtcgaggcaggtggatcacctgaggtcaggagttcgagaccaacctggccaacatggtgaaaccccctgtctgtactaaaaatacaaaattagctgggtgcggtggcgggcacctgtaatcccagctactcaggaggctgaggcaggagcatcactggaacccaggaggcagaggttgcagtgagccgagatcgccccattgcactccagcctgggcgacagagtgagactccatcttgaaaaaaaaaaaaaaagtatttatcacattattttctgaactatctgaacatacttgaccatgtaagagcatttctatcactgtacagcaaagcttctttcacaggaggccacaaaaagtccatgagccccaggaaattatctgcttacaattttttatgaacgtccgtatgtccatttgttttctggaggagagctctatctttcactgaattcctagtcctcagagggttgagaacgattgctctatacaatgacagaaccttcatttaagggaacacttaagtttctcttgtgtggcttcctgctaccatatccctgactgcaggtcttccagccttggtttgaatggtggttttctccttgtgtgagccagtagatgactgcgtccctgctatgtgggacagcctgtcctcctgttacactgttttaactgtcaaacgattctcccttatatagaccccaggaaatagtccatggtggaagctcttccaagtccgaacaagctgccctagtggaaaacctgcattcatgtcctccagtggcacaaacccccttgccctaagtagccattttctttttctttctactccaccacctcagacatctaagtgcccacaccaggctcagacacaggtggagacatggtcttggaatagcatggtgcccatttcctcccatgttgggtcctctgccccagtttctccctggggatagggtcatgagtgctgagcgctcccgcctcaccttgatgccgcatatctttctcctgtggttgtacttgccgcattgaggttgccatggaaatcacggtgagtaaattacttaccgagggatgtgccgtgctgcatgacaatgctggagttgagtgaggctgggagagaatatgccgagggggaaaacggcctctgatagtaactcatgggactcacggcacctcctgagtttccattcactgttatctggctctgagaaaagcgcaaaggcatcgagttaaattagcacatagttccctgtaaacatcattccattaggtgataataaaagacttccaatcacatgagagtaatcagctgccaagctcttatttattttgaaaactgatgtcagagggcatgctacattctttgccttctctctattcccttatttctgaaaatcactctcttgtgtatctgagggtccagggagtggttaggaagaatgaaagtggctgactagtgggcatgccactctgccaacagaggtgccaaatggtatcagtaggagtcagtaccaagtaaatgtggaggacgactttgctctgacagtcgtaacatcagcaatcagaacacggtggtgctgttccgcatgcagcattgacgtggatgtcctttgacatgaggcaagggattggttctcagacttagtcagggatatcttctagtgaatgaatgtttccagagctggtgaataacataaggaacctagttgtttggatgtatatatcatgaagcaacctattctagaaggatcaaatacctggtaaaggatcagagagacatgttcaaccactggcttctccctacttcagcctcattgagcacttcatgaatctctgtttgatttcttaattattcattgtttcgattgttccgtatctgactattttatatccccaatggtatctcaagcttcttgttgaagatggtcatatatatgcttctttaatattttgtataacatgcagcctagtgctgatgacagagtagatgttcaataggtatctattctgatggaactgaatcggcttagttcacagatatcgagctcaggactattaagcatgcctgtctacccacagcacagtactgatcattacagggcgcacacaatgcatgcaaataagatcaaacattagtaagaacgtttagttaaaattatagctaaatacacacaacacacataggcacacagataaagaagcataatttgtgaaacttttctacttattttaaaacaaaacaaacttctattccacaggcttgaaacatagatatagtaactgtgtatttctatgatttcactttaaagcaaatgggttttcaaatgacctagaataagtctaatttcattactgtataaccataccacttatgtccccaaatcaataaacatttcattacaagccttgtgcttattgattaaataattctctaagctgttagaaaaattacactcatatcataaccagccacatcttgaggacctgctccctggagagagctggacgttcaaataactgtgaggcacaggcctgcccaaatcttcagagcttttatgtacctctgatggatgatttgagaacactttcacctccttgcccaagttaagtttggtggatctttgtcaatatcattgtaatactattataacatgttataattaatgttaaaagctgaagaatccttcttattaaaaaccatcaggttaactatattgctaaacctacaaacttgctctgaatcctattttgatggtttcaataatattgactaggggttaaaaaagtaaacactgagagtagatttattcttttttttttttttttttttttttgagatggagtctcgctctgtcgcccaggctggagtgcagtggcgcagtctcggctcactgcaagctccgcctcccgggttcatgtcattctcctgcctcagcctcccgagtagttgggactacaggcgcccaccaccacgcccggctaattttttgtatttttagtagagacggggtttcaccatgttagccaggatggtctcgatctcctgacctcgtgatccacccacctcggcctcccaaagtgctgggattacaggcgtgagccaccgcgcccggcctagatttattcttttattgtgttcaaccaatcaggattttatgactaaaatactatcattagcattttagaaaatactgtattgttatagtgaattcattattaggaaaaacatgtcatgaataatctatttgcaattttaaactgataattgcaattaatttcccttacaagtagctctgctcgtgcccacaagactgtatataagacagttagtctcctgtaaagtcttaaaaacagaaaattgaacaggttagttggtagattgataccctctcactgccttctttttttggttaaaggtcctggtaaagttttaaaagctaagaaccattgaagcacagtagggcatgggaggaacccacacctgctgtgctcctggtgcccgtagttgggctggtcctctgtggcagggagggactcgctatggggttaggcctggaaaatgaggctccttctgtagccagtctctgaatggagcatttgaatgcaaagtgttagacacagccattgggggaataccaaatcccattaccaaaaaaagcatcttttactttatgtaaattgtagtgtcttaaaaaacatatggcttattataacatttctctgcgcataaaatttgcagacttatcagcttgatagaacataaaacaatgtagcacaaataaaattttgtctatgacagtgcttattcggaacttcattataatatcaatttaaaaaaaaaatctgatttttttgcctgaagctatgtgtctcttaaatggaagccattacttagacattatatgcaatatagaatctgtgccataaaattttgaaacattttagccattcacagatcatttattagggattgcttatcacatagatatatttaaataatatatgtatggaaaagatgtatatattgctataaatgaaagacaaattattgataaacaaaataaaaaatgtattcataaatttctgtcctgaaatggctcaggaagaataatttttaaaaatcgtacagctaaatttctgaaaggtagataggattatcgacatcattcactcctggacaatagatgagttcaaaagttgtagctgttagagaaggaggaacaagaaaaattagcctcatgcagtcagtaatcatttatgtgagaaaaaggatatagaaaagagtcacacaggacacattaatgtgagtctgtgagaaaaactgctaacatgtattaatactgggttaaaattttttgaaaaattttagactttatgatcacaacatattgtgatgtatacttagctaataaggcaaatcactgtagaacttaccagctacagtaacacgggaaaccgtaagtaactattttagagtaactataagtaattctaaaatgaatgaagagaatgaagtgactttttcagccttaagcaagcttataggatgactaatgatttccctgacagatggcatagaattggtttgggaatcaacacctatgtaaataaaaatgtcagccgaaaaatgagatggcacaacaaatcagtcctttcaaggaaacggtggaggcaaagaaaggcagaataattacatgagtggccgcaggggtggttaaggtggtgccatctgtcacagcagacctctgaccccaggtgggggagggtgtctcagaacggccagtggtgtcagagtcaccaatctgcagctcctccagcatggctgtggaggactcactctccgagcgggaggagtgctcggccagggaggagtctgttgtcagagagcctgtgtcgtggctgtggatgaggctttctggagctgggagcaggtgtttgtataagcaatgggaaaggctctggggattatgcaggcgtgaagaccccacaccatcggggggcggaaggctgagtgatgctgagctggtgccactgcctggtgagaaagtggctcggttcaaaggtaccacggaaggagggcacggaggagaagcttctggtgtggtttgtctgtgtgtctgtgaagcatttacctccaacacactggcaggtaagttctgatttccaagctgagtatgaggaaaaaataataagagataaattatccaattaacaaaagtacctctttttgcgatgtggcagagaaggcaaagcatcggttttatttgcaagcactttaaggagttacattcagatgggttaggtgccaaccacacagtgcagaaaaagtgtgaaaacaggaagaaagtgaatccagtcggtgtgttttgaaacaaggccggttttcacacagcactgcaatgtaattctggttaggggcttgagagtgttggcataacgaaactgtttcctcaggagttttagtttttgtatttgtgacaatgataagatatcagactatcggtcagcagaattggtttgtccttcactagaaaaatctaatagcataattgcctcccccttgccaaaatgtccccaaaacataaatctgtttgtcttattttttcctggtttatgaatctaaacactgataatactaaacacaactaagcagaaaagataaatggaaaagatgttttatttcctttccactaattaaatctgttctttgatttcactacaaaatacgaaaagaattggactttaaaatatcctagcaatgcaaatagaggtaccatgtgtgaaaatgaaaaccagccactgataatagttagaatgtaccctagttagttagaactatggttggcactaaatcttaggtaaaggagaaagaaactgaaggaaaaataaaagatttaacagctccaaggctatatatagcccaagaggctaaacatagcgaagggatgctctgtaggaggaagagagaagatgaccatttgaaattttacaaccacctgtggtagcctggatgacgtttgaccacacgtgacaaataggatgataagtactcaattcaacgtaagtgaataaaactccgaagcaacttttcttacttattttttctacctttcagaacagacactttttggaggggatgtttgggagaggaaatggttttaagatagatggccagaggtattgtgagatattagtacaaagatgggaatgaatgaaggagaactgtttacacttagaaatactgcctagtaaatgtttaagttaaacaatttggtgttctttggcagccataattttcataatgactgatgtcatgcacgttgttagcataataaaaaggttgcaataatttttttctcagacttttacttgaatacttttaaaaaatccatcatataaaaaggtctctctgaatcatagatcccttagaaatctgataaatgtgactgatccttcttttggggaaatgcacaaattcatacatacagaaagttctgcataaacttcagggggacagagacactctaaagcataaccttaatctaatgggttaagaaaccccaaccttggataaaaagacagattttcttgtcctaatcttacttaatatgattttttttcttgtttaaacatagtcattttaaatgtgatatatatatatatatatacgtatatatataatatatattttactgttcatggttgtttaaatctctagaaataactgacagaaatcttagttacccagaacttaaaatgttttggtggggatgcatccttattattactgagtgtttacaataattgcaatcttattggaggtgaaactttaatattatgaaattatcataattctaacttaatgtattaaaatgttgctataagtctgaatgtaattcagtataaagcagtctttggatagcgtcaatgaaatttcccctaataattcagctttactaaggatgtttccatgtaatacgaatctctttttagttttatttatgctaaatgaaaactatgaaataatacaaatcatacaaaaggatttgagttatctgctcatgagacttttccctttcaaattaaaagaaaaaaatctaatgactttaacccccattggactgacttgtccatatcctatgacttgaaacatgtcaaaagctaaagcgtattctaaaatcaccattgtcacgggtaatatgatcattagtttgcatagcactgtgtctggggatggtccttacccattcaattgttcttccaaatagaatgtccacagaaaacaaaattattccacctttcgaatttctttcaccacctcctgacatgctcctggttttgagtcttttaatgcacgtgtgtgtatgggtgtgtatgtgcgtgtgtgtgtttgtgagtgtaaggcatgaaatgcctcgtggtgagtcacatcacacttaaatttctacagataaaactcaataattcaacagttatactggtcacccacaaaaaagctttgacaagaccccaatcttcacatgaatggaatataccctgtagacccaaggggaaagaaagaccatgttacacgtgtttctcctgaggaaaatcagaagagcagcaggaaaggtatgaaaggggaagaaggcagtattttcccaatctggactacctcaaaaatagggaaaactggctttaaacaagtgtatttttttcttacttcatgagtggcaagtagatgactgcaggtaatcatcctaattgttttaggtctccttcttttcaagaccatggaaggctaaggtgtttgaatagggatcaagggtcaccaactttttgtgagtataaattgttttttctttccccaacccttgagctagcaggaagagggtaatgagaaacaccagctagcagccaggggctgcctggtcttctgcaaaggacagggacggtgcttaaaccttaatatgcttcatataccaagagagagcacctgcttactcaaactagcactgagcttcttcgtccaaatgactccaacccagaatgctaaagagagcctgtggatgagagtgctcaccaatcaacactggagctcctgaggaatgaaggggcacagagattcaagggagggtgagcttcagcagtggaaaaagtgtattgagttggatgaaggcattgcaaactcaagtgcccatcatgggtcaggaaagtatccaggatgtgcaaatcaagcccgtgttggatgacagggaatgatgggaccgatggcagaatgcggaagtcatgttccccctcaaggcgggcgtcattgacccatatcctttgccttgaaacacgatgaaaattaaagcttactgtctctaagaccaccatagtcatgggtaatatgacctttagttcgctcataagctcagtgacaacacatctatagtcataagcccctaagctgtcacttgctgacacagcagatgtggaagctggaggtggaagagggtagctgtggagcggggatgtgaagaaggagtgcatggccaggcctcaggagaggaggggaaagtgctcgttggggtgcaaaacttaaagagtgacaaaaaactcagtaattgagataaattctgtttcaatgcaatctttgaaagaaaatcaacatcaatgcaaaaaagcaaaaataccccatactgaacaaaaatgtcgaaaatataaatgaagaccagcgcatgccaagccataggaaaagagagtctgggtctggcgtttttaatgcaagaaaactcatcaataatattttcaaaatctacatttttgcttatttcagttttagttgagagaatagacatgtttgacaatttccaattaactgatggccatcttaaataatttgtaattaatttaaggtgaagtaaacatgtaatagggcaagcgcagtggctcacacctgtaatcccagcactttgggaggctgaggcgggcagatcacctgaggtcaggagttctagaccagcctggacaacatggtgaaaccccgtctctactaaaaatacaaaaattagccaggcgtgatggcaggtgcctgtaatcccagctactctggaggctgaggcaggagaattgcttgaacctgggaggtggaggttgcagtgggccgagatcacaccactgcactccagcctgggtgacagagcaagactctgtctcaaatttaaaaaaaaaaggtttattttgctttaaataaaatatttaagcttaaaataatgtgtgagtgttaataacgtgcgtttcaacttttcaaaaaaattctaatgacttaaacattctaggaaaaagctcattcccaatatatgaaaacaggtataaggaagcacagaatttccttccacctcaggttccagttggcttgacatggccctgaggtcaaggatcctaacatctctctcttaacacctttagtcattgagcttctaggcctcatttctcaaggaacataaggaatatatattaaatgtcaagcaaagaaatctgacaggcttttgttctcttttttccaatgatagtaatttacttgaaaagaaaatatctaggaaggggtttttttttttttggagtcttgctctcgacctccaaaagtgctgggattacaggcatgagccactgtgcccggctggaaggggttttaaaaaaaccaatctttacctcccatccacacatcctttagggaaaatgtgccccctcttttcatggcctgtcctggtggtatgaggagacctgcctggcagctgtgtctgttgccggatcatcattttgctggccacagctgattaggaagggggagtaactggactatgctgggccagtggggccctgcctccctcctgggaatttgaattacgtgacactgaatgcccctcaggtagctgtcgggtacccaaatgcaaggagtcagagagtatcatggaaacccatgggcaacttgaagtaacgacagagcagaaactaagagacagacagggaactatgcagttcctacgactgagaaggatggagggtagctgcctggccattgccccgtttccctaaggcctggctgtattgcctgcattgtaatgatgtgagattgtctgacagcctcataataaaaattattttaaccatatactccccacccaagagctgggtgacaagtgatctaaaattgtcacacagattgggcacactgacagcatgtggcatctgaatcaggggagtaaatatttctactgtactctgtggtattcagatcgggaatatggttttgcatctgggaaagtgtcatattttaagaacattatcaaaatatgggatttaaaaatcagcttgtgtgagagcatagaggtagcagaggctagtggctgagctgtggatcttgagtcagacagacttgggcaacttgtttaatttccttggcctcagttccttcatgtgtaaaatataggcatggataaaacccatctcttaaagcctgtaaaaattaagtagggcaatgtaaagtgcttagcacagtgcctggtgtgctgtaatagctctcaaaaaaaggagaatcatgttttacaaaattaaaatgctgggaaggaacaggaatgctctgcacaaagccagtagcagggtagggaagagaaggatcacgtgaacactgtcagatagaggcggaagaacattctgtctcttttgctctgtggataaccatgcagaagttaaggaaggcagatcatgacgtggtattagaaattctttccaataattcgatctcagaaatggccaagcactggactgctgccttggaatgtaactgagctcttcattaagtgtattcagaaaaggctggatgcccatctattgggagatgttgaagaggacgttttatttgtaaactcatgttggactcccaagtattctctaatgttcaattatttaaatacatgcatatgcatgcgcatgcacagacatcaaatggagaaattgccaaagacctgatcaactaatagcattacgagcccacagaaaggaagccatactaatggaagacatcaatgattggggccggtcttgatagcaatgttccagaaagtgcgttctgcagttctgcacctattatcccacactgctgacatgtctgcattactctgtcctccttagtatctacatactgatcccatggagcaaaagaaatgagtttcctctcccttctacatgacagtcgggcaagttcccctgtgagtccccagcatatgtgcagtggcagctgtgaaggtgaggctttggcaaatgattgattatgttatttcataacggacaggacaagcttatcttcctgaagcaaggaacatagcacagatgccatagaaactgtttgggggtgtagctttttgctggctttccaaagtgtctggcttataccttcacttacttgacattgagaacaatgtgacatttttagcaacaggatatctgatcacacagtgccataaggataacatgcctcatttctggtctgtttgtaggaggtcaattaaagcacatgccgtttagaaaacactatgaaaaattgtcaaatatgaagagaatttctaacagtgacctgtagttttcttcttaaattaatgagcagacattaataataacaaaactatgtaaataaaacttctgaaacactgaaatgtacttttcacatcttggtgtacttttatcgcttggacctgctaattcctgggagcctaattctttataatggagcacatatttggctgactcacagggtatagcttacagtgcttggcattggctgagacttgccagaatgcggagtgcaagtgtttaaaatggaaaggtcaccattgtgaaaggtcattacatggaaaatgagacttaaaaatgaagcatatcacaatcatcaagatgtagaaacaaaccaaatgtccattgatggacaaatagataaagacaacgtggtgtatacgcatactaggatactattcagccttaaaaaagatggatgtcctgccacatgctgtaacatggagcaatctggaggaccttataccaagtgaaggcctgtctcagaaggacaaatatctgagcagagagtagactggtggttgccaggcgcttggggaagggggatatgagttgctattcggtgggcataaagttttagttatgcaagatgaataaatcctagagatctgctgcactgcatggtgcctacagttaacaatactgcattgcacacttacaaatttgttaagaaggcagatctcatgttaaatgttcttaccaaaattttaaacagagaataaaaactgcaacagcttcatgctaccttttttaaaaagccttagaaaagaggacacgctatcttggaacaaactgaaagtctgttgaaataaacttttacctaccagtaaaaaaaatgaagtattgttgaaaataatatatttctttttcccaatcagatgcataatttggaaaaatattatttaatgatgatgacagctactgtatgttgaagaattaccatgaagcaggcaccatgccaagatccttatatgccttactcaaacctcccagcagttctatgaatggttgctatcattgtccctgttttatagatgagaaaactgctgctcggggagggtgaataactagatgaatggttttatgttaataagatcttgaaacagctgactgcccaaccactttcttcccagtctctctcatacccactccaagaaagcctccttccccactatggaatcaatggtaagttttcagatttcatttcaaacctgtctcatcaacagcatttgtgcggtgaaccatccctttctttccacacattttcctcacatggcttttaggatgccacattttcccagatttcctcctcccttagaggacactgctttcagtctcctccactgcttcttcctcttaatgttgagattcactcaggctcaactcttggtcctccccttttctctgtccttcccctgctgatctcactctgtctcatggccacaaaacccatcgactagccaatggctgatacctccaaccaggacctttcccctgaagtacaggctcttacatccaaatgctcacttgaccacttaatgtgggtgtctaagaaatgcctcaaacttcctgtttcccaaatggaacctctgaagtttccaccaacctgttccacccacagctgtccagtctcagctgatggcgatgctatcttccagttggagtcaaccttgacttttctcttcctcacatcccacatgcaatctgccaggaagtcctgtttgcttgactttcaaaatacattctcacagtctgatttctcaccacctcctctgctgccccctgctttgagccccatcatttcttacctaaaggactgcagtagttacctaactggtttgcctgatctcctccttgccccactatggtacgtttttcactgagctgccagaatgattttgttaaaatataagggaaataataatggtggtagcctcaacatcctccagtgacctccatttttattgagagtaaatgtcaaaatccttgcaatggcttataaggcctcctgtcatctggtctttgttacctctgacttcacttcctatcactctcacctcacttacttcctctccctccctcaggcttccttctggtcctcccacagccccagcatgatcaacctcaaagcctttacataagacattccctctgcctagaatattcttcctccttcaaagctgttctcttttcagtgaggtctattgatattgagttaccatacttgacatgatatctggtctccacatctctactttgcatggcataactcaatttccataatcttctaatatatgtaatttactccagttcttattaatgcttgctcctcctgccacacacagacaaattttaagcaggaatggtttcaaatccaactctgttactagaacagacttgacataggttaggcacccaataaatatttcttgaataaatagcagtgacaggatctcaaatcttaacttttagatggtgccgataccctggggataatataatcaaactaaccgtctctgcgcagcctggataaaaccatgcaaaacgaaaggtatcagcttgttttcaaacatcacaaaaccattctgaagaagcaaaccaggttggatgagtccaatgactgatatgtgttcctatgacttctcctacacctgcttcctggcgtgcccatcctgggacactggcgagtctgctcactgacactggcacgggcctgtctgtacagtcacagacggattttgctccctccgaccttcctggactcctgaacccgatcaagatgcatctgcctcagctcccaccatcatggcaccgtgtctcgtcactgctgagtaacgacttcacaacgagaagtagcactctttcagagtggtggccctgcagccagcctgccagggtgtgtattctgtttctgccttttgccagctgcatgaccctgggggagcaacttacttctgtgcctcagtttccttagccataaaataaggacagtagtaatacctactccatgagattgtggcaattattaataaacataaacaagctgcaacagtgcctgcatagagtaaggccttaatatttgttagctcctattaatgttattattattattatcatctgatttcataggtgctttcagaagatattaccttaattagaagaaattgctctactgaacgaattttgcacatcttgattggctgatggagaagatattttagtagaggtatgataataccagcttgtcctttaatcatttctgtttaaggctcgtctgctttatgagtgggtggggggatcttggtgtcaattagttatcttttggagattttctgtacagtttaaaagtatatctcctcgaggatatgttttggatgatctttattaacacagatacaaaaaggagtattatacaaattatttacttaggcaccactgttttcaatattaacactagcgctgttgctgctactattatatcttttattaacagctgtcattgagtgcttgctctagcctagtctatggtaattccctagtcttaccataacctataaattaagggttaattagtattctcatttctttgttcggactcacagaaaagtttagatgaatgtctcatcacatagtaaatgatgcctggattaaaatctacagcttatccttaaagtttgtgcttttagcactacattgttctatggagaagtcaaaaagagaagcacatttctcctgttaacagactaatacatgtaaacagaaggatgctatgagagaattctacacacatggaaagttttacttcctgaaagtctggataataaaagttggctaatacactttctgaaatgataaattaagttttagtgaaaatgaatattgagttgcaaagaaatagacattgcttaaaattaagataactattccctgccaaagcaaattataattgacaattatctgaagaggttttacacatgtaaataaagtaaatctaagtgcaaaaagatctaatatgaaaaatatttctttgaaacctaaacatgctttaagtcctgaagtagtctgcaatgtcttaaatgataactgacccctcaatgatttcccataaacatctagaagaaaaaaaaaaatttagaacatgatttctggatgaaagatctgtatatgcatatttacatttaaaaatacctagacatttgctgatgaatttagtagggttttaaattggaaaatggtttctttctcctttcccttcctgcttggaaactaagaaagcattaggtcatataagaagcccaaaccaaaggagttagggtctctacgatacgcatgtattaatacgaagagactgagaagcttaaggtaccactctgcagtctgaggactgagaggccgctgcaactgcagatttttgtctctcttgctgaagaggtatctttgcagtctctggagaaagctcaggtagctgtttgtggctttcaagatcctgtcctgaaaggggagctatctgaatggaaagagatgctgtgtgtgtctcaggcactggattaggggtcagtgagcggggccttttgagaaatgacggtacttcgacagatttggagaactgtggagtactaatggggctgctacttcctagatcctggttatgggttagtttcaaggtagaaatcctccgagtttgagaatcttgcctgtagtcctcttgtagaactggggtgttgatgttagcgaatggtgcaggatccgtgctggaagctgctggtagtggattagtgattttttgtgtatatgacatggttgtgttagattcttcagaatatacaattgtctgtctcgaatcttcattggaatacatagttccctgaagaggttttttgttagcaaagtactctgtactggagggaatttgtgtgttagttactaactggtctaaaatgacaccctttgtgtgactggttatcaaagagctatgaaagctctcttttctttctggtggagggggtgcctggattgacaatgggatccagagaaagaaataaagttgaaagaaaaacagagaaagtccaagttagtcatgaaagaaaccagtgtcaaccttgcctttacagaagtaaagcaatgccacaccttctgattatgctatccattttgttagctagattgagtgatcattttcattccatttagaatgcacttatgtttattatcaatgtttgcccttggggaaaaaagtgttgccagagaatacattataacatttgctccatctacattcagggaaattatgttaaaagtgaacatatgttctcttggcatattttattagactttgacatatatatatatagtttatttaatagcattgttttataacaattttcatgcttgtggcacaattttactaatatctccaacacagagcccttttagttaatataatagttgcatactcatagttattgaatacataatgtattgctgacctcatcagtttaaatccaaagcatcagctgtcagcttttaaagaattagaatatatcctagagattatgttaaaaaccgacatactttgataagcttaatcagaaacaaaaccaaaccaaacccttgtttgttaaaatttgttctccatgttgtaaatacaaacctggcaagcaaactaaatacaaaagcaaaaacatattaaaaataaaacgtattgaaatacgcacattaggaaagaggctgtaagcagtggtctaataatcatgccttaaaataatgcagtagccaagagtgtgcagggttacctgagttggtgatcttttatcttgtaggtttggtcgaacgcttctaaaaccttttgctgcaagagaggaatatgtagcatctccgttcagtgtctcctgattgccatcattgtaagatctccaagctttcattaagggaaaacaattggatacaaaaatatctacgttcacttaaacattttttataaaatttatttttatttccaaaatcatttttatttccaaaattgtagtgttcttactagaggtttaatttaatatgcataacagtacatgaaatttaaatttaacatgaagtcagcgatgtggctatgaatatgttttctaaaagtcacaaataatataataattattcagaatattttttctgtacctgagtctggtgactgagaatcacgccctgaaagaaaaaaaaatgttgaaattaagactaaggtgaaataaatgaacaacccagtaaaaataacatggcaaagaactatatgcattgtttttgcaaacattatttcagttttaaaatctgggtatgtcaaacatgccaaagggaggcttgtacatttatttttacttcaattagaatgtcattcattaaatatctataatatataaatatctatatagtaaacactcatttttcccctcaataatgttgcaacatgcaattttaatcttattatggcaaagatgaatatatgaatttctaaatatcaaattaaaggatcaaaagagatctggtttataaacagcactaactcaaactgccagatccttagcttccaatgccctgctgttgataagcatatttaactcctgtgttacagaactgtattctgtagttcgcatttttttttaccttaagaaactgtagacctgtctaccatatcatgtgacattttcaaattattctcgagactgagtttttttcctattgcaatataaaagtcattttatactcaaatatgaaaaaactgttacaacatgttccactgtctttcagctagtaagctgtggaaaataaatttcaggactaataaattgcttttggtaaggcagttggcaagttatcagtgatatatttgttatcaattttattgaagttatatattccaaaatcttctatatgcacatttgaggtaatcagtttgcacgtttaactcatgtgtattttaagtcatcagcttgtgttgcctggtttattaaagcacatggtcaactttacttagattcattaagctttaactttggaggtgatcctaggggttggatcattagcccaacctgctgtccagtcctggattccttctacgtgttccccaggaccattattagattcccatttcaattcataaaacaggaattttacatgctggaaaagtctttgtttttcttttagtgcttcagcacagttattttcaagtttaaacacatgaacttagaatgataaaaatgggctgagaaatgcgagcatctgatttttagataaaatatttgatatgggttctttccaaatcaaaggaaggaacacaaatgtgagtcagcacagagtacattagaatgattccagctcaggtgagctagagaagactaatgaattcccattctttatgatcattgataacttggtatggattttatctccaatgaatttaaaattggagtaataaaatgggtaccatagagaaaaattactttgaagaattatgcatgaaatgtttattggaccctacttctagaatttgtacaattttttgatttttattttattttttaaagatggggtcttgctattttgtccaggctgtccttgaaatagtgggctcaagagatcctacagcctcagtctgttggttagctgggactacaggtatgtgccactgggcctggcccttcttctaggatttgatggaagcagaaatgattgaaattcttaatcagctatatgatgaagataaagaaaaatacagtttgacaaaaaatacagagcaatcatcagaatgctgctttagggcactcaggagagagatttaataaccatgaggctgccatccactgtggacaatgaacaaattttgggatttgggaaaggacaacgaaaagcaaattttggaatttgggaaaaagcaataaaatagcccaatgctactttatgaaaagagaagcagcattaataacaatgattatattctgatttttttcttgaggatagggagtttcttttatgcttggtttggtaaaactgagataaaaaagaaggctgtgtgttagcgctggggacgaggtaatgggacccagaggcttggaggtgcaagggtgcaggtgcggtgagaaagaagaaggtgtactgggcgggtctgaaggacactagaaataaactccctctaaatgatagtctgtagggggcaggctctgtttcttcacgctggtcaccgtgttgaagatgaggagccccaggagacggtaagtgtgagaatcagaggacagtcactccaggctcaactgtgggtttcttcctgggacactgggcccagggatttccaaatgaatctgtccctgtgccactggaaacattagacagtaagaggggtgggctgttctgaagggtcttgcatcgcacagtggacacgagtgtgcagaattaagagaaaggagaaaatggccattgagtcgaacttcaggatgaaccagtattttaataaagcttatgttgatgattaaagtctgccttgaagtggctggtctctcaaggagactaaagtacattcatttctctttctttaaaataaatccaattacagatacttggaacacccagtcctgatttgctcttttattatagtcttctatgtggacactttttagcatagccctgcttttattttatccctgcaggaaagactaggagagggaggacacctgttctttggagcaggtaatagaaagtatcatggatccacatcaagtaaagagaatataggttagaaaaaaaaaaaaaagtcgcccaggtaaatggcttggcagatgtgtggggaaaatggatttccccagatctgcagcattattggtgcacattcacttgtgaaaaaaacacaaagctaggactaggggccagagtccttaatttctagtgttctttagtagacagtcactgcttcactgaaaatccacgaatgactaaatggtgtaagttttcccctttcctggctgttttgcatgtgaatattttaacaaatagggtcttgaagaatgaagagctccacgtgctcttaccagcccttttccttgtgtcgaggcacaaactggtgagtctctgtctgagattttgtgcaagacattcccggttccatgtcaggggtggaactggatgccctccatggccctttccactgttatcattctaacatgacagctttcgtgtagctgtgtttgtgatacgtgtcacatcgtaatctctactctcaggttttatttaaatcccttttaactgatatgctctattgacactatcactatatttttcttgaaaattattattttgatgcctataactcatttctttagaagactcaagtgctttttaagaattattttaaaatgttgattaaattcaggtcaactaattgagtgcctactgtgtttctatgtacaattataacccttttcatttattttcttcatttattctcatttattctgacaaatccttgtgagtctgggaaacgattaagctttcagagaggtaagaaatgacaaacaatttttcattggaaagaaaggaaatgagatctagacagactaattttcttaagggcatgaaacatgcaggtggtatcgacaagaccctgtctcttggcggagtggtccccatactgcggcattcctttaggctgacaaggggttttggtgaaataaaatgttttcaattgtttctcaatagtcattgtcttggttttggcataggtttaaaatatccgtgtgtgctctgatggattgtccagtgggaatttacttcttataaaaggaaaagagaaagacagactgactcaggggacaaataggtggtgactcagattgactgtctgatcagagaagggagtgaaaatggcttgggaccttttctggaggttttacataaaggctgttgtattttaacaatatcgaaggcaataaatatttatcaattcccttttgattcacatatagacactgtatcatataagttcttatgaaagctacatagaatgcagttgtgcatattaatgctaacttctttattcaaaaatataatggaagcttctttgaaaaagggggccaggtgtagtggctcaggcctgtaatcccagcactttcggaggctgaggcgggcggatcacttgaggtcaggagtttgagaccagcctggccaacatggtgaaaccaggtctctactaaaaaaaatacaaaaattagccaggcatggtggcaggcacctgtaatcgcagctactcaggagcctaaggcaggagaatgcttgaacctgggaggcagaggttgcagtgagccaagatcgtgccacagcactgcagcctgggcacagagcaagacccacccgtctcaaaaaaaaaaaaaaagaaaagaaaagaaaaagaaaaagggatcttactttacgtctaattgacacaaaagagggctgtttttaaacaattatgtccaaaattcagtggacttcattctctagaaatcatatgcctagtgatagaaaacttaaaatagcccaaagctacattgttattactgaagattatttcatattcctaaagtgtgaaatgttttttttttcttttttgctgttgtaattccgaagcattaaatcttttctatgaagtcgagttatatgaaattgcatgtagttcagtttcgactctccacatgggcactgtggaagcagtgtggcgttccctggtacgtgcgtcaaggttcacgtctgagtaggttggactgagatcctatttggttgaaatgtcaatgacattcagggtattggcattccaattacacgatggccctgaactcttacggttattgtcttacttgccttcattcctgtttctcatggtatccaaggtaaatacatctgtagtttttctaacacctttttatgttcatacgtgcatgagccactacatacaaatagagatttgtatagagatttttttttaaccaaaatgaggtcatactataaaccttgcaatgcatcttgcattttcttttaacttaatatataactgaactcactagcctggcatttaaacttggacgttgaaatccatttgtggattagaggtggtgaacggaagtgggattctgcatatggaagttcatttttttttctcaagaaaaactcagtagtttagaattaagtggctgtaaagcgaagaacaccctgagtatttaatcaacttctagatgtatgtgtgtagaagactgtgatatgcataatgagaattaaaattatttaaagatgccccatccctttctcacttctgctgtaagacccattaatcttataaataaaaaacaagcagtccccaaactgcagctaaccaaccagccaaccaaccaaccaacccaccaaccaacccatcaccaacaggtgtgggtctatttcagggtctggaggcactgggcttgctggcctccctttgaccttctaacagctgcaccccctcccagtgcagactgtgccttaggtactgtgcctaacttcggtactgtggcttaggtagtcacaacagagatttattaaaaagagaccacctgagtggatgctgaaatctcgcacccccagtgacttcctatctgtgggtacatgtgaatcttaattggtcaagattttggtatgtttaaatatatatagtagaagggtatttgctgattggattaaaggaaagcaaaggtctctttcaaaactaatgttctatcattctgttcacaacctttgacaaagaatccagttaatgaagattcagtttcctacaaatcccttttttcatcctgtacccctgtacccctaccccaaaagtttttaggttaaaaaaaaaaaccccaaaacctctgagttatcttaatgaaatattatgctacttaagttcatgagataacaaaaacgtgaatagttattaacactcgcagttactcaacctatttttggcaagtgactgctgtttttaattacacatttaaaatgtttcctacaagatctcattttcctttgctttttacgtttagaacaaaaacagtcagaagagctagaagccattcaagtgcgacattgtgtgagttagtgatattatacctgcagccaataggtttggagaactttgcactctcttcacagatgttagcgtaacagacatggcggcacgtttgcgagcacacccaccgctatctggaagcaaaaaaatgatatagcagaggccaaggcaacgggaaaagcacgtgcaatatcatgcgttttaagagaaatgtgccagacatccatgagaaagatgaacagttagaattagtaatcatggaatgcacctgccaatttcacaccaccctcaaactaaaacaaacaaaacgaaacaaaacaaaagaagaccagggatctgtcttagaaataggtatcactgttttagtgaaagcatggaagacttaatacttaacattttatggttttctttgtgaaaactcaggcacagaactcaactttgtttataccatttaaattcaatttatactaaatctataagcactggatctggcttttagagtcaaggattagctccatgtcaggattaaaggctatggtacaacatacttttaagttaatatcatttaagttttaccatcttctagctgttataattcccaaagagagcttgaataattcttgcagtaaaaattattagtgacacaggtatgatacatttttttaggattcatagaggaacacatggcatcatggaaagtccactcttcctgtagttagtgttagttatgcaaataactagccttattaaaataaaagtattgatatatatggtatcgaaatgaccatgtttaaagaaaggagtatattgcttttactttttaaatttttatttttagggccggagtcttgctccatcacccaggctggagtgcagtggtaccatcacagctcattgccatctcaacctcctgcgctcaagcaatcctcctgcctcagtctcctgagtagctaggaccacaggcacacaccggctaacgttttaactttttgtagagatgtggtcttgctgtgttccccaggctggtctcaaactccctggctcaagggctctttccgcctcggcctcccattacaagcatgagccaccgcacctggcctcatttattgcttttatacttttaacaatatgtgtactatgattcatatctttaaacttatgcaagtcataatgtgaaataaaatcagtgtaagttcatcagccattttaatgtgctatgagaagtttagacttctaaatttggaagagaagtcttttaaaattggaaggccaatgttctatttatgaccagattcaaattccattcttacattcctctgtaatatggcatggcaataaatagttttgctcattctcctcattctgcttattgagtaaaaccaaattaaattaaatctttttgaaagttataaaaaaagacaatataaccaccgatataataatataatcattatatattgtcacatttccatttttcctttttctttattttcataaggaaagtatcaagtttgtttattggacatgacagaatttagattggtaaagatgctcggaagtataatttgaaggaatttttcataaaatttataaatagtaagattaatagaacttaaaagcagtggagtgattcttacttcacttttttaaagtatatgtttaaagtaacaatttcttaatgtagaaaatcattaaaccagaaaaccaacttgaaagaatattaaaagaaaatgaaccaaataaatcaaaggttataattaagaacccaaagaaagtgacacaaatgggagaaacaactgaagattccttcaggaaaggctccaaaaggattttagcgaactcagcaaactgaaagtgcttagagacaagtgcgtctgataagatggaggtgatgttattgcttccaggagctggaaactggttgaaatggttgtgtagtcaaaggtgttgaaagtaaaaactgacatcactctaagagtgattttatttcctagttctgttaattctgaacatctcacaagcacataggtgaaaagagaaaattccagaatgagaagatccagggtcacaggttaaatctctggtgttcaaactgtgggctgcgatgccctgggctgcactggtgcattcatgagggtgttggggggtagttcctgtttttaaggaaaacacagtgctaactgttggacactcaatgaactacttgcttggggcagtgcctggtttcaacataatagacgcgctatattccttttgatgacatcatattttggaaaaactgggattttgatacttgctatgataaaaagcaagtaccatctgaagaacattttatttatttatgtttagagacagggtcttgctctgttgcccaggctggagtgtagtgatgcatttggaccttactgggctcaaactgatcctcctacctcagcttccctcatagctgggattacaggcacatgccaccacgcccagctaatttttaaaatttttacagggatagggtctcactatgttgcccaggcttgtctccaacacctggggtcaagcgatcctcctggctcagcctcccaaaatgctggaattacaggcgtgagccaccgtgactgtctggcctgtaaatcattttagatcagtaaatgagagtggtcatgtacaatcgaattctaaggtctgagaaatttttcagtgtgcaacaggcacacacataatattagtaagtaattcttgttataaagaaagaaataaaactattttctttcaatttatgtgtactgttctgtcaaatggcttctaagttgttagaacaaagtatttataaagtaattattaagttattaagttgttagcacctaactacttaataaatagaagtgttacatatttttgacctaggagcacagtgaagaaattactgagacattaaaggtcactgtaaaacaagaaagtttgggaatccttgggttagacaatttatgtattttaggaagctctaagtcttagatgaaataaatggaggctctgtctttaataaagtttaataaagggctgaattctaaaacttgaggcatttgtaaaattgctggaacagaatgatctattatattgtgtttctacttccttttgtattgatactttctgatactccttgaagatatttttaagatcttaaaacaaggatgctacctttcatgtgtcagtttatcctaaagaatcctaacgctggtcttgccttttgtcctcattaatgacctgcagccttgctaggctactcttcccctgagctgcaagattcctggaagctgttcctactgctggaaacccctcatatgggtaaattatagatggataattatttgatgtctttccttctctcctttcttcaatagctaagatatgcctaagaaagtaatgtgttaaacattctaaaagtggacatataacatgttttgtatatattttctacattgtttagacactttagtatgaaaaattaaccacattccccatggctagtttattatgcactgattaaaagcaaatacttaacttaaaagaatgctttttagccgtggtgaccaacacatgaagatttaaataggaatatatatttttaatgattgatatattggatagatatatctatcaataaagagatatattcctgtttaaatgaatattgatatatatatcaataaaactggcctgtattatttatctatatagattatctgcattgtctatccatatattatctgcattatctatctgtctattgatagatagataaatagatagatagatagatagatagatagacaaaaaagtcagaagagctagaagctattttggggatgagaaaaataacttgtggggccactttattcatctatctatctatctatcatcatctgtctatctgtagatagataatgcaggccagttttattgactagctctttaggaacaaattcctacttcattttgtaaacacagtaacaatgctttcaaattcctaaggcaatatatgtgtgtatatatatacatatatatttaaaagtggtatgtttttataaaaacattataattattattttggaattttgagcaaaagttttcagtcacttttgatcaattttatgcatatgtttgaataccatattttccaatcattatacattaagtggaagttcatccaaataagcaaaataatcctatacaaattgcatcccatccagagtcaagcttactccttagaaatgagaagatgctttagaaggttacatttatgctgctaagcagtaacttgggtcaagtaccttagtgacttaaacaaatttacaaatttgtatgtgcttattttgctatgagggattgaattatatgaataggaaggttaattattgagtgtactgcccatcaacacagcatattcagtatatcatgtatgcatatccctgtcataatagtgttataataaataggaaaatcagcactcagtaaaatgaggaatactgggagttatgatccacttaagtctacagggaaatgtcttggaaggatcaggaaatatcacttcctcatgtggaacttctgctggagtgactttgtagctccaaaacatggctgatgctagtccagctgtgggctctacattctatttgctttcttctgtctcctttacctgctaatattttctacttcattccccatgtctacttctgacatctccaatcatcaagttgcctttgtgtggtgcatatgcagggttataacttctcttgattgctgagccttccttgtgtgttttgactgtctccagtatcctcatcttgcctgttgtccacatgtctgcaaggtgactgcatccccaggagcccgcccgcacagccttctctgaggccactacggcacatggcacatgacgcaaggctctgcactcgacctggggattaggtattggtcctcgccagtggctgggtaatcctccttgtagcacttgatgcaacaagagacctcaaaaaggcaaccagctggacatgagagaatatcttgggccatcctttctactctgccatggcgcgacggctcaaacaactttccagtgatcacttgtggataggaaatggtatcgtttaaacacaagttacaaaatttcaacgagaaagttgtttcttgaattactttgtattgtatatttcaaggtggggggaaggcaaaattataagccaaattatttctactgtggaaaaaagttcatatgtacaaagcatgtatcatgaacacttttacagttaaaatgtagacaatacagtttagagacacagttgttaagttatttggagatactactctcacatctacacatataatgcttataacactatgggaattgtgactataggttaattaagctgattttgtataaaactttggcactctatctgctgacttcttcaacataaagagtttatagaacaggtaagtttgaatattttcttctagagcaacttgcctttgaatttagcctatttttaagtgagagatttcaaaagtacacaaacaaacgacatactacctcttcctattgtttataggagttagttttaacatgtgattagagaaaaagggagtaggagcaagtaatagaagagaaaattctatgtttggtggctataagagtggggcacaaatacaaagaaagaaagtaatgaatctatgctatgtatctaatcagaaactcagaatcacatttaggatcagaagagtgctaaactaatgatttagggccaacatgatttttagagagcaaggctaaaagagtttaaaactaacagacagcatacctgtgttcattttcaccttggagagtttgttattaaagtcttcagttttcctgtaggaaaaaaatggtgcataattgttcactagcatgtggaagaaaatatcatgaaagtgtgtcgcatttttgtttttgatgtacctgtaagttaatatcacattatcattagtcttatttaaatcagtgtttaataaggtaggaagaatttataattctgttcatgttaaactttaattattggtcccatgctcataaaacagacatattctgtttttatgcttttgtttaatggtgagcattaatggatgaaaatggagacgttttgtgcttgtttttctttttttctttctttttttttttgagacagagtccgccactgtcgcccaggccacagtgtagtggtgcgatcttggctcactgcaatctctgcctcctgggttcaagcgattcccctgcctcagcctcccaagtagctgggattacaggcacatgccaccacacccagctaatttttttctatttttaatagagacggggtttcactatgttggtcaggctactcttgaactcctgacgtcgtgatccacctgattcggcctcccagagtgctgggattacaggcgtgagccaccgtgcccggcctgtttgtttcttttttagagagagggttgtgctctgttacccaggctggagtgcagttggtgtgattgtagttcactgtggccttaatttcccgggctcaagccatcctcccacctcagcctctcaaggtgctgggattacaggtgtgaactaccgtgcctggttgagttttccttttaaaaaattaaatttcttttacaaatatttatacaaatggtttttgttctctaagcctgaaatgattgcctgttaagtgtcctcttccagagttttaaaagtgaccctggcactttaaaatcattgccttacatgtgcaggtcagttgactaccggggaatatgtaatgaatgtaacgcatattttcaggacactgtcaagaaagatgagattcatctttctcttttttaaagacacaggaaatagatggtcactacaaaatccatctctgcattagtattgaatgctgatttttcccagtgaaatgttggatgcaaagcaattgagattaattcgctagaaacggttggcagaaaggggttgtctcagaaaaaagtttttttttttgagatgagtctcgctctgtcgcccaggctggagtgcagtggtgcgatctcggctcactgcaagctctgcctcccgggctcacgccattcttctgcctcagcctcccaagtagctgggactacaggcacccgccaccacgctcggataatttctttttgcatttttagtagagacagggtttcaccatgttagccaggatggctacgatctcctgaccttgtgatccgcccgcctcggcctcccaaagaaaaaggttttaaatattgtgtatcgttttatgacatgtgagatgacttagttctttctctggcatattctcttagcccatttatggagtttcttatttacccataccctgaaaccaaagaggaaagacacgctgataaggtagcaaatctcctaagtccaagagctccctgcaagagctgtctgaccccggccacttggcctttgctcctgagtgggcctgttgttgagtatccacaagaacccccccgcacagcacaacacactcacagcttccaggcgcatcagtactgcaacatccgaacattttcaagaattttatttattccttttggatgaatgaggataaatttgaaatgaaatcattggcatgatcacctgtcaagaaagacttttgataaataaagattttttagtctctaaaaagagcagcaaatgagcttcctggctttcttgcctttgtctgccaaggttctcaccctcttctcccttctgaccatttcctctgctcaactcacaactattattttctttcaatgtggctattggagttcacctcttttggaaagcctggctttgttcattactgatgaaaaattataataataaaatcaaaatgtgaatattagctaaatataatggtacttctctcccagtggggggaaaatgatgaaagaaaataacattaaaaatacacttaagtcctatgaaatataattataaagcaagattttatatatagatatatatgtatagtgtaatcctcgttttgctatatacacatgtatatgtgcacacatacacacacacacgtatatttgcctagattgaattactaataccttaggactcaataaatgctaaattaatgaacatttaaaataggtaaaatcacagtactgataatcacctcagtatatgtttttagagctctacgctgaaaacaatatagacgatatccttactatatggtgtttaatttttgtgtggtctgtgttcagtgtcatatcgttgtccgtctgccctgggcatcattgcagtgtagggagcagggcaggagccatgcttagcgtggccaggctagaactgagtttccacagggttatggggaacttcactggggcatttcataggccaacagactctgaaaaatgattgagggaaattttatgatggtgaattttatctcctatttttcagtgtatgcaactaaacaggcacatttctgttttacttttttgttttgttcttctccagaattacacagaaaaaatgtggcgtatttctaaaaactcagcttggtagccttaagaccgcctgtattgagggataccgatgaagtcagggaagagggcagcggccagcacaggagctttgggaaagctccttcaaacgtatttagtttaatctctcggtagctcttggtagcaaaactcctaatatgttaaccttaaatggacaaaataaatggaaaagaaaagcctcaggggatgtctgtgactgagactgaggcaacttctaaaacaagaagggataaacaacctccagaaaatgaggattatgaggacctttcccaaattcgacttcttcattccttttgaaaccaggcaacgctgtgcttacaactgcttaaggttttaaaacggaatgaggaagacagtattcgggctagaataatagtgattgacaaagaaaacatcaaatacagaaggttaactctcagaatacaaaatctgctgacagacaataataatgtttttgtaccaagttagagaactagttatcaacacctattgtttgaattcaaatgccgatatttacagaatatctaacactcaaaaagtaaaataggattaacgagaacaaagaaaggcgccacaaatccttgaggttttcatctttaaagtgatgtatcctgttacttataaatgtaatttgtgaggctttttaacttcccattgttttagatgtcaaaatgtgaaatgactaacttcctaatcaagcaagacattttccaagtcgttaaaagaagaatcccagtgattgagctctcaagaagaacctgaaaccgaaaggcttcttgggtgactaataaaaatgcacgattctatttcccttatttgtgctaagtccattaacaaatccacgactgagaactctctttagacagttcaaactaaagcgaatctaatctcttttgttctgctctgaaaaagtgtccttgattgtacttacataacaagcacagattattctggaaagcatcaaattcctagagtctttgcatgctgctagacaacagcatctcaagtattctcttaacttggaattgaaccagggacgagactatgagaactgaccataacatggagactaccttgagccttagcagacaatccacggagcaaagaagtctccgaacatgaaggtgtcagcatgattttcaataggtgctaggggattgtgtttacttttgtcaaagtttcatataaaaagcaacttcatatgtgtcctaatttgtgacaacaatggattggttttacttatggattagagtagcctccactgtcaaaatacatatggcaatagattgtgttgattgttcatggaagggctgtaaacagcatgacttcgggtctatagtcttttaattttgcttgaatttcttttttttctttttctttttccttttctttcttttcttttcttttttttgagacggagtctcactctgccgcccaggctagagggcagtggcatgatctcggctcactacaacctccacctcctgggttcaaaggattctcctgcctcagccttctgagtagctggaattacaggcgtgcaccatcacgcctggctaatttttgtatttttagtagagacggggttttaccatgttggtcaggctggtctcaaactcctgaccttgtgatcctcccgcctcagcctcccaaagtgctgggattacagatgtgagccaccacgcctggccaattctgcttgaatttctttggattatcagacatctcatttttctcggaatcagagcaggctgtgttctcaatacgtataagagaatagaatgggtaatttaacttttgaaagaggatcctaaggagtttgatcctgcatgggcatgaacatgcctttgtgcctgttgtctcataattctgcttgaattgttttgattatcaggcatcccattctgaagagcagcagagacaaaatcctttccccagttttggctaagaattctatgtaggtcattttatttttgtagacctgaatttaagcaccaagaccatgtatgaaactacaggactgaattttagctcagttaatgggaggagttgcccaaaagattttccacagacgaaccttaagccaatacattgctactgttattttgaaattaacatattcacagttcatatattattcaaaaaaggacatattgatgtttaagtagtaggaaaacattgcaggatgttagtttttttttttaaagagatgtattttaaacatgaacataaaaatacaatcatattaaggttatgcaccagattttaacttgaatttacttatttattttgaaatgggatcatttgtagcactctctttggataaactgccctaagtgatcaatgtattaatgcatctctctctatctctgactgtggtaaaataagaagtattcataaatgccaagtgatttcacttttctattatagtcaaatgacttaattcaggttgacatttatcttcacctatctttcctatatgtcaacatgctgctttgaaatagtcacatgaaaactccaagtagtttgttttgtgagtttagaaactctcttctgactagtttctctaaattggctcagagactcctctgcctgagtgggtggcacacaagtcaacagtagcggcatgactgtccatgctcataagaacaccaagtacctcccagaactcctgtgctaacagtgcctgaaaatgttccttattattcaggagccgaattacccgcggcatctatttatctatgctgaggccagaacacattcaacatcatttctaggaataaggagacattattaccacaaataataaagaaataaatgaacatgaggccgttgataattttttatgagaatacgcggagtgttagttttaattagaccaaatgtcctgatatttggaaaaatttcctgaaaaaagagcactatatgtcttccaaggaaactagcaattttccttttgagactttacaatgtaagctgttcaaaatacttatcaattttccctaaagactttactgattagaagttgatcacctggtaaatgattccttctgatgttattccaaggtctcaaagttggtgaatcactcatttcactatttgctttaaatggtcatgtgacttaacattggtccagcaccttactttcttttttttctttaggtggaatctcactctgttgcccaggctggagtgcaatgatgcgatcttgcccactgcaacctctgcctcccggggtcaagtgattctcctgcctcagcctcccgagtagctgggattacaggcatgcaccaccatgccgtatttttagtagagacagggtttcaccatgttggccaggctggtctcgaactcctgacctcaagtgatccacccgcctcggcctcccaaagtgctaggattacaggtgtgagtcactgtgcctagccaccctactttcatggagttccttagttttatattgtaatcttagggatcattacggaacaacatctaagtattttcaagtgcatcttttttctaagactaagtcatttgttcaacttgatagtacagtattaggagaattccattggcttataatgtgcaaatcaaaagccaaaaaaatttctaatgaaaataattcagattctgactgaggatctcataagtcaggcaccttatcaaagagacatgtgaggaattaattagaatatccctataacacatgtataggcaaactgaatagcgttggaagaatgggtcaagaaataggcaaagcttgactcaaatcccagttctgcccatttctatgcatccgaacaatttataccaatgtcattatcatcgactcccccgctagacagcaaagcatccccaatctggcaaactggcattattcccattcactaatatttcaaatattttgaagcagatctttacctttgattgagtcttaagaagataatctagactttcctgaaaatacatggggcattattgtattgctttagattgaagcaagccatatggtttattagactgatttctatggattttcccgtctcccaattgtcccacacccagcttagcaacatgttggaattgaaaaggaattctactttccaggcagctttctttcttccttaaaaagatcctttatttagctaagattttcccccccacacattgccatgaacaagagaaaacctaagaaaatagttgaatcaaacccttgccttctagcccagctatagacaatgctactggatctaagggaaagtgacactataaaggttttgacgattagcttttttaaaaaaatcattctctttccctttgacagctgatagccgaaagcgatggctgaatggaaagagatgtctataaaatgtcacataacaaattgtgtgacaaattgcagagtgataacatcctgatggcagcctactcctgcttaattcaataagggaaagtgcctctgatttcccaccttgtactgagaagcacacatttctattttgaggagaaaagccttgatctttttaaagaaccattttttaaaattttatgctttgctaagtttctcactgcttttaattttaaaatcttccgttttaatttttatatattgaaatataaaaatcatctgatatcaaaagaattatgtaatctagtctagttttgcatgtctcatacttagactttaagtagaagcaagcatcaaaggctctggtagggattgagatcaaccaactcatttttagggttagacatttgaggataagataaatggatgccccaagcagatactcaaaagtagttcatctctcctgactcctagcaaataataggcatcctcctttaaggaatcttaaaacgtcatttgaaatcaagatcttggccaggcgcagtggctcacgcctgtaatcccagcactttgggaggccgaggcaggagggtcacttgaggtcaggagttcgagaccagcctggccaacatgacgaaacccctgcctctactaaaattcaaaaattagccgggcatggtggcacatgcctgtagtcccagctacgtgggaggctgaggcaggagaatggcttgaagctgggaggtggaggttgcagtgagtcgaaggttgcagtgagccgagatcgcaccattgcactccagcctgggtgacagagcaagactccatctcaaaaaaatgaaacaaaacaaaacaaaacacaaaacagaaaaacaacataggaaatcaagctctttccctttaaaatattacagtaccctgcttaattaagtactgaatcatatgaggcaggggttagggaaaagaacaaaatatgagaagacggtgtggtagaaggcaaaactgtttgataaataaaataagaactgttaacatagaaccatatgtttcttcctctaagactaataggaaaacagtggttgattatgacaaggattccttttgcccaatcacagcacaagtccaaatggaaagtgttaatcaggtctactaaacccaaagcatattagacctccttggtctaagcctagaccaatagccattgattttttttttctgaaatccttagaattttcagttagtaagtatatctattttaaattattttcatggtaatgttacgtggtgaaagtattacagtgaaataagcctgcttattgttaattcactgttcttaaaaagccacacttttcttctgattgaatacacctgtttcctgagcacctgaaataacatttatatactttagcaatgtcaaggtttgtcagaatttttgacagaatatactgtcagaattattacaaattcatgtttatatgtgtctcagatatgcaatggtgaaatcccacttgctatgtggaatttaaattttggggcaggggaaaatttgctctaatttgatcttatagtcttaaaatttaagtaatacattacttacaaagtttatccagaatgaaatgtaccttttttttttttttttttttgagacagagtctcgctctgttggccagggtggagtgcagtggtgcaatctcggctcaccgcagcctccacctcccaggttcgagcaattctcctgcctcatcctgcagagtagctggggttaccggtgtgtgccatcatgccaggctaattgtagtatttttagtagaaatggggtttcaccatgttggccacactggtctcgaactcttgacctcaggtaatctgcccgccttggtctcccaaagtgctgggattatgggtgtgagcctccatgcctggccagaatgtatcttaaattgtacatcttaaggcagtttgattcattttagaaaatttgaacgagaaaataataagccaatggaggaaaaatatcatctgaagaaattttgaatgcattaaaagttggaaacttttgatatttgtgttgaacagtggatagtttattacattattctttgggatctaataaaagtagacaataaagacagatatcttccattttaatggaaatgtattattcagaaatgtattattaatatttatatactgctgctccattgttattcagacatttgaaaaaattctttacatttctctatgtactaaatgtacaagtgttaagcagaatcataggtgaataaaaggtactcaatttgaggagtaccctgttccgactgtgtctgcaacatttttattttagggaaaaacaaagtggtgtgtttattgattctgcagaaggcatacacacgagaggggaataggtaataagtagaaagatgatcttgacaggctgaattaaatttggctaaactaaatttcatgattaggttgaagagactggcttttcaaaaatttatatggaataagtctaagggctttaatgcaattgttgaaaaatataattaaatcaatgtctaaatgaacagtggtttcatgaatcaaggaagattgggctccagctgcctcacttttaaagtgtccacatgagtctgtgcgtgagtcaggctggcatgaacttgagtctctaggcaggctttggaggctgtgctgggtggggggagggtcacagaacgatatggtagagacactatggtgagtttccaggtgactaccagcagcaacaggaaaagttactgacatgtacttgaggtttatttttttctttcatctcgtggaactcatcccagtggcccttagggttaatgctcttaaatataccaaatttatgctttaaattgacaagaagatgtataaataacagttgcagctagaagcttcaatattccctcaagatgtacctgaatttaagaaacataatatctaaataagactgtttctcagtgctgggtttttaaccatctggttcacaattgtcatcagaaagaatgaaaacaagtccatcctagaaataaggggtttaagacttcagaactgtacaacaaaatgggatgtggtgtctattgcccttttgttcagcaaaatgccaactcagatgacctcacttctagttcttaccccccacatatgttcccagcattcttcatttttcatacctaatatagtccttcatgctctgccactatttaaagctaaaactttcactcaatccaccaaaaataggcaagaaaaacaacatacaaatacaaatttatattccacagttacacagtggagaacagtgaagcttatttgaacaaagtttttgttgtttcataatactctaacttatttgacgtactggctaaaggtagaaatgatcagaacactttttgagattgttagttggcatattttaacatatgtagtgaaatcctactcagtctgatctttattagccatttctcccccttttatctacagaaataaactctcaacactctttcttttatcttggacttttgccactcttggaaaagcagaaaaatttccttttgacttcccaactacacgaactctttcagggcagcctggttttagctccagggtagtctgccatgatgctcagggccatggatcaccttacagatccaacctgggcctcttgttcgcatcgactctaccctgggactcagcctgttctccttcaggtccacaggtagagaatgtctgtgtggacatcttcatggacagagatacccactgacttctgatctgatacctactgacttcatttccatttcttcttttataatggagcgtaaaagcactttgtcatctgtgctgcagcatttggtaaaggaaatccagaacccacgctgggaccacatgcatttacattgattctagttaattatgtttgagtggagtgatcgcttttctatagtacatagaaaatgttaacatgaactattattattgggatgttggctgtctgccattcctaacacagagcagagggtaagaaaatgtcactcatattgggagagggcaaacaataatggatgggccaaaaagttagcaaatttctttcttttttttttttttagacggagtcttgctctgttgccaggctggagtgcaagtggcgtgatctcagctcactgcaacctctgtctcccaggttcaagtgattcccctgcctcagcctcctgagtagctgggactacaggcacgtgccagcacgcccagctaattttttgtattttagtagagacggggtttcaccatgttggccaggatggtctagatctcctgacctcctgatccacccacctcggcctcccaaagtgctaggattacaggtgtgagccactgtgctgggccgcaaatttcttttttgtgggagaagccactttagaagtatatatctacataccttgtctaagtcaatgtgttgctataaaggaatacctgaggctgggtaatctatacagaaaagagggttatttggctctcggttctgcagcctgcacgggacgcatggcactgacatttgcttgggttttagagaggcctcatgatgcttccactcctggtggaggggagaaggttaaagggagccggcgtgcagagatcccatggcgagagcagaagcaagagagagcaggaaggtgccaggctcttttcaacaatcagctctcaagggagctcccccaggaatgaatagagcaagaactcactcactctccctctgccagggaggacactaatctattcatgaagtatctggtcccaagactcaaacacctcccattaagccccatctccaattggggatcgaatttcaacatgagatttggaggaatcaaatatccagaccatagcacacatcaatagcgaggaagtggcagagtcagagttcaacaacctatgttttaggggacttccaggtatgtgctcttaatgttacatgactttttttttttttattgtactaaagtgggagtcggtgttaagccttgtgtgggaaggtatgcttgggcaaatcacttcacttcgatgagcctgagttttaaagtttataacatgaaagacttgatttaaaatataaaagcacataagggacttttatggtttgaaattttgctaaatctaggaaaggtatattcaaccaacaaacatttgttgacctttaatgtgcaaaccactatgctactgtcatgattgtacatatcaagcagaaactaactggaagccaatatttaatgactcattcacatattaaaattcagaaaaaggagatggttaaagacccgtgcttctgatagcatcatgatgagatggggtacatattaacacatgtccaagccaccatcctgacaaccaagctgtctccctctttgttgtctgctttacttaactccagatataagatctagagaattgtttatatattacatgtctttctatattatctccagtgccctacccttgagcttctcaattttagaatttgatcgttcctaaaatagaatccattttataaatctgcaccagaagaaacagacagaacttcagtccatcaattttcattaatttttaaagcttttttcatgagtagtgtggtaggtacattggaggtaacaagaatcattgattctttttttattctgttagaatttacagtagaggagaacttcaaaacaggtatctcaatcatggaggcagcttggcattccaaatattacgtttttgcatagctcctattttaaagagtaaaagtctattggcttttgaaggaaaaaaaactaaaagatctaagcagactgtactcctagccaatattctcatcacatttttcttactggctgaatcagtcatgccataacttgctaaatgacaatagcatgggaagtacaatgacaatttgagttatttttcatgtggatggttgttgttctgtgctttgattactgttgagaaatgtcggcatcaggctcacaaacaattgccaaggtcctatgacccacaaaaacttcaatcagcctgttcccatgttcagatgttttggaatttggatgtttactttacataaattatgatttaatattatggctatttgtaaggctactatgtgataattgtatcattaacttcaaatgattaagaaaagcaatctgaattagggagaagtgagttataaagtgcttgtgaaaaaaggcaacgtattttccttcaaaaatacagattaactctaggtcaaggcaataacacctaaaataaatcctccagggtcctagtttaatgaatacataagaatgatttgtacttctaacatcaattcatatggaatgaatgcttctaaaaaggtttattttgtgtagtataagtatgctagcactttgcttaagaatctagcttttaatattatcaaaagtaaagacagcctagactctcactgaattacctcaatttctaaattggtatgtctaagttacgattcagacataattcatatttatttcccatttcatgttggagtcaggatattcgcttctccccaaacctcaccccatttttccagtattcctcacctcagagaatgctatcattcattcattattttttacaattttatttatttatttttttgaaacagagtctcactctgtcgcccaggctggagtgcagtggcgtgatctcggctcactgcaacctctgcctcccaggttcaagctcttctcctgcctcagcctcctgagcagctgggatcgcaggcatgcaccatcacacctggctaatttttgcacttttagtagagatggggtttcaccatgttggctaggctagtctcgagttcctgacctcaggtgatccacccccctcggcctcccaaagtgctgggattacaggcgtgagccaccgcacctggcccattcattcattattcaattcattaatcaaaaagtttgagagcccattctactccacaaattaccctggatgttccctctccctcaactctccatgttttgagaaataagacaagaaacattcagctctgggaagggcagcatgcttctatctcagtcccacagttcatttgcccaagagacttgggcatgaaagataagcatttctagtccttttgattttgcacaggtcagatataggttaggcacaggttaacacagagtgggcagatgggagtctctgaccagctcatgcggtgcaggagttatactgttgcttcactttcccataacagcaatggatccgaaatggatgatgatgttccagtgtcacacaggtaggggcagcatggcagataaacgtgagagaaaaagcagtgtgtgcatgcacatgtgcacatacacaaacacatgtgcccatgcacaggcacacgtacacatgctgttgtgttccccacccagttgtctcaaaggccacgagtttgtggattttatcttcctagttcagtacaggactacccagaagttggtcgatattaaagcctcaaaggaatcataatatcacttttgtccagattttattttccaatcctctctttgttttatcaaaaacattttaggagtacattttttcagatggattatgtaaacactggacctgttcgttaaaaaaatttcttagagatcaagaccatcctggccaacatggtgaaaccccgtctctactaaaaatacaaaaattagctgggtgtggtggtgcgcacctgtagtcccagctacttgggaggctgaggcaggagaatcgcttgaaccgagaaagtggaagttgcagtgagccaaggtcgcgccactgtactccagcctggcgacagagcaagactccatctcaaaaaatatatataaaatcaaaaataaaaaaaaattccttaaagtttaatattgatatgttctatatgcaaacatgaatgggggttttccgttttttcactgctatacactcagcctctaacaatatctggtacatattatttacccagtgaatatttatagaaagaagatgtcctcatttacagacatgatggaatgactcccatcgtgaagtggtttgtcagggagagttagacaaaggggcttgaggattcccctcatttgccattacagtccaccccttggctcttctagtctattgagggcctttcttctgagttgctattggacatcttgaatgtaatggtgtccctagacaccagtttacattgtcttccagcatatgtcacttgaggaatctctagatgatttagaggtgtcaggctaacaaatccacactcattcctgaaaatccctggaaaatggcaaagataattgagctgatattttggcaattggcaggatgattttgtttgagtctgaagtgtattttaagaagttatttaggtttcctgaataccaacagtatcatgaaaatattatgcttgccacgttgatttaatcaatcaattctaaatcaccaaattatatcatacattttaaacaaaagcatttttactattgaaccctaaacatgaatgtgacttgtgatttttgtttttccaagagaagactaatacaaatattcattttagaaaaattctcagtacatgggctgtttgtatatatcttaccacttcatatcccaaccaaaatcagatccacaaacagcaagcaaacaaacccttgactcttttctcttttagttagttgtaatataacataagtgatattgattgtagcaatggagaatgattattgttactttgggggttgtgtctcaagtatacacaaatggataaaccacaatccttggtgcatgacaaggtcatgtacatccccctccctcctttccttccttctgtcactaaacatctacacaccaaccatctaaagccaaagatagaccttcgtaaggacctgtgtctatccagatgacttctgctgttataacatccctcagctccatgcatttgagtagccatcattctgaattccatgcttatcattctcttcctttcctgttcatataatttcattgtatttatatgtcttctaaaagcacatttattttagttgttttaatctttataatgatataatgctgcatataattacattgctaagattcatctatattgttggttatccctgtagtgtgttcacttggtctcctatataatatttaattttgtcaaaataccacattttgtacatccacttcctgttcaggggcatttgggttgcttctagatttttgctatattggagagttctgtcataaacacgtatgtacatgtttcttaatgcttttcttgtgaattaactgcttggcagataatttaaatgatatagctcctacttaaaaagtattttctatgtgccaaaaactgatctaagaatatttacagatattacatgtatattaattacatatgtgttacatatatattacatattacacatatattaattgacctgaggcctcacaacaaccaaacaagctaaatactattgttatcttattttactgcaaagaaacgccaaaccacagggaaggtacaaggtcacacagctattaagtagtgagtgaagcttgggaatgcaggcagtttggcttcagagtttttgtactataatgtctttcttggatctaaggacataaaggattgcaacagtttataacacataacttagttattgaccagaatttgagtgtgagtctgtcataatcaggattaatcaggtacagtacaccctgtaatgagcaatattggaaatgctcatgtatactataattactctaagacaaatgtcataaacatctttgttttttttttttatcatgggtacaaggcacataaatttatttcaataggacagctgctgcttttgatgcttgttctcacaattccgtggtggtagttgtatttgtttgttctcatgttcctaataaagacatacccaagactgggtaatttataaaggaaagagatttaattgactcacagttccacatggctggggaggcctcacaatcatggcagaaggcaaagggcatcttacatgacagcaggcaagagagcttgtgcaggggaattcccatttataaaaccatcagatctcatgagacttattcactaccacaagaacagcacgagaaagacgcaccccatgagtcacttacctcccaccggatccctcccatgacacgtgggattatgggagctacaattcaagatgagatttgggtggggacacagccaaaccttatcagtatttctctgtgtttctcacaaacatccctgagcactttattgttatcacccaccataggatggtcaggcccatctttcttccccttgaaggagcccaggcttctcctaggcttcagtgttaagggcacagtgggttctgggtgaccctcataaaatcagatcatgaatttaaggcagagccgacttgggctctcactctccaggggagatgttcttagatgaacaaaaattctccttagtcagaaaagcagcatcctcatcaatgtatggaattgtggcaaacatattaagcatgtcattccttaagttaatatctgtcactacataataactcacgataaataaatgtggtcaagaaactatattgtcacaggtacatgtaatagataaagacagggagcacaaccagcgtttgtttaactttgcaaggatcaaaccatcatcagaaccaccctttgtgtcttcattaattttttgttcatgctgattctgaatgtttagtctcaagaggaattatgagccatcagattggatgagtcaccttttagttataatcacaggagcattcaaaaatgaaatcactttattcagctggatgaaccttataaaaagtaaatgacttcatatacatttggcataaggctaatgagctatttttagtttttcctggaattatcttagcccttctttccgccctccgtgatgcctgcctccattttaccccttcccagtgctttcttggtcatgctaatcaaaaaggaaagggggaagaaacatgtggttttgataaccttcaaatcattaaggcaagggggaaaaggcccacaaaaggtggctctgaaacgtggagcgcctttccaagatccaaataaagtgttttctagagagtttcatgttatttttatcatgacttttataatctactactatcttttaaaatctgcattagaatattatttctggatctccaatctttatatctatttctacgtgggtatgactgtatgtgtccctcaaaaaatttcaattcagttcttgtgaaccagagaactcttcaaccttttctctttttttgagacggagtctcgctctgttgcccaggctggagtgcagtggcgggatctctgctcactgcaacctccgcctctcgggttcaagcgattctccctgcctcaacctcccaggtagctgggattacaggcatgcaccaccacacccagctaacttttgtattttttagtagagatggggttttgccatattggccaggctggtcttgaactcccgccttggcctcccaaagtgctgggattataggcatgagccgctgtgctggccaaatcttttttttttttttttttttagtaaaaggaaactaaagttacaataaagaaataaagaaacttacattttgttgacactaaatggcaggtttcatacaaagactaatcttttttattagggtaggaataattattggtgactttctctgccaattttccaagtgttggtaatacatgttgttactttttaaatgtgtttttgttacttttaaaatgaaatgaaaaagacatataaattatagcatacatgtctacccctacatttaaaacaatatattcctatgataaggcagaaaaattaacctacccttccctaacacaaacttccctttaatgcctgtggccatctgtagatcctgtcctctgttagcaaactccactcatttgctttttgaagttgagttcaagatcctcccatctcctcacctgccccgtcacccacatctctgcattactgtaggctcactgcatgtgcccttcatctgacattgaatctaggctgtcttgcaacatttctgatattactgccatttaatttaactttttatatgcattgccttttttttttttaagactagtcaagtgcagtagtgagaaggaagaaagagtggaacaaggagttcagctgtaattgactaaggtgactcactctgtggaccagcctgcattgcctttctggctacattggtaagtatgttaaggagagggacaaagtcacttgaagtttttggcctcggtttcctcatctgtaaaatgaagggaaccaggcctccgaatgttgttaatccaacacctataactctttttcccaaggttgaagatccccagtaatatttcagcttgctttcactcgatgttaatccaacacctataactcttttccccaagactgaagatccccagtaatatttcagctttgctttcactcagtgttccctgactcagagatctcaaaccctaagggagaggcagagtgtccttcagtcttgacgcctgggagctgtggatgcctcattgttgctcgtcttgcgacataaaataacagcatgctagtggccaaaaggcatgaagtgttcaaacttattcaaagttcaaagtgttcaaaccttttatgtacatgattctttaaaacgagggaaaagggaattgctctgttctcaatcgactgtgtctgagttcttaggatttatattagatccacactcccccccaaattttgaagatggaatgaatgtgttttctcctatatttaccactcaagttttttctttcctacatgctgactgtttgtgttatggtcattagattctagtactgaaggggttttggtttttgcctttgttctctgtgtgagctatgcagtggcttttgtgctgaaggagggagctcccgtctcatcagtttcagaacttgagtgatggattcgtcgtggctgctgatggtaacggtgggcactggccagcctgttgctcatgcagcgtgggaggtgagcgggcacagtgcccgtggagaggtggtgctgcctgatgagcttagggaaacccggtaaacaccgatgtgctctcccagatgcaaactgagtcacatccctgtcaggaaactgcaaataaatcgtgtgcaaaacggaacaaggatcctattaattaatttgggataactttattttattttttattttttttagagacagggtctctctccattgcccaggctggagtgccgtggtgtgattatggctcactgcagccttgactgcctggattcaagggaccctcccacctcagcctcttgagtagctgggagtacagatatacaccatcacactcagcaaatcttttcattttttttttgtagagctggggtcttgccttgttgcctgggctggtcttgaactcctggcctcccatctcagcctctcccatctcatcctcccatctcagcctctcaaagtgctgggatgacaggcatgagccactatgcctggccctgacatgagactcttaaccaggccattttacaaccaatttcatgcattctacaattaaacaagatagtaattgtgtaacagatctagacaactttttcatacagatatttattttcccaagttcaactagggctagagcggtttgtagaaatgtataggtctaaccaatgcttcagttcacatggtctcttgctgtacagcaacagccaggtgagttctaagtgtcaaagtgcccacaaaaactgcagtgtaagtgaagctaatctttggtgtctaacatatttttactgtgtattcacttcccttcatctttttgcattattttctgtctcaaagcaatctgttctacatccttccccatccaaattcccaacatatgttggggtttaggcaataatatttgaggcaatcgtagaggaatgtccaaatgtgtttgaatgaggggctgtttaacctcatgtagagctatttgaagattcagaaatgtacttctgaagcccgggtctgtctttaaaaggccagacttggtatatcagcacctattcagcacacgcacaagctgcccaacaccacactcagctgaccgtgctccccgccacctatcctctccactgatggagtttcatttttctatcaagagcatcaccattttgcttgtccagccccaaaacactgacatcatatttgactcataactcctcctactatcctcatgttggagcagatcctactgatatgaacagaagccagagaaattctaggcagaaaagggtgattccccagcaaaaccccaccctcaagctgaaaagcctgaaaccatggcccaaagtgagaacttgtatccctctttacccgctaaaatgttgcctttcctaaactacctataaccatgccccaccccatcctgtgcccataaaaaccccagacttagctggtaggtgggactacagatgaatgtcagagagaagcagcttgactttggagggacagcttgacggcgtaacttcggagaagaatccagccagagacagctggattcaaggggaagactacctacctgcccatcccctgttcagctccccttcccactgagagccactttatcggcaataaaatcccccacatttatcatccttcaatttgtttgtgcaacctcatttttcctggatgccaggcaagagctcagaagccaccagtgcaaatataaaaggctgtcacactggcctttgccctcgctggcgggggtagctgcctcatgcgaaaaggcagagggcccactaagctgttaacacttaagccgcccgtggacagcagagctagaacagcactgcaacacgccctctggggctttgggagtcacaggcacccccacctggatgctcgaacggggactgcatggagttcgctcctgccagtgccaaagcggccagcgggttccagcgctcatgcacgccagcttccactctgcttgctggtgcactccctcctgtgaggagttgagaggggcaggctgagtaaatgaggcacccccctcgcaagtgccgtgaaggggtcaggggaatatcctgcatcgctactgtctctttaaaatctctccagaacctgcacacctctcatcaccaccttctgtttaccacctaacaccttagtctagctttccagtaaccttatggtttttctcccttcctccattgacatcacctgcgttccactgttcccaaagtatccagagtgatgctcaaacatctgagagacatcaggcattctcctattcaaagccctccagtcacctcccatctcccctcctttgctggccggcagcatcctctgtgtcctgggccctcactgcacctctagctcatggctaccactcttcctctttgtcctccagcctctaatgaggctggctacctcgttaagccttggacactccaagcccacactgtcctctccctggagccccaggtctctccttgagttcttcagatttatgctccagcacctctgtatcagagacctttcctaactgccccatataaaatgcagtcctccatgtttcctttgtcttttaaaagtttttctgcagaacacttcttatcacctctcatcttacgtgtttgctttttatctctttcccaccacaaggattagctcagaagagcagagactttcatcaggagaacgtgattcagaggcaggaaatttaatcatggggtggaacctataaggacgttcagtccacgtactggcatcgtgtggctctacacagggtagttaggggaagggatgagtattacaagttgctgaaaacaatatatacttttttcctttagcaaatgcaaagaggtagtcagcttcaccacttaggcaaatgcagaaatattgctgctgtggaaaagggtgcaagagaaagtcagagtgaaacaaatcggtgctttataatttagtgagtagaatctgtaatcattactataatttaatcattactatcatttagtttcccactgtcatgatattgcagcctggtacacattaatattgccatatgttcatactgcacaccattatttgcctttgtcgttttgtgtgaaactagacaaacatcacaatctgactttggactctgaccattagcattgatttcaaacagtgctgaggcaattctgtgaaatatggaatcaccaccactacacaggatcttaaacttcaattctagaaatgggatggaacagctacccacctatccttaagtataatgaaaaaattactttcctggtgataacataaccttcattatttaagtggatatatggttgattttctatcttacatttaatttccttgggttttgttaaaattatgaatgatgaggcattgctttatcaaaataatacatttgcattttaacagattttcttccattctttctaaaggagtatctcaaataatgggaggagtcagcaggctagagtgtaggatattttgcagcagtgtcttgctttcagcttcacgtcatcccattgctccctcagccagcctctgaccctacacttggtctataccaggtttatatactgagtttcatggatacacttaggtggcattaagtagaataatggcagatgtaatgtttatataacttcacttaaatttagtttaggcttttttttttcacctcatcaacacagaaaacctataacctaaaatttgtgcagaaatgtgtttcacaacagcaattaggtatacaggtgtattaatctgttctcgcactgctaataaagacatacctgagactgggtaatttataaaggaaagaggtttaatggactcacagctccacatggctggggaggcctcaccgtcatggcagaaggcaaaggaggagcaaagtcatgtcttccatggtggcagacaagagagcatgtgcaggggaactctcctttataaaaccgtcagatctcgtagatgtattcactaccacgagaacagcttgagggaaaccacccccatgatccaattatctccacctggccccacccttgacacatggggattattacaattcaaggtgagatttgggtggggccacagagccaaaccatatcaacaggcatgctacctaaacctctcaaatcatttaaaagtttcacttatcttcagaacacatgagtctataaagaaataagcaactgtgttttgggttataagttaaaggcttgtaaatcattaaaaagaagaccactttaccatggcatttttcacgacagattttttaaaaatatcaacattttctcattaatctccatgaatttgtttgcaaagaataaatttacttaatcattagctttattctgcttttggatagcatgactaaataagttgcctaaactgaaagagtgatgttaagactaaaagtagaagttatcagtatttatgctgatgtaacaggcataaaatgggattatgccaggcaataaggcgaaaaagagatgatgtaacaaaattccttctattttgatattaatttagtctccagcaatttatagcttttctctccaagaaacaccactcctgtaccccaaggagatagtaaagttgagaaaagccctatgaaaaggccaaaggaacagacacgaaataaaaaataaaataaatatttagtttaaaaaataaaaagaaataatttaacctagaataattaagactaaagaaacatgagactgaaaatttaaaatcagaaaaaaactggtaaagttaactctatttttccctaagccctaacttaccaggattaaaagacactccattatatttcaaaattgtttttgatagaaatagattaaaaagtactttatgtagcgagtagaacatttctggaactcaacaacttgaaatacaacagaccaaaaatgtagacagaatctaaatcctttagaaatatgcaggagtgacagctccatccatgttttcctccctcgactacaagtggcttaaagacagaggtcataaaaaaagagtgaaaactactaaatgctcaatagataaataataaatcttaagtgcttaataaatgttgctggaatgtgtaacagaatattctgaaaggaaggctattcttaacagtcatgcccactgtgccatgtcctacaatgtgactgctggagagagattagaagtaacatctttttctatggcaagccacacagtcagagacctaagagaaagtagtcctcttcctcttctaataaatagaaatagacagttcctatatcatcagaggatttcatagaaaaagtatttcataacgaaggcttatgatcctgattatgggctacttttaagaactgtggcatcacctgctgctcaactcccagacagagatgggcgtggtctcccgtaacacctgctgctggggcaggctggcgaggtagtcaagagtgtagatgctggagccaagccagctttgtgaaaagcccattctaccatatccagatggatcacttcagaaagtgacttatcctctctctgaacctgcccacatttcctcctctagaaacagggataacaacggtgccaacctcctggggtggctgaaggacccagtggatgcgtatacacgaagcacttagaagtgagtctggcaggtactgccaaaaatgtgactcctgctgctattaaacaggggatgttgccttggcaccgacaggtgtgactagcggttgaaatatttcagatacggggccccttcttgccttggtccctcattcaaatgaattcacgaatcaggttttctcttgtataaatgagttttttttaagggcgtctactaaatcttggtttgaaggatgaattcttctgggctcacatttgcttctttactccacagatggtggagtaaaatctgtgttcattgcaccttccgctggtgctttaggctccaggagcagcagctccctggattgagtgggagccagttctgcctgactggtctcaccagcacaccagactgcgcaggcgggtcagaggcccacggggaggaaacatcagtggagggaggatgctgtgagcggtccacccctgcatgacagatgtccctttacagaaaagaagtgggaaacagactttggcaaagggaaacggcagagtagcaagatgattttgattactagtgacatttaattgcaattagatttttaaccacaaccaagaagatgataaagcttttccatgtattttccataaaactgtccgagcttaggacactttagtgctcattcttcctgcaacactacccaccacaggttcactgtattggaagtatactgagaagagctcgtggctggcgtgggagcgccgctgtcttcaaacctggaagtgaagtgcacccacacccagccacagcagtgattccccgggagcgaccttcagggagttgctaggagatggccgctctgtgtttcctttgattatagggcataaccctgccactgtcaaaatgccagaagaaaagggcagtgattgctggacataatttttttctgttacttcctgtgagatattgttttgcacaaagggaggagactaagggagccatggatatctctgtagcagaaacatggcaactattatctgaggaaggccgacatcctccaatagcgatcctgtgtgcaacgcgtattatttgcttcttcaaattgagtcgtatctttcagtaatttcttaagacgctagacggtattacacataggcatggggggtggcttgtggtttaaaagcagggcttacacatataggtagaagccgcatgtggtcaaaggagataaagtaccacaaactgaggagtgtagttagctgggcgccctggattgaggtaaagtagaaaaagactgtgatacttctgagcccaagacatttcactctgccacactatctcctgtatatgcagttattagatagacaattctttttccgtgacagccaatatcaggtagggcttaaaagtcacaatctgggtttacaacacaactcttctgcttattagccgcatgacctggggtgagttactttctctctctgtgccttggtttctacaactataaaaccgaaatacgttacagtaagcacttgataggatcaccgtgagaatggaatgaaatcatatatgtatggccgggcgcagtggctcacgcctgcaaccccgacactttgggaggtggaccacttgaggtcaggagttccagaacagcctggccaacatggtgcaaccccatctctactacaaatacaaaaattagctgggtgtggtggcgggcgcctataatcccagctactcgggaggctgaggcaggagaatcgcttgagcctgggagacaggcgctgtaggaagccaagatcgcgccattgcacttcagcctgggtgtcagagtgtctgtctcaaagaaaaaaaaaaagaaaatatgtaatatacttagaaaaatagctggcgcagaacaaatgattacagaaatatgagctatcattttcattattattattagcatcataaacattatttcgttgtgctctgaatgcagctgaacagtactcaagagtttcaggatcagttgtataaaattacaaaaaattagaaggtcacccatcttgagaaaagacaagtttgtataaacaggacaaactactgaaagcaggagagttcaaggaagccaagagaagctgagaaagttttcttaaatctgctgtcttgttggttgctgatcaccacctcattctccatgataggtgcacagttggcgtacaggttacctagggctggatactgattgagcatatcctgtgcacaaggacacctatgtttattccacttagaagtctgaggttgttctgaatgtcaagcaacaaaacaatgcacttctttgggagagctggggcattccagattctggtcattaactgggtgagtgtctttaggcatcattccacctttgtggacttctgctccctcgtttgcaaagtgagagagtcagacactcaggttatgttcccttaatctccacctttaaaaaaaataatgttctgatctaccttcataagagcagttgtgtgccttaattttctttgcaggtttgctctatgcagacctgtcatgtggaaactcagagttataaattagaaacaggtaaatgatttatttttgccctgcaaatgagtcacactctctacaagtggattattaaattccattaaataacaagcttgcccaataattctaaaatagaatctggttttaaaaaaaaatcggtgtacctgttctctgttgtataaagaaaggtatgtgatagcatcgttaaagtatatgttttagaaactactctggcaaataattttcttagagagaggttaccgagaaaagagaaaagaaaaatttagtttttctggcttggagaagcagcaagtaaaagtcacagctctggaaccaaagcaagaaagctccttgaagaatgaggtaatcagacttgccggtaggtactctcaaaccagcgtgaactgtacactgcaattaattattaaatgtgctcaggctaggtcaggctatactaacagaattcagacacgtttttctctccagcatttggttatcagttttgtgacatatagagtaacagttataaggatcagtttctgcaactccatccctcaacctacttttttattgtaaatagactgaatgtggggaaaaggcaaagagaaaaagtgctatgcttcaagaacatttgtcttgatattttggtggcaagcatcatcaaactaactatatttggctctgactagcttagcatgagatgttagtttttagccgcaaatgagtagcacttgacaaggtgagaaatcttccttcaattgttgaaatcatccaagacgtgtttctaatctacattttgaaaacaaaagccctagcataatgcaataggaattcttcttgcctgtataactggattctgctctagggtcttgtgggatggttattacacatggcagagaaagctacgtgtcctcttgcacccagtccctcttcttaatttataacggaagtttcagctgaacacatggctttagccaggctaagattacatttttcagtttcccttgttttatcaccaaattttgaccagtgggtgtgagaggaaatgctgtgtgcatcttccaagaggctgtggccttaaaggcaagaggtgccctctttgcttttccctttcctgctggctggaacgcagaactgatgtcaggagctggggcagccctcttgaccaccaagggaagccatgtttagcgctgagaaagacagagcaataaatggaaggagcccaggttcccagaattgtgaagcctccgtactagccttgcaccaccaatctgtacttttacatgagtgagcaatacacatcttttatgtttaacctctgttaatttgaatctctgtaacggcagctgaggttttatcgcaataaatgtattcccacagtcagaatccagacaatttcaatagttccattttatatttatgtataatcataagaagaaagtccccaattttacattaaactctgtattccttctaactgtcttgggttgagtgacacggcggctattgaacgtatttctgtggcactgtaacccagtagatcacacccatgcaattgctttctcttccttaggcccaggtcacttcacctgcacctctttaaagactgtatttcctttctgtgtccctccctccctctctccctttcttccttccttccatgtatctaagagattggcctgggcctccggtacccaggtgctctgccttgtgactccatcttatgtgaaaactgtgccaggtgctagaaaacagtttgcaaattatattttggtttggagaccttgaggatgcatttactgaattttttgactggtatttacatgatcatctcaaagaatgaattgcagttttttcacagtggaggtactgataattcaccccttgaaatgaggccgtgtgggatgagcaaccttgaaccaggaccttaaaagcttagattccagccacggctccgacacaaagtgacagccgcgtgaccgtaggcccatcgctctgtctccctgggcctcaatcttctcacccttgcattgggaatgatactaaagttcctcatccacctgcctcatgggattgctcagaggatagtgtgagacaatctaccacaaagtacaactgtgagccacttcctaactcctgctttcccacctattcttttttttttttttttttttttgagacagaatctcactctgtcgccctggctgtgatctggctcactgcaacctctgcctctcgggttcaagtgattctcctgcctcagcctcctgagtagttgggattataggtgcctgccaccacgcccagataatttttgtatttttagtagaaacggggttttgccatgttggccaggctggtctcaaactcctgaccttgggtgatccgcctgccttggcctcccaaagtgctaggattacaggcgtgagccagcatacccggtccccacctactctttaactatgacagatgtgaacgtttgatctctttgcagacaagatcagcacggtgactgggtctttgccctaccttcctaagcaaatgacagaactggtagcagaactggagcccctgaagcttctgcaggcaaacttcctggagcagcccaagaaagtcagagcccctccttttcgtcacattcagttggaattttggaaaccaagcataatggagaaataacttttttggtatagccggaagatgaacccttgggcacagtttcaaagtcaaatattttactgtaaagtggaagaagaaaatacccagatctttctgcatagtcaagtggcttatgttttgcacgcattggaaagaagggaaaacaaaagctgtcttagaagacgaaatcaatcacatgaggagtggcactgctccagagagctgaggtcttcctcttaggaattacagactttggttccgtataattaggccctgtgttgctcaacttccaaataatttagagagaattatcatgtgagagtgcacatatatacatttttttccaaaacaaccttctcaatatgtagcaaaatgtagtcaaggaagaaaaaaaatgagaagttctttagatttcagccaaaacaatcacttaagctccaagtcactatataaacaccattaatacctgttaaaaggtcgtgaattctgtaagagatgtttggaacaaacagtgcttcagaactacccacaaaaataaacaaaaaagagatcatattatgtcactgggtccagacaggatgatgaaacggctatgatcacgtataagctttatctatctttccagagaacagtgtcagggacatatgggttactttccaaattttgtttaaaaaatatgaaaaacatctgtgaaattctggtaagacaaaaagagtttctaattctttggatcgcaaaatgattcttcagttctaattagctatgataaattatgttaattctaaattattatcattcatgtgggcatttaatttaaaaagtggcattatttggaaaacagtctctgcaatttattctaatgtagtttaacacgaagcagctacattgcctttttggatattttcagaagtgtgaaaactgtgaatatcacttcaggctttgcagaatggtactctacaatgaatctgtgtctggcatctgattggtgataaaaaaaattattgggaatagattattagttattctgagacagaattttgagaaacttgttgaaagagtcttgtttgaagagcccataaggaacctcctccttcacacccatactctggctaagaatgttgactcttttttcttaattaaaggctgaatcactgataatattgttgatattaagtgcctactaaccagcagcatgagcttttaacacttttaatgtcacccaaaagcctacccaaagtgcccaggaaaataaacagttttctaagattcagtataattttattttgttttgtagctaaaatgcgccagagctgtattcatgtcatcacagtgggaagaaggcaaacatctgagaaattaataaatcccacagccgatctgagctgtcacccaaccccaaagggcctcagtatctgcatctgtatatggggataactcagttctccagagtttgtaacaggcctagcacagtgcctgcacatgtaagagctcagaaagttatttgtaaattagtaaattaatttataaaattgtaataaatcaataaccattaaaaaaaaataaaataaaataaatcccacagccactaaaagcatatcgtatttggggcacaactctggccatagaggcaagcacctgacataacacagatggcttcttgctggtagcatggtggcaacttcgctgaaaacacagagacaaggactgtttcactctgtctcccttaagaactttgaaaacagttttatgtctttggagaaggagcaccaatttagcttgcatcatggatcatatagaacagggtatgttttaatgtgctaaaacctaagcaatgtatttaacagagcaatctatttccatgaggttcgtgagaaaataattcagaggctctaagggaagttgggagaagaaaggacagcccgtaccagtgcactcaaatagccagaaagagcagagatgctgattgctccaagcagtagtctgagtcttattctattcatttccttagagtaatttccagtatttgttaaggcatacagaatttgggggcttgaggtagggagtgtgtcttatccatgcttggaaatgtaacagcttttgaagttttgtaatgtttcttttttaaagcaggcatctttctagttccactatctctgtggagttgaggaaagaaagtaattcatagacacagggcagcacgctgacctttcttcagtgaacgtcaaggtcctgggctcataagggaataaggaagaggaacctcagtatattaatccatgggctccagccacgtggcagctacatattttcaatcactttgcttacttcaaacttttcttggtgtgccatgtacattaagaacagataactaagaagcaacccttctcagtgtttttggcatctactgatcagcacctgacattccaagttatttcctcctctactcggcatgccgatttctgtactgttgaacagcaggaagtgctttcaagggtctaataaattagcctttcgttgtttcaacttccaagtgaagttaacaataaaagaagcttagtatgaaaaagatccagggtttcttaacctacctcttgtttcttattttctttcagtattggcttttttttgatgatgtttgggtgtttggggagtggaaacaccataaatttgatcttaagctgtgctgggacaacttttgcatgtttttattgaatacttgggatattccactgcccagagagttaaaaaaaaaaaaagacaaaaggatgagcagctagttaatagtcttcatagccaccagttatcctttaatctagtattttctagagtgctgtgatatttgcagaattaacccacaaaacagtatcctatgggccaaccggtgatgagactgagtttgcctttgagaactccggtgggtgttctaacctaactttcctacctctcttcactgtcatttatattgttgcctgaggactcttcctaatacctagccaaagtatggggggcctctgctgtctgagaggtcaacttctaacaatttagtgtgacctcaaggccaccccatgacctgactccattctcctttttcactctcgtcttcggccacctctctcaatttgccagactatctgctctccctggaatccaccatggacgctcatgctgtttcccgaatctggatgtagaatttccctgacctttttatttacaaaattctacccatctttcaagattttccttttcctgagttgattattctttgtttctgtgttctcaaaacactttccttgagcaatgctaaatactagtttccttcacgtctgtttctctcaccgcagcatctgtgagattaaggatagtgtctttttcaccatttatctctcactgctcctagttcagcaccttgcatatctttcatgctcagtgtacttaaaaacaaaagaatcatacataagacggtgttgccagtttatcatttaatgaagaggcttttttcttttatcaattatggtaaatctttgactagttcaaaaagggatttaggcagatctatttttgagcatttctcctgttaatatttatattgaacttcagccttttggggtcaacagctagaaaccatcacagcctgctataatccattagttacaaaaggatggaaattatcctgcaaaaagcgccaggctgcagaggttcttgtttggaattattacactgctgttggatattctaactacccacttgtgttcaaaggagaagcggcatttgagaaagcttctaaatgtgggttctgccacctaccatgtagaactctatgccagtgggtcaaacatacttgccgtctaatttagcatcccaatatagattctagcagagcttctttgacatagctaatctctctgagtttcaatttcctcacctataaacttgggagtaacgactttgtgtggcaagaaccccaagtaattaatcaaaattctaactttgtgcttggacatagggattgatcataaatgtgggctattattgtcttgatctttgtttttgctgttgttcatatagtacttattaatatggcttctaatttcaggtttgtcatttctgtcgttttaattttattttatcaaataaattatcataataatcttttcattggctctcctgtccctagttctccccctaatattgatctctctccttttaattccaagctgcaattgcaaggctaatattttgaaaggaacactgacttcacattatctattaataaattctaaaccaagcccaacacaacatgatcctaacctaattttcaagaatttattttccttctcagtttttttttgttttttagtcaaactgaactttttgttgctcctttttttgtacatttcatgttttagccttcatttgagtttaattagcacattttaaccagatgcctacattgtgtcagatattttctgggtagtaggagtgtcaggataatccaaaagaatccctgccttccaggagcccatgactggtgtggcgaggcaggtgtgattttgattcatcttttgtgagatgttttattcgttgagattacctctaattactcttaaaattacacacagttttagaagtccatctcaaaatagtcccctatgaaaaccacataaatccctctcactcatttaaactaatatagttccttttctgtgccacttcatcttgtcttactttatgttatttatgttggtgttttcttgagggcagggatcatgctttattcacatctgtgtctttcatcgtaccttatgtataacaggcttgcaataaatatgggttaaatatcaaaggaatgtaatagtacaatttgactttaaatagaataataaccaaagttttcagggaccatttttcaaaagacccattcccccaagatacttaacctacaatgcttactttgtataagctctgttacttaagctaacaaacaatagttctggaaacctcatatacagaaacataaggatatttagatgtataatatattatatatataatatattttgttacaccactagacttggcttgaatgaaccagaatattgcttgcttatttccttgatgttcttttcttacacggtttgttctacaaatgtataaatattaatatattagaaagttatagaaacagatgaaggaaaaatagacacaaatatagtatggaagcctggacataaaccagggatttcagaaatagaagctatggagatgcatccgggaggagggtctgttttagcacatttgggcatgcatctttaaataggagacacatttctggaaggaacatagggtcctgtgggtaaagtattgggttgccttgttttatatttacttgaggctattacagagaatcaactacagtgtaaagggagagcaaaaccaagcgagtttggatttagggacattaagtacgctttgaacagatcagaagccctggacagacgccaccacaaaagcagcagcatctggaagtacacgtgctcatctctttgtattgcttggtgtgatttccatggctactaaacgagtcattcacttcaacctacattgatgtgatcaaaatagtttcatcagagcaaattctcatcccctctgaagagtggacagattcttaaggattgtccacgtttgtattaacgaccctattgcttatgccgtcacaattacagctaaccagataggtgcagtcaatggattttgtcaatgatttaccttcaaagtaacaatactcacatacaagtagaagttaaaaggatttcaataaatttggtaattgactttttaactatacgtttgtgtcaggcatttatacttagcaaatcttatttatttcaatgtatttgattgttctgaaatcagtgacaggttaataactttgttatcagattactaaattaagcttttatcagatcatgtttacattaaaaaagaaaagcctgaagacattattaacttcatttcaacaagcttctgtaaataaataggctttcattaggaaaccagccctatttatcaaggttattaaaccattttgtaacaaaaagcatgatttacaaaaatgtcccatgattaggcttattttattttgatacgaccaggtttgctacacattttaacataaatcaagataaacagcttgttcagaaaaaataaagcttcagaaaaatgcaccttaatcactgttttgagttactgattaatgtttgtccctgaatctgctccagacagattttatgttttctttgatgactttcactggaatatggttggcttttatgattaaacccatccttatggtataatccttgactaggagttagacattgaaaaacacttaaaactatacatggtcaatttcttataattgatttttttcagtaaactcatggagaataacttttgtggtgattattagaatgttcaaaaacatatttctattgtgaaaacccagtgcttgctttctgagtctgcgggtctatccagcctgcccaagaactcgattcagctaaggttctcccttccattatggagcctggaaggttttatgcaaaaccagtgactgtgctccccgagaaagtccactgagtagcgtgctggacagaacctgaccaggactccatgctttcaagctctggttctaccgtctgttacttaggcaaatgttttcacctgactgtagggttgattaaggcttttggcttgccccaaaaacccctgtatttctggatgggaatcagttggaagtattttgctagggtcctgtctttgccattccatctagctctagtaatcttgatggctcttatctcttatgctctggatgaaaactggtaatacttctttctccatttgttttgtgtaagcatggtggtcggtaagatgatttctggtgaagcagcaaaaccacaggctcttgtttctaaatctggttaactgaatgccttctgtgttcacctgtcatcacaaaaggatgcgcaggagcactcattattttaatcggagtcgttcctaattctaaagttaatcatggcgattctcagatcagggagaaaattaattaagatgcaatgctattttcttctctcccagggtgacatctcccaggtttctcattaaatcgcccatttagtgtttggtttcagtgctttggagccaggcagaccagatgcaaaccccagctgcatgtgccatttgctccctgaggggcagagatgatggccttgctgccagtggcatctccagccctggaactgtgctgggtgcacacgaggagccaaatgcatgttttctgaggggagtaagtggaagaatgaatgaagtcagcccttccatctcttcttccttagctgtcaaataggatgacaaaatacctatttgccagtggttgttgtgaggattaaatcatagatgtaatgcatttagcacagtgaatgggcacatgagaagaattctataaatggcggttgttcatcttcctacaggaagggcagatctctgagtcatagaaattgcttcttatttcccactttcctttatttccttatgtggtgaagtataagttccactggtattcaacaagtaaaactcttgttcagggtaatgtgctactaacttttaagtctgcatattttaaaatgagagaaaatctagttttttcattaactttctactcatctctttctgggcccgctcagcaaatccccggtttcagaggactgccctgtaaggaactatagacagggtttccatccgtatttccattttctgaataagtaacaaggggaactagactctcagggcctcctctgcctgcttcgtccttatggagctgatgtggggagaacactcctcactgtccagtctagtgatgaccacagttctgtagccacgtggatctgtgtactcgaggtcagttagttccagaaaatcatccagtctaacatttgctcagattccctaatttctactctgtgaaagacaaggaatagtacagctcttcagtttcctgggggagtgcttcattacttttcctctttttctttctacttagtctaatgactcagattccagatggttctgcctaagtttagaattatcatgatctactttgtagagagaaaagaaaacatttcttgtacagtacaacttatgtaattttttttcagggaagtgagaaaaatataacacgcagtgtagaagaacttttggctctaacattagatatcaatgtttcgtattctgtcattggggtgtattgtaatttacttatttactgtctaattccttctgtagctagtgaagtttacattttcttttttctttttttttgagatggagtcttgctctatcgcccagactggagtgcagtagagccatctcggctcactgcaagctccgcctcccgggttcacgccattctcctgcctcagcctcccgagtagctgggactacaggtgcctgccacggcacctggctaattttttgtatttttagtagagacggggtttcactgtgttagccaggatggtctcgatctgtgaagtttacattttcaaagaatgttttaatgatatggaaaaatattctccaaacaatgatgtgcaagtacaaggtacaaaccaggaaagtgtaattctaattttttttttttaaaggtcaatatactttcttttttttttttttttttggaaaagaaatattcctaataattcatttaatcatctggagagtgggttgaagttttgtaaaatttaatttcttcattatagactgtattattttaataaaagcttttctttggtgtcacccattgtgtgcagcactgagctggggccctggagctctcactattgtccatctggccgcaccactgtcagcactgctttcaatgaactgtaacagaatactgatgactcagcatttctgctgctgacaggaagtccttgagcgagtctctttgtagttcctccaagaaaggatgctcaggcactccttgggtgaacagctgcaggccatggagaggacaaccgggttgcagtagtaagtttgcactgggctatcccagagctagaacaagggaacaggtcagcccctagagtcccagaggtcacagacttgggcaggtccaggcgttaaatgcagctgtgcctttggagctggacatccaggtacctggctgcctgctgggaacaggtgagtatgtatcagccattgtgaagcctcaaaaggctgcagcctgacgtagctgcagatcaggctgtacccaaattgcattgttactgatgaaataattttttaaaaaaccaatggtatctatttgagcattttcctcatggacaccattcaacagaatgctgttctcggggaacaaatgactcatgcaaatgactattttctaggtttttctcatggtcaagcagccatgatctttttatagctttattttattttaactcagtcccaatggttaatttaaatcctttctttctttcatcaatgatacaaagagctcactttactacagtctcatcttgacagagtcaaatgcagaggctgtaaggctgcccacctgaggaggaggaactggaacttaggaaaacagctcagatgcttcatgcaaatgaggaagctcaattggcttctattgaaaatacctcacgcatcattttctcttgtctctacttgccaaaatatttataaaatatctttgccctgccatacctaactaagcctcttggaatttattttttcagtgagattctctgatgcaataaccaagcactggcttttagaaagtgttctctccccctccctccctccctgcctgtctctctccctccctccctgcctgtctctctccctccctccctgcctatctctctccccctccctctctccctgcctctctccctccctccctgcctatctctctccttccctctctccctccctccctgcctatctctctctctccctccctgcctatctctctccctccctgcctatctctctccctccctatctctctccctccctccctgcctctctccctccctccctgcctgtctctctccctccctccctgcctgtctctctccctccctccctatctctctccctccctccccgcctgtctctctctcttcctccctgcctatctctttccctccctccctgcctgtctctctctttctctctctctctctctctctctctctctctctctatatatatatatatatatatatatatatatatatatatatatgtctgtttctctgtctcactctagatatacaatcaaatcagtgtgcagatggaggacaaagagtatcacaaaattattattgtaacttgtggataataaatttcaaaatctgatgtctgtgctccaatatctgacctccttttttgcaaaatatgcacatgtgaaacctgatttactactgaggaagttaaccctttccttttgaaagtaatgcatcagtagaagatggaaagttcagtggagatgggtgatcttctcaattatgtgcatgagaataagtaaactcccaggcattccgtcactctccaaagtcagaacaatcaagaggacacatcaggctttagaaaaactcattcccttggaagataatctcaatagcatgtgtgaataggaagagcatcaaagtgtgaccgagagagtgtcagagaagagtcacctattacaagcatgatcatagtacttaggaaaaagtaagttccaggcttatgtggatattcatatagatattttccagggttttagaggttcatgatttctcagggagaccaaagtgcctatgtgactgtgaggggttattagtcctctgggttctggctttactcagaaatagcctggaccacatgggtcagtcctgccccacagacattaggccccctcctggggcccctgcagagtgggtcagttctgcagatgtgggaagggatgagtgttgggtttgggaaccaaaggctgtgtgttgagcttacagtagacaatttggagctgcttcttgcttagagatgacccaatatccaaaagtagctattgcgggcaagtggtgttccccaaaaaggtatgttgaagtccttcctcacccccagtacctgtgagagcgatcttatttggaaacaggatctttacagatgtaatccagttaattgaggtcatactggagaaaagtgagccctaaatccaatgactggtattcttacatggagagagagatttggagacagatccatagaaagaacattgcgagacaatgcaggcagagatgggtgatgctgccataagccaaggactgccagcaaccaccagaagtgggaagaagtgaggaaggattcgctgctggagccttcacaggcaacccggccctgctgacaccttgatctcagacttctacacccccacgtagagtgtgagacaatagatttctgttgtttcaagccacccaattggttgcactttgttgcagcgctctagaaactgatacagtggctcaaacagagcctctaggtgtctcttcttttgcaatccaaagactgcaccagtgctacttgaaggggtaagagagctaaataaatttgcttttggggagatagatttgggtaagtttctccatgctgagttagatgagtgatatgtggtggtggtaaaatccagataacccttgagtgtgatgatttcagaaagagagagccaggaggcctgggagccagcaggccagcgggggtccgcccactggccccgaaacagcgaacagtgacattggagcaagggcccatcccgtgcttctctggagccccactgggcagagccaggtggagaagcaggaaactgcacattggtgggctggaggggcttggaggggctgagacaaggtgtgtgcttggggataagggcgttcctggtccccggtgaagcatcagtgaccaagaggcatcctctagaagaggtagacactacatgggaagggagaagcagcatgaaggaaggcgctttaggacaaggggatcagttacagtttcttcgccatgtgccttagacctacagcttgctattccactctgaaataaggcagagtgaagaattcaaaaacaatcactctgggagaaaaaagcgagttctcttgatatccttgctttctcctggcctcatttcctctgatgttcccctgccctcttgcaaatcaatcagcctaaatcaagggtgtctgtgcaggttctcaagacagacatgctgctgggagtggcacgtacgtgaacgtcaaggagatgtcagggcatgcgcatattctttggtgcccaccgtcttattttcttaacttactgggaaatctttttgttagagtgcacgcattaagtttcttcctggcctcatcagccccaaacccaggcagtggcgggcggtttcccgtgaggacagcgtaccttctgaagaaatgcacccagatcagaatggtatacgagtctgtcctattctcgctctagaaaagaaatgtcacaataaataggtgggtggggtctgccccacactccccaaaacaaccaaaacagcggcgagatcaaactgaggacaacgttatcatcatatattcttttctttacacagtttgatacctacctacttctcagaacaaacaccgcggaaaggaaactgggtggatacttactgtttttagtttgttacatactacaattagtcaccattagctaattatatagaaaaggggaaattggggctgttttacccagagttggttttaggtgggggtgaagcaggcagggtgatattggcagcctcatggttggttttgctgattcagttcctctttccttgccccctatttcatacaaaattcctctgacaaagcttcctgtgtggccactggtcagcattttaatagaatggaagggtgcagcacagcaaaggccatagtgttaatatccctcgcatctgccgttcccacctcctccttgcttttccagtcctttccaactctgcataggatgatggggagaggagggagctaggaagggtgagaggcaagcaaagtcatttccagcattttaaagtcagctctcccaaaatgctctctctctccatagccttctccctactggggcttcaaagccttccctctacctgaaaccactcagggtgcaaggaagcctcttcaggtccccctcatccttgatcattacaccagctcttgaggatcctttctttctctaaatttggcaacaatcttctgttgcagactcttttcactattggaattccctttcagggactgctctctacaacttatatggctgcagcagcagcttatctgaccatttaaggctctacactgtgcagacagaaaaggatcacactcctctctcagacacattataagaaattttatacaaggcctgtgcattttcaaaacacaggattgacctaatgagcaggaatttgagaccaggtaggaaaagagggtcatgggatgtggggagctgcctgggggctggtgggaacttgccaggggtcctcatatcccttcatgagacagttgcctaatcagcctatttcaagggatggccctgatttcacggtgaaaagcaaggcatgtttctgcagatacgtcagtgctctaacagcaacatgtcctctgctaggaggacatcctaggagattcgcttccattgaatcagagtaaactatttttttttttttttgcttcttggcagaatattatttgcagatatctgcaaatttggtaggaaagcttttttttctaaatggaactatcctgaaaacaaagggaaaaaagggcaaacacacacacactcacacacacaaacaaacacacacactcacatgcgagccttcccccaaatccttccaagtcttcattctatttaagctgttcataaataatatctgatgataatctcattgaaaatgcatctgtttttatgttaatttttgttaatttgacatccctagacgatatcatgaaaatatttactgtgtgtacgtttgtgtgtgtgtatgtgtgtgtgtgggtgcaattttgtccccttagtccatgatgaattaaaataagtagtttacctatagataactaaaattctatacatgtcttcatgaagtttaccttatttaaccgttgcaattaacacatatcccagaaaaatctttaaattttatttttaatattatcctaatgttgctgagttcccagcaacacaattatttattgcagccaacatctaccatgcttactattacagcaagctcttttccaagttcttatatcaataacacacaaggcagggcctgtgatatttcccatttgtggatggagaagcagagccgtggacaggtgccaagtcacccaggtctcaggggtggggtggggtctccccacagacagcctggctcagacacactctccactgccgcagcgcgagggacccttgtcatcatcccacagagtttgccttgtcattgcttctgaagtgcttagagactgtcaatgaaggagcaatctcaataaactttgtggttttgtcatcctcagaaatgaccaatcttcatgaaggtggtgttgtgcaagcctgggcttctattaaaataaaaaagtgtgctttgcacctaaggcaatggtgggattaaagcaagtagcaaattgatgttctcatttaaaagtcttgcctggtctgtgagtgccctgggcctgcaaaggtaaaagaagcctgaccacaaagcaactgggcattctggaggttactgggcagacctgagactccagagaaagtaggaagagaaggcagattgtcagttaatgatggcggtgttcgtttctgtttgtatacttttaacagtctaaaaatggggcttcggacacaatacctttcctaaatgaaaccagtgcctgcttcgttacaggcacaaggtatgtactgtgggtgacatccagcccccttcagttttccagagtctttcctggggtcttgcttggctcagggccactggaacacaacccacccgatgacaccagggtgtgtcgagcctgtggtcaaggttcacacgtctgtgtgtgccacaaccactgcagaggggaaagacatcatccacacaacatcccaccctcagcagggacttggaaaatcaggaacccgatagtccatagttggggagactgaaaggttccccaaacaagcaaggctgctccattttacctaacaataccatacctactggcacggtttctccctgtgccccattgctaacatttctccttcgagttggcatgccaaggaaagcacagtgaaaaatgtctgagttccgggttgctcttagcaacatccatgaatctgagtttctaacctccttccctatagaacagtgcctgaaggaagaactggcaatgctcactggtgtcagaattgcccacgatttttcccttttcagcaattatttaagtgctccaaaagcattgcttccttactgttttcaaggcaagatagaaggagaggttaatcttgcttagaatttcctctgctttcaagttccaggttgggggtataaagaggtttgatagaaaagaaccgcagcagcccaggcctggctgcaggagaaagcaaagtggctggggacagggggtgtggagagcaggtggtctcccgtctcctccatcagggtcaggaatgtgtctgctcctttactggaaccatcgccctccctggatggctgtaccgtttagggaggcctgtgctgacaatacaggtgcaattcaaaagaaattccattaaaataaagtgggcagtggggagaaacggggaattctgtcatgaaacataaaacctaaaatactgtctggtcaaaacctagacagcctgtgagacccatgagagctcggagaccctgctttcggagcataggtggggacccgaggggtggggccgtgagcagggtctcaggccagccgtggagaaggcggctgcctctgcggggatgggcaccgcagcgtggtgggcagatatgaggaaggcaaggactttcccattgaccatgcaaaaccttcacgaagtcagggtctgtccaccgtctaaagatcgagacctcatgttgagttctgaggtaaaatgggaaaacagttttaacagtgcagtgaagcttcctgccaataagcaaacctttccaccctccgctcagctacagaaacacatttgggagctccagggaggaggcggaggggcacaggcgctccccagtgtgggccacgctcaggtgtcccttcacaatggcagccacactgcttcgtgaaacggacacactacgggatggaaaacagtgagagggaagccacggcatcaagaagcaataatcacagaatgtttttgtgctgtccacgccttcctcaacatctgcctccacttccaagtcaatcgagacagcctgtttatgtggagctttgagatgacacatacactttactgaccctagaacaataccctttccacatctaaagcaattttcgtgtaaatgactgtgccattaaccttccagggtcattcaaatattttctgagaaattggctgctttcgggattttcttagaatgccatgtgtttcatttttgtgcagaacagatgacaggcgaggcattccaacaggacttcagttgatttaactaattcctgtcaggggaagtgaagtgttgggattcataaagccgatcccagcccggagattttccttttcccaaaacagaaaaaacaagacatgctgtgtggttttgcaaccgggcaagtttcgaaatatttttaagctttctactttgccaagtatttcataaaaaaactattttctttttgtttcgtgccaaaaaatgtcacccctaaatattttttcccatatctggtcacatgtccaggattttttcttttctaagaataaataatttttctgggttataaaaattccacttgctctatcagattaaacatatctttatatagaaaaagcatccgaaacattccccaagtgggtctaagggaggagtcttaatacaattttgttaaattaattttgattaaatattaggccttgaattctttttgtgactctcacaaagttcaggcttattttgttacactttcaagtctccctttttttcactctccacatactgtttccttttattagaaagcattcaagaagaattgattggtgtgtttgaccaaaataatatgttggaagtgataccagtgcaaggggaccctctgggttccattctctatttgcatagttagctggagttagaaggttcagctgtcagggattcaagaactctagcatcaaaaaagtgtgaacttgcaaatgagctgtcaaggttcatagcaagtgaataatgcagctgagagctgacttgtctccaccctggtgttctattgatcttgctgctggataaagcataggcacataggaacactgaaaaatagcaatttgtatgggttggactggtattttcttttttaccagttaaaatgttaattacattcacaaagtcaaaaagctgaataaatagtcttacagttggaaatatagggcaaaacaaaacacaggcttgaaaaagcaataatagctatacacctaaaatgtgaaaaatattcatagagaaatgaattgtagggcattaactcttgcaaaaccaccaaaggcctggtggaattaatatgctacagatttgaaacttaacattgggcaacttaaaatgcatgtatttgttattgatatttaactaatccttgtaagtaaatctactataagcgaaaagcattctaaattgatgttattgctagtttgcagggaaattctgaaagtctatgtgtttgttggtgcatgaggggatgtgcgtattgaggtgtgtgttcaggatgagggcttctggtcctttagaaatggttccctctaagcttcttggtttccaaatcttcatcactctttttaaaatctaaaaatgcaggtttactttatatggagagcacattgctatgaggagatgtgacatttcagaaagagcacatggcactgattctgaaatgctaccaagttgcttcagaatatacccaaattctctcaaagattaatgatacactaagaaactgaaggacacagcaaattattttgcttgtcttcaacccactgtcaccctgccacaaattgaacctaataaaatttccatccctctcccatcttatgatatgacccttccccctcatgcatggggaaattgttatttacattgtgaaaatatcaagcatctccaaacacttacgttttgtggagccgggtctcccatggtaaaatgagagcccaacacggtgagtttgcttcctaggaatggcaaatcagcatcgcgatgccctcaaaccagaaataatacccttcatttgctgcaactggttgagtatcagtgctataaaaaatagatgatggaaaaccggagcccttgacagaaatacaagtctgctgtgtgtggcttgtgcaggaatggagcagagagaagcggtggtcttgtctacacatcatacttgggcttcgcccatgctgacaagtggaagcacatgcacagtggacacacgctgtcaggacattcatccctgctggcacgtaaacggcagggagctaaactgctagaattcaagtggcacagaaacttgagcctatggaatatcactgtggagtgggcaggccaagttctttacagtgctctttgcttttgcaaagaggtaatttccaactcaagaatgctctgtggctttggcgtcaagaaagctgaaagtcagtgaaatagagccttgaaggtcatccaatctgcgctgcagcaggaagtgaattttgggagccccaaatgcaaaataggcagctcagcccaacattaactcagcccaacactaactcagcccaacattaactcagcccaatattaactcagcccaacactaactcagcccaacactaactcagcccaacattaactcagcccaacattaactcagcccaacactaactcagcccagcaccagctcagcccaacgctaactcagcccagcaccaactcagcccagcaccaactcagcccagcactaactcaacccagcactaactcagcccagcaccaactcagatcagcaccaactcgaaccagcactaactcggaccagcactaactcggaccagcactaactcaaaccagcaccaactcaaaccagcacaaactcagcccagcaccaactcagatcagcacgaactcaaaccagcactaactcggaccagcaccaactcaaaccagcaccaactcaaaccagcaccaactcagcctagcatgcactgattctctggcatagactcagactccaaaaatatgtcgagaaagtctaaccaaaatttgcaaaattaggacctgtggtcagtaccttgactaaatatgactctgtctatgaacacaagtaggcataatgtaacataagacagtaaagaggggcatcgttagaaacctttagcattatgtcagaaagggcaagaggactcaagtagaagaaaggcagagagaataacagagggacatgcatgaaaagtacttttttcttcttcagtcctgcaattgcattaggaacagaggtcaggcccaagagctgccctctcctcacttttctttctttcttttcttttttttttgtttttttttttttttttgagggggagtctcgctctgtcgcccaggctgaagtgcagtggcatgatctcggctcactgcaacctccacctcccaggttcaagagattctcctgcctcagtcaccggagctaatttttgtatttttagtacagatggagtttcaccatgttgaccaggctggtctcaaactcttgacctcaaatgcccgccttggcctcccaaagtgctgggattacaggcgtgagccaccgcacccggcctgtcctcactttttatcacatactcctgctcttgtggccctgcttgaacacagcaacagggtctacataaaataaattaaaatacatttaaaaaaaaattacctgctttacttctggtccatagcattggacatacccagccagaaatcatacactgggctggtttttgggagccaactcaaatgcttgtcctttgaggtaagtattagggtgctcgtggcctcccgccccacgggtccttcactcactgaccctgacctgtgctcactttgtctcaccacctacatttcccaacagttcatgtttgatacagctgctggtcctgccaaggctggaggccctccccatccgctgatttgcctttctctgaaatcggcatcttggctcctctgcattatttctgattggacttgtctctctggcttgttttctctgctaattctgatgaagacgataatctctagctctcaggggccagccctggctacacagtttgggggtagtgttcaaacaacccttgagaatcttatttttcaaggctgttggctggcactttagggctaaagcaagtggtgaattaaaacacaaaacaaaacaaagcaaaaaccacaggcctaaataaacatatgcacccaggagcatgactgtgcagacagactgcctggctttgaatctcattgccaccattgattggccacttaaccttgcatatcacaagatgggaataataaggcacctgcttcatagattgttcttttagtcttctatccgtttgttcattccttcagtaaatatccatcgagcacctactactgcccagacatacggatccagaaatgtccagcacagattaagaggccacagcctcgtggattttccattccagggcatttttcttcaaggatccaataagatatccccctaaactatacatcatagagcctttgacacagtaaacactcacatgccattagctgttatcacggtaacaataaaaataaacttttagcaaaggttttaactaaatgaggtgagaatcataaataaagatatatttgctatagtgaaaaggagagaaaatgtaggaaagtcaggcaagaggaatatttgccaaaatcattcatgaatctgacacattagattctgggcgtgtcctaagccttgacctgtgctacttgatgtgggatttgcacacctgggacacacgagcttctgaagttcagactgtctgcactctatctgacacactccacagctgcacaacttgcagcatgagtcagcaccatcctaacctctaaagagccccgcgggcacagcgaatgcacctcccagccctttggacgtggtggcgaccagctggtttcctggagaggcatctcctttacacccatctgtgaaagaaatctagatctaagccttagatctcaaggttagaaagggggtaaggttgaggttccggagtgctactctattagacacattgtcctttttaaattatatttttacaataatttccatttattattttttcgtggcatcctagtgaggcaggctagtttgacaacatgctgcttaggggaaatttgctgttaataagtcttttgagctcactaaattttggtgcagcatgaaaacccagactgttttcaactctctctctggcatacccgcttgattcctgatagggctattaattttgcgcagatttcccaatttgctccccatttgctacctgggatggtgaagaacagacaaatagcccttcggaagcaaaagcagtcccaaaccaggctgagtttcgtgatggcttcttccacattgtccttcattgctgaggatgaaaacatagagctaaaaactgtgatacacaatgatttatcacctcctttccatgtacacacctagtagtttagaactctgttagcttcaaaatctattcagtcacattgcattcccctccccaactcccacaaattctacatgaaagagggttcaggtagcaaatgagtggaaggacagggcaaactaagactctgatggtgagcccctcctcctcctgattcagatgatttcttcctcctcttcctcctcctcctcctcttctggttctttcttctccttcttcttcttattcctcttcctcctccttcttcctcttcttctatcttctttcctcctcctcctccttctattttctttcctcctcctcctcctctttctcctcctccttcttcttctccttctccttcttctattttctttcctcctcctcctctttctcctcctccttcttctccttctccttcttcttcctcccctcctcctcctcctgtccccctcacctttcccctttccctcctctcccatttccactttcttccccttcttcctccttctcccccttcctttcctcctcctcttccacttccccctttctcttctccccctcctcctccttttcctcttcttcctcctccttcccttctctctttttttgttatttgatctccaattttcacttcctaaaatttcatatggttggatgctattataattattcaattacacaatgattacatgtgggctggtggttttgaaacaatgtaccccattgtatgcattattgcattcatgtggaacttgaactgtaggaggtccatgcaggcttttccagggtccccaagagtactttgtgggttttggatccaggtttctgtttcactaaatcagcatattactctagtctacagtgtactgttgggctagaaatagtccattgactattttagactctgcatcacgaaacgagatctatggttttggttgaatttcatagaagaatattgataaattatcattgttcagatcattaatcttctttagctcaaatcaaacaatgaagtgatgttatcttgcaaaccatgcaggcaggtggtggcactaatgagcctgccacatcggattaatctttgaatgttcagaatctcagaatgagaactttccacaaattcaaaactgtttgatgaactgacaatgtccaagtccaccaaatggtccaacattcagagatgaaattatgtcatgacataagaagcctaatggaatgaatggccactatgcattaaagaccagaatgtgaaaacctggctcctaccattcagacttccctgaaattgtgaaacatgattttccccttcaccctagggaagaccctctggcaaaggcacattcactaagggtgagccttcttttggattgggggctcagaagagagagtcatattgaagtcgcccaaactgttctttgccctggctgcccgctgactttgttaggcagctggtgctaaggagagggtaaagaaaacagaagacacttgtgggccggctcagggatggacagtacctggccgctctccctgtgtgatgcaggtggcttgttctgaggtaggtgggcatacaggcagtgagtacatctccattgcagcgggggaaggtggatgtgggactaatcagggatggagagggagggatgctgcaaagatgcccgagcaggtgctgtcagtggggactagggaagcagtgtctctatccgagagtgcatgccggtggtaggggagcaccaacctgaacatggccagtaagaacacaaactagacctcccagattctcccgcaagtaaggagagatcagggactgttccaatttttggcgttcatattttttagacagttgtcttaaaaaaaatgcctgcttcacttgcgttaagaattaactaatcatggtccagacttatgctcaggtagacaaggaggactgaagccacagtgggctccttccaacctcacatcacatcttcctcatagcacctgtgcacccgaggtgcagatcctgatttgatggcgacctattacaaatttccttagactgcaagcaatcacactatacttaatagctatatttagtagaatacttagattaatacttggagagaatttaaatttaaatattatttccacagccaaaagacaaaacagcaatagacaaatgcattctctttttagttttcttcaacggatatatttcatttttaagcctatctaccccctcccccgatttgaagacatccctcgggctacgtggggaggaaagcctgtgtgactgatcgctgcagtgactgctcttggccatgactgttactgccattttggcctctctgaaaagtgaggcagcctaagcctcacagatatgtttcctggtcacatttttgttgtctctacagaaagagaagcaaacgatatcaccaaagtcctaactctatcctcccactctgtgaactacagaaaaggaagcagcagaagaaataatagagggaataacaaagtgacagaagcatagagggaaaagcagcaggtggcttttcatcaaggggcctttgggtaagatttacaggagacaatgttttctctgcgcctctgggacttgaaaggtcatggaaagaggactcactcgcgacagaattcaaacactcgtagttgtgtctcaaagtcctccgcggacatcaccagaaggcatggtttcaggggtgtttttcagaagggcgatggatttctttggatccacgtagtctctcttatctggttagagtttcttctttttctttttgttcttttttgacacagagtctcactctgtcgcccaggctgcagggcagtggcaccatcttggctcgctgcaacctccgcgtcctgggttcaagcaattctcctgcctcagcctcccgagtagctgggactagaggtgtgcaccaccatgcctggctaatttttgtatttttagtagagacagagtttcaccatgttggccaggctggttctcgaacttctgacctcaagtggtcctcctgcctcggcttcccagagtgctgggattacaggtgtgggccaccgcgcccggccttatctggttagagtttcttaggtgggaatggagttagcagtcccagaccaggccaagttaggacaagctgagaaatgcatcctgtggttgacacatggtgaggaatacccaagcaaaatactcttgtgtgaggcttagactctgtaagaatctaccactttatgaagagactttcttctcccatctaccagattttccaccaaatttgttgcagccttgttatgggctgaattgtgccctcttaaattcatgtatcgaaggactggccccctaggacctcagaatgtgcctgtgccctgtatttgaagacagggactttaaagaggggaaaagttaaactgaagtcattagggtgggccttaatccaatctagctggtgtccttaagaagagtgccgggcgcagtggctcacgcctatgatgccactgcactccagcctgggcaacagtgtgagacttgtctcgaaacaaaaaaggaggaaatttggacacacaaaaaagacaccagacaccagggatgcattcatagaggaaaggccatatgagatcacagcaagaaggtggccgtcggcaagacaaggaggaaggcttcagaagaaaccagacctgctctcaccttgatcttggacctcgagcctggagaactttgagaaataaatttctgccatcaaagccaccagtctgtggtactttgttatggaagcccaagcagactaatacaacctgcaggctttaaacgatgaacaagggatgtgactttattgtaggaccagtaatttgaatttcttgcaaacgcttgagtgtaagcattagtcaatagtcagtgatctgactggaaagaagcagagggcacaagttcatggcagtgtgctcaggggtacctggcccctctgtgaagagccccatagaagacaaggcacttgggccctgtctcaggggcagcacaagcttccaggacaccaccgtcactggtcacttgctgctccccactgtggccctggacagatgagtcaggcccatggtggtcagggcagtggtttctcctcgtcctcccccagcctgcactactccgtgcctggagctgtgaaaaattggcctttgctcgggcgcggtggctcacacctgtaatcccagcactttgggaggtcgaagtgggcacatcaggagctcgagaccagcctggccaacatggtgaaaccccgtctctaccgaaaatacaaaaaattagccgggcacggtggagggcgccggtaatcccagctacttgggaggctgaggcaggagaatcacttgaacccaggaggcggaggttgcagtgagctgagaccgtaacactgcactctagcctgggtaacagagtgagactcagtttcaaaaaaaaaacaaggtctttgctgcttccacagatgctcacatttctccctggctcattttaagctgtgctaaaatctggtaacaaagcttgcttttatttaaggtacattttgtaagttttcgggtggcccactgtaaggtagagagccctgctcttggtgacttgctttggaactagaaaattagcatctagctgtaccatatctgggcacatgactggggcttcatcaggtagggctgggctttcatgaagtaagttgcagctcagggcctcggcgtgcgaggagtgcagttgctgtgtgtgactggctctgtcaccaggagccccgcgtattcttcagggagaattttcaatcatgctggttttgatttaggcaatatggtcttgaaaatattttcatagtctagtctccatcaatcttattcttccacactgacatctgcttccagaatttggagtaaggcgagctgggaagtagggctctgaaatcttgaaggactgcctaagcccccccaccacacagaagcaaaagcagcctccacaggatgccagcttagcaagggaggcctcacgagcaattttaaggacctcagcactgatgacgagagatggtgtgttacggattttgcatctgcagttttgccattagtggcattttaggaataaataaggttgatatgttaactacctcaaaataattttcccattcaattagattttgttagtgaactcactcatcagtttggatagttcaagtagtatactgaaaaatgatagctaaacctggcttatgattagagctggtttacattttgccttcggcaagtggaggatttccctaggctgtttctggagcctcatttattgatgagcttctgtgccctactccaagaagcacctttccacctgagaatgaggggccccatttacaatattcttggatgaggacctggggaagaatgcaggagagccccaagctaagatggtattcaaactcagagcacggcagaaagttcccaaaaagatgttagaagtatggctcggcttgctgctgttttggcttttaaaaaaagattatagcaagaaccttttagggaactccacagccaccagtagggatcggcaggcacattgccccagctaaccactggagtggtgttcagggagggtttgggatgtggatgctgctccaagccatctgggagggagacaggtgcagggacagtcagcatgaaagcaactggggactgggattgccatagctcaacagcctgatgatggcctgaggttgttgccaagagcagctcctaggaactgctccttctctgagccaccctctgggaacagcagagctgtcagagaagatttaattgttttgatcttcctgccttcttgatatcccattgagagtcacccttcagggagaaggagatagagtcgtcattttgtattaagcaatgacaagaaagaaaaaaaacttttaagatgaaatcctgatgggattgaaaatcaattaatcaatcacacagacctctgattcctggtcattctggctcagaattacagacataagtgtgtgacactgtgttaccttagggtatatggacttttagaccagtagaattttatggagagaagaaacagtaaagatacattagttcaatgtatgcattagtgtttaaggtaataattttggtgcaaaagcagaatgggccagatagactagtttgccaggagtttatggatctaatgaaatagtttcagttgctcatttagagaaaacaaatgcagaaatagagaccacagctcttaatgcaaccaaagagagaaaatgcatgctgactaaacgtccacccattaggctccttattaacagaaatgagaagttattctttggggactgttgctctcctgctgctctgtcatggggctatggcttcattttccatctataaacaccaaacactggaaggttggttgctaagagaactcactggggaaacagttaactgttcaaatgtccccacttacgtggatatgtgcaaataccaccctctgttcagatctgcatgttgcagaaagacactacgtgcagtggactaaagctggacgccggagtgtcccacagacccaggttagcacccctgccctgccactcactagacatgtaactcacagcaagttcttaagaactctttcgaaactattcctcatgggcaaaaagaaaaggatggcaaagcatgattttttaagtgttcactgtgtataccaattatgaacaaattgtaaaatcctgcttcatttcatcaccatcaaaccataggcttaaatttgctcataatcccgacaacactgtgtgtttggaaacagtggaaacaggaagaactgagagcgggtctgcattcaggatccacgtggctccaatcataggtgtgaaaagactcacatattccgtagcatcataggacccatcagagtataacagctaagattattacacatgctgttccagtgtcccactcacactgcaccacagaaagctctgcagtggatcaattgctgctgtgcagtccccaacatccgatccttgctgaagtttattgattaagctggctaatacactccttacacagttatttggtaccatattgaaaatacattaattctaaaataacaaacaaacaataactttcaacctctattgctagtttgagaataaaatgctccctttggtgcagtgagtagtgctcatgagtgacagacaatttgaataagaaaactgggctcttgatttagatttttggctgtcaattacatttggaaagttgggggtaaggtacaagctgcttaggaacccttatttcttccccctgcccttttgatatcatttctctctcttctccttgaccttaggtgggtcaaggagttggaattcaaatcacatgagcaaatagcattcaaatgtacatgatatataaggcactttagcgatccaaaaaaaatttacaatatagtttctgtctcaaaaagtttattgccttgtttggggagacaaaacataccacacgaaaagttcatgatacaggatttaaacaagggctcaacaaatcatagaggaattgttatataacatgggttcttccattaaatggtaaaggaatgctcttagctctaaatactaaaaaaaaaaaaaaaaaaagagaaagagagagaaattcaggaactgtccaggtaggattgaggtaaaggacagggacgaaatgaactttttgagaagcatgtaggtggctaagtcagtttggatgttaggaactacactgagaatcaagagatgaggaagaccaagggcaaaccgaaacgagacaggctgagacaaagcgagatgagacaaagtgagaagagatgagacaaagcaagatgacagaagtttggtgatcatcttggacattttgctaaattaggtgaaaaaggagcaagaaacaggtatccttaggcaaaggcaacctctgaccaagcttgatgagggcagatgaggactgattctagcatgagagggaggtgcaggagaggcagctgcccagtaggtcctcagaagatggtgaaggcaccactccaaagagtgtagatacatactgaccacaacagagacagaatgtgtgtgtgtgcacacgtacacatgaacgaaagaggctagggcatcagaggggagaggaaatacagggagaagggaagtcaaggaaagatgcctgacattccacaggagaagcttctgcacaggagcagtggggataacaactccaagatgcactggagaggggtttttgctagagagtcagcatcgcaaacaagcagagtacctttgcattaaggtgcgatttaaaaatatgttattatctaggatagtggtgctcaaccatggcgattttgctccccagggaacatttgacaactgggagacagttttggttgccacagctggcagtggggatgggggtgctaactgccatcgtgtgggtagaggacagagacgctgctgaacacccagcagcacgcaagaagatcccacaacctggctccagatgtcaatggcaccaaggctgagaaaccaaatttagaggatcccagggaaaacagaaaagtatcttaaaaataaacattacccagtattgtacagttgacaaatgttaacattatgcatttattaaaaacaaatgtaagcaacatttattactgtagttagaattttaaaatatgtacatatactgcagcagacttttatttatttatttatttacttatatgagacagagtctcgctctgtcgcccaggctggagtgcagtggcacgatcttggctcactgcaagctccgcctcccgggttcgcgccattctcctgcctcagcctcccgagtagcttggactacaggcgcccgccaccacacccagctaattttttgtattttttagtagatatggggtttcaccgtgttggccaggatggtctcgatctcctgaccttgtgatctgcccgcctcggcctcccaaagtgctgggattacaggcgtgagccaccgtgcccagccctgcagcagacttttaaaaagatatattcagcttcatcacccttttcttaaaaaactgaaattacttctgtcaaaatcatgccgatggaaagcaatgacatgctaagcacagtcctttacagaaataattcagatagaataagtggaaaataaccttaaagaagattgaaagaagcgacaacttaatgaaacccagctactggttccattttctatttatccttccaaattgctaatgaattctgacccatttagtcatgcaaaatatatatcctgaagaatctgtatcccttttgaggtacttaatggatgtttagccggcaaggaaatatggcatgcctattattcacaatagttgatctttaaattgacattaatatgccacacttagagtactggggaaattctagccaaatatacaaagccgctgctactaagatgaaagacattccacaaggaggaaactgatctcagaaccagtgaccacggccatgagggcttcgtggctgctacagcacgttagccataaacaatttccatctgaggaagtgcattcagtgcagctgctgatgcatagtaaatatttgatcctaattggacctaatgatgaatttcaattctgtattcaccattcttttataggacaccaacccataaacacaaaaaataaaaaaggttttggggaacatttttcatttccttaagtcatttaataatgatgaattgcctgggaggctctttgaaaagatagatgcggctagaaagttactgggagaattagaaattgcataaggattcaatgcaaaatactttgtaaaaagaaattttaacttccttgtttaacttattttaattcattgagaaattaaaggtaaaatatactttataaaaatataatctggcaaactttaatttgggtaccaatttggaattcgattaaacaggttcaagtctatttttatagattataaaaatgctcctttcagataaagtaaaaaagataattttgttttgggagttaaaagaatcaatgtctgtgcatcctttagtctcaatagaataactcttattctatcagtaggcagaaatgtttaagcagcactgtccaaaagacatacatgtaatttaaatgcttttaaatggaatagaaaagtgaaattctctggtgttttttcttgtattctttcaaaatcatagcaccaatggatgtgagtttctaacattattcacctatctttttaaaaatttacccctgaatgcttatacactgctggtggagatgtaaattaggtcaaccattgtggaaagcatttggtgatttctgatagaacttaaaacagaactatcattgacccagtaatcccattattgggtctatacctaaaggaatataaatcattttatcataaagacacatgcacgcatatattcattgcagcatcattcacaatagcaaagacatggaatcaacataaatgctcatcaatggtagacttgataaagaagatatggtatatacacaccatggaataccatgcagccataaaaaaggacaagatgatgtcctttgcagcaacatggatggagctagaggtcattttctaagcaaactaacacaggagaagaaaaccaaattctacatgttctcaagtataagtgggagctaaacattgagtacatatggacacaaagaagggaataacaaacaccacagcctacttgagggtggaaggtgggaggaggtgagggttgaaaaactacctatcaagtactatgcttattacctgggtcatgaaataatctgcacacaaaccccccataacacacagtaacccccgtaacatgctatcaatctatctatataacaaacctgcacatgtacccctgaacttaaaataaaagttaaaagaataataaaaacagaaagtttacccttgataacacgttttatgtataatcactaaatctactaaggcacatttgcatattatattatagagtctgctagctctacagtttttccaactgtgtacagtcggccaactaccataacccacatcttccaaatcctagtggcttaacaatggaaaatggaatatccagtgcagctcagtggagtgtggggtggggggctgtgttccaaacagccatttagaaatgatgctccttgcagctattactccaccataccatggggtctcacagtccttcacatcccctgagtccagctgttagctgagaggagcgagaatgtacaggatcaggtatgggtttcatgaggcagacctggaagggcaatacatcacttctacgagccagaaattgtcacacgattccttccaactgcagaggaggctggggaatgtaatctacctgtgtgcccaggaggaagggaaatgggctttgtgaaaatgtgcagcattatctctgacaaactggcaggaaaaaacccactaatgtcatatctttatatacctgagagatgtatcatcaatgaccaattctctgcccttggcagaatgccgattggaaatatagctttggacagggccaatattaggctacgtcaagatgaccagcatgtgtcctggcaagctgacaacagactctgtcaaacagtcagcatggccagattaccctcctggtcttccaggcaatcatgctcctcttcccactttgggactgacacctttgcttcccatcgcaagcacagccaattcactgaaaagagttgactagtgtcacttgcattttcatctgaataagggaagagtcactgtcacttggaatgtgaccatagactccactatccttagactacatcaaaattatgctcctttaaactatttggaggtaaaagacacaagaaaataataggcaccagaagcatacacaaatgtgagatgtttggcatggaagacagttttctactcataaaatacacaacttgaaagttggtataaatatcagatcctgaatcctgccagccacatttttactggcaggcatagcaggagacagcacaatgaaaattctcatagaggttggaagtagcaacaagtcttgaaaactcatttgactatcaaggagggctagaccacacattaactcagaccacaaaggctaaaggtctcacttagactctcttatcactcagcatttagaaccagaagaataatcacattcattctttcaagactttccctttaactatacataagaaaggaaatgtctttacattcctcatatctcacttggcataaaatctaatgtttgttcatctcacttatcttaatcccatacctcctcatgtttattagaagaaaaaaatgtaactctgcatgtcagaaaacagatctgaagtaaatatcagttaaaatgcaaaacaaaaagcaaaagaggtctcagatttttacaaatgttgttttatagaaaccataaaattgaggtaacttgatttaaaacaagtgaagacatccaagaattttcatagtatgcaagtgatctggactggtggttggcagcattgacattaaatcagctgaattttcattgacagctcattagaaagatgttccaagaaaatcgaatacaagatgctcaacagaagctcttctctatgcagttcataactgttattttatgtccttacaagtcatgactcatattagaacacgtaactctgtaaaatttaaagatttttataaatcgcatgaaaaatttccccttagtatagctataattttgctgtttatgtcacatggatttttaattacattttccaaacacgaaggcagtcaatttgataaggagaatatttcacaaaattcactcttctgttctaggatcttggttctaggtaactcattctccagaaagaaatcatatcagtcagttcacaaaagaaaaaaatatttaagccacctaaaaactcaagtactattcattgttaattttgtctggatctttacattaccttaactatatggtcagtctataaaaatgtatctgtacatatgcttacaggtaatatgtaatataagtaacatccagggatggatcctgaagcgggcttccatttttttttggcatttgtattttaatgaaggttaataaaagccaaattacagccaactgttaaagctttttttttttttttttttaattctatggtataacaaaatcagttccaggtttttttctgaacaaatgatcctttggtctttcccgtggcatgctcctaaaacaactaaaacaaccctctacgtctaatcagtcacctaagatatcgagtggcaagtctttcacatttgctgcttataattcctgaatggtccatattgagtattttcatttctgggtaagggaaaaagcattttggtccattaattcacccgctcgctcctggaggacgttaaccaattctgctatcacaaagacgtgagtggcatcaatgtcttgcatgatgaacttcgcaggcttccatttttgttcactttgggatggttttcctgtcgaactgcgtggaaaagcaggaagcacactgtccactgtaggggttcctggtccagcagaagactttcagatattgtcaagtttagtccacttctttggatctcagtggcttttattctgacataagatatttagatgttgcaagcccctccaaggaacactattttataaacagaaacatccagttgtgtggccatttcataattagcttctgaaatggacaggaaatgcacctatgtgaaggaggcagagcagggcaaatgcctttactgcttttcaaattttgatttccgggtaggaaacacaactaaacctcctatcaatttttagtctttacctgtacatttctaacttttagagatttctgttaatgttcctttttcttgttaactttgtatttgatattcaagaaacgttagaaatgaatgcctgtataacataatttcaagatattaaaatagcatttatcattaaggccacttgctttataccaacatcacaattccattttaagagttattccatgtcctgggaaattaaatcactgtctcaactccttccaggtgacataagaagacatggaggcatgatggtctagcagagagaagcctaggtggtatggattgttccatgttgtggaacatattacagagacaagggtatacattagttcagcaatttcgagttcttaaaacatctgctttctctccagctagatctatacaactggatggagaagatcaggcttaggtgttctgtaaaatttaaaaatgagacccctaatggcagctttcctattttactcatatttttggaatattttcaagcaattgctgatacaatctggtgagccactgatggaattgagtgtaagaaatggaaactgctatggattgttaacatagagactgatgaccagattacaggtgcatatattttgtttatctagagttgtgtggaggctgctgttcagagcattgctgacaccagggcatgaaactagtgacacagttaatgaggctggtgatgaagaaactctcgggtcctaaccgataatttcacatacctagtaaatcagcattatttcatttgagttacacttgactttttaaaattaaatatcatgcgaaagactttccagaattacagcattccaccaaattgctctagccaggaccccattgaggtccatattgtaaaattatcaggttatatctaagccatcatctttcttgattgcacctccccctctgacatagtttcttctcttggctgtcagcacactgtgcccgcttgccttcctcctatctccctgggcatgccttctcagtttcattgatagggttctcctcctcctcctggcctctcaatcttggaggtttttagccttgaagtttcttagcctttttgtcctctttctgcactcactgcctcattcagtctcaaggctttaaacaccatggagacccagccatctcttgccgtctcctccatttccacccattccaggcaccttccttcctcacctggccgttgcaatagcttcctaattagtctccagcttccaccttccccttcttaccacctactcccttcagtgcaaaagcctcaacctctggcactcaccctttctttctcttggttgcagctatcctggcctccttgctgtgcctcatactggaaggccactcacactttagggcatttgcagaggcagtgccttctgcccccagatgggtaaccctatgggcaacccccttcaacttccttgctcaacatttgaaactccaagctgcactgtcctcaacacattctccagatcctctttaccctgctatgttttgagccccttttactctcttacctactgtataatctcctaacatgtttaccttttactgtgtgttctgcccatgggaatttaagctctgtgggggcagggatttttaccaaggttgttcactgatgtgtctcaagcgctcagaacagtcctttgcctttggacagtgctcggatttgcatgagtgaatgactgtgctctctccagagtgatgaggatgtcaggattgctaggtttagaaatgaagcacatcctatagtatgacagagcctgcagaggagataacagcttctcgcttaaagatatggagtaggcgttaaaaatgatttctgcccaatgtaagaggaggattttccaattaccaaccagaaggagttgcttgctcttgcctcagtgattctcacaataccatatgctatcaagttccattgccctctttgtacatgtgagggtaaggtgctccattggatgtatcttgaaacagaacagagtttgtgtatgtgaggggggtgtgtacctttttctaaggattgagctggatgacaaaggatattgcatatttaacgggtagggagaacgcaggtgcaacaattcacaaaaatctcataatagtgaatgatggtgaatgaatagagaagacctaagaaatctctcaaacgggtgagttctctaggaattgaaagggttttttttttttctgttacagttttaaaagaatgtggaaatggaataatttgatgatattaagctgtggttttgatgaatgctctaagaatcatccccagtgataaatattcaaagataaatggtgatgttttagatagaagtcaatcgttattctattgcctgtaacagggttccttagttataattctgttagttgctctcatggtcttatgttactaatatagtcattatttcaaagcttatcacattctgtaaaatcctgtagtcattagcaataatctaagccaacgttagcaatccattaaggttagacatttaacttctataaaatactctatgccacagcactttcatattcctatggggcaaatttccatcgtagactccacgttggctccttgaaatggtgtgtactcaaggatagcccagcttaggggactccaaatgccatttcaattttaactttatacaacagattctcgttctccatccatgcttagacttcccagctctcaggttcaactctcagatcaggaacaaccatatgtactatgttttgtttccatcgaattggcagtgactcattatttaattactctccatgtgttggccaaatatgaggaaagaatactctgaaaaattaacaaaatgtggctggcattacagccatgcagtgcctcatgcctgtaatccctgcactttgggaggctgaggcaggtggatcacctgaggtcagaagttcaagaccagcctggtcaacatggtgaaaccccatctctactaaatatacaaaaaattagctgagtgtggtggtgggcacctgtaataccagcttctcaggagactgaggcaggagaaccacttgaacctgggaggcggagattgcagtgagctgagatcgcgccattgcgctccagcctgggcaacaagagtgaaactttgtctcaaaaaaaaaaattaacaaaatgcatctgtataggcatcctatgtctgcataatgcgtctacacaggctttgggatgcagcagcattggatagaacaatactgatccctggcaaagatacaccacaaaaaagctcggctgcctttcacaaatacgagttcatgaacacgtccaggaagataaaagtgtgcagtgcattaaaaacacatttccttctcattagttgcatgaggatataaaaattaaatcaaatctgctttgttgccaatttcaagaatgtgactgaggacaaggagcagaagaaagcagtgtcaccaatcctactcggaataatctgtcaccatgttagcagagcagaaaacatttcattttaaatgattgctatttcagttacataataaaagttaatagatacaaccccaaacataagatttaattcattcagacacacatatacttgtgttagtctatgaaggaaatatatcttttatgtcaaaattatgtacttctttgaaatgtagttcaaagtgaagaagaaaactttaaacattttccttcacttttaactccttccatgccccaaagcaaacacctgaacatatgttaaaatacttgaattcatagctgccatcagtaatgtctttattcattcagagattttacttcaatatccctctgttagactttttcctgaatgttgatcttgaaaatctgtaccgaaagcttaagtttttctccaaagtcacattcaacttccatagatcatatcagaataatactcctttgatatttacatagaagcaaatacaacaatatctctataatccatggataatgtatatatgctactatagatagctctcattctgaagatatttttcccaaggcacaaaggccatcacataaattcacctgcatttttagagtggatgttcagggcgatgtcattggagaaaggctatgctcccagtgactgtcacggacaagtacagagtcttgagtaggctctcaacaaatgattgttgtgcttattaattgaagaagaatgatcttatatgtgaatcagaaaggaaggaaattaggagtaagtgacaacgaagcaagtgatttgtgaacattgtgtccgaaagagaatctgaggaaaagggtgttttgaggttagtagcagggctgacattgaatctgagttccatgcccagcagtgagccacaccctttccttactaaggaatctggaaatgttgccagccctgccttttatctttgaaaacacagggctatttatgtctaaacacaatgcactgaatttaccttcattggttgacacagttatctttcctgatcctcaaaacctcaacagacagcaaagtgcacaacttgctatgtaatagaagtttggtagatgggaagtctacatgcaaagctgatttattttggcaagataactcagccgcaaggggttacacggaaggcagagagaatggatgtaaagtgtagtcaggatactactgagaaatcctagtcaaggatgttgcaatagcctgtgaactaggaaaggagtgatattgaagacgtgtatgtaagtagaatcaatgagtagggactaagttggtatgaagaaaaattcgaatgcttgtctaagattctaattctcagtaactgggtggcaccatcgtcaagatccagccctgggaaggaagagcagggtgggagttggaaagtgagttttagacgcattgaatttgaggtactcagaagacattcaaagggaatgttcaccagcttcttggaaatgtgagtctggaactttcacaagagatcagggatagagattagggattatcgtgaaggaagaaacaggtgaactcagggaagattacagagatttagacgagagggacagaacccaagggagtaactttaaggttgggcaaaaaaaaaaaagggcacctgtaagtggaattcagaagatgtaatcagagagactgaaggtaaatcagaagcttccagtgtcacagaaggcaaaggggaacagatttcatgaagatgcgagagtcagcagcatgtaatgccagtaatctaaaagacttgtctccacatttgtttccaataccgctttatgttaattatgtaatatctggtttctcagctttagtaacaatgacatgagaaaattcaaaattattttttgtgtcatttctctcagtgtgtttattattatttaaatatatttatatgctttcatgaactttacttatgaacgagttaagaacatggcatcccaaaatacaccactctggcatattcagtatttttagttaaaggcacttaagaaaaaccaggtgaggtcgggcgtggtggcttatgcctgtaatcccagcactttgggaggctgaagcgggtggatcacctgaggtcaggagttcgagaccagcctggccaacatggtgaaatcccatctctactaaaaatacaaaaattagctgggtgtggtggcaggtgcctgtaatcccagctattcaggaggctgaggcaggagaatcacttgaacccgggaggcggaggttgcagtgagccgagattgcgccactgcactccagcctgggtgacagagagagactctctcaaaaacaaaaacaaaaacaaaaacaaaaagcaggtacaagaagatcactctgaccttccttctgtttctgaaaagcaggagatgacattcccatgtgaaaggtgtcctcccttggccaggtgggaggcatgattcctatgggcaaggaccagaagctgaggctgagggaaacctgtaccacctgctatactggcccttccttcccagccattctcctccaatcacctgccctggcccaagcccccgaccccccacctcatcacatttctgcaatttactgctctttgtctaattccttatataagtggtcaatacaaactgcatctttgggtcttcacaaattctgaaggttttcatgccacataaacttatattaaataaatgtatatgtttttctcctgtggatctgtcttatgtcaatttaattctcaggcacaacacccacgtgccccatcccctaacaaatcctaacagaggagaggtataattttgccttccttacacctagaaacatagaaaccatcttttctttgaatttaatgatttaaaattataaagacttttggcttgcactgaattttcagattacatgtgaaattacttgtaaagaaaaattattcaatattatccattttgtcaaaactcttaaaaagatagtgatgtctaccagctttcgcattttagcataattggaatgagtctatggataaaacaaatagaaaaaattggaataaaaatcctcaaaattaagcactggttcctgccaaatggtaatgaaaagtcactagctttttccaataacattaaggaagtataaatattattaaggaaaagctgtgtgtatataagcttttctgaataaattaaattacacgaaatatataagctacagaatgaagtctttatattaaaaacaggtagtcctattttgcctggtatcgtgtcaacaggaaactcaagcatatccagccatatcactgctctccatagtcctgtagcaactgagaggactgcttgtctgttttactcacttttcatacatttattacataaattctcttaaaacagaaatcctttcttctcaacctgttgacccaaaaccagtgttaaagaggttaagataatgtatacactgctagattcaaagcccattataaattttcataaaacataatgacaaactatttgataacttaaagagtaaatatcagatttataacaatgccatacaaaaagatacacactacaaaaaccatcttgaatgtaagtttacaaaagatgtttgtctgctaaggaactaaattcattttctctttgaattcaccatttatagaagttttgagccctagaccaaaaatatggaagtataggccaaacattatactatctgtgataaattttcagaaaatttgggctgctttaagtaatgtatttatgttttacatagttcctcaatgttagcagctgtgaaagatatttacaatttacttcctatgtagaatttatcttaaatttaagaaatagcaaatagagggaaagatgttttaatgcaggtctttattgagtcgttcaaatgatgaagagaataatataacaaatgtccatgtacccatcatttatcttaaaatagaagatactaattcaattaaagcctgctgcacatgtctctaattggaagtgccttcctacctccagaggtaaccattatctgaatgtaatatttatcagtccatatatttctttacattatgatgatgtaggtttttaatgaatactctttttaaggttaaagtaattccttcctttgtctggttgtgagtttttatcttgaaagcctgtgttgggtttcatcagtttttttttctgcactgattcagactgatctacagtcagaatgtaaagttttaaaccacaaaactcatatgattcatatatggtggtgaaatgccttcaataaataaatgaagcaatatgaaaagaccctcatgaaaatattttattcaatgaaaatgaaattgctttaggcattaaaagtagttatctatggtcacctaaaacactatttggttttactagtgaattcctcatttccttcctttctgatttatatgttagataattcttaaattaataagcacagctgagggttaaacataccaaatagtcttctgccaaatgtttttacacctgtggttttaagtattttagaatattgattagaaaaattatacatgtgaacataaaaaattatgatgtggacacaaatgatttttaacatcaaacgttttttaattttgatatccaaaatacataaaaaattgtaaggggataaaaatctcactgcaatcaagctttctcacctttgcataaaaattatcactttgatttcagacaagtttttacaagctgtggttattaagaggtggatctcaccatgtgagacaaaaaaacacgtgtgtgccaattctaaattaatttccaaatatgaaatacatccgttaattcttaaagatgctcaaacacaaaataaaatatattttgaatgtagacaagtaggcatcatcaatttttttaccacagaaaaaggtagtattttattactttttccacataaaagtctacctctgaatttaccttttcactcggcttttcatttttacttgtttttttagttttccatcataagccagtcttctattatatcaatacaaactttataaacttgtttacacttaatttttgtcttattctgccttgaataaaaatagtcatagtggatataaaaagaaaattctaatgatttaatttgatgtcagaaatacaatttttaaagaaaacatcgaatttctgctgctaagagatgtcactctgtaagttttctccaaaagggagtgttttactgccctttacaaacagagggaaaaaccattttctacttcagaatgaggcgtggatcccttagtctgacatctgacatccttcttgaatttgcactgaacctccatctttatctccaacaattcctggctgagtcccttcactatgggcctactcatagatgtgcacagaaatgaaccatctggtgtgccaggccacaccttccaacacttggctctgctgggaccacaaggatgggctttctcatctcaccgtacatttagatggccatattgggtttcggatagtctcccattcttaaccatggtcttcaacagtttttgttttaaaagtgaatactcttatggtaaaaaagataaatgtgaaatagaaaatactgtagatctacagatcaaagttatatttgaaaaccacatttaattgtatattcacatatttttgtaattcacaaaaaatatacccatctgtaacttttcaacattcttgagtgttttgaaaattaacaatttgttctaaaacttgagagttacatagttttgaaatatttcaaagttcagttcaaacacacacaaaactcctggataccacctggagctaaattcaataccaatcgaattttttaggtttgcaaaattgaactaaagaagtaccactgagttgagggcatgtcaagatctagcattaaaccaattcagatttgtacttggaccagcatattccaggggtcacagtagccaacatgcaatgccttaaaaatacatgctgtacgtgtgtttttctattaagctaaattcaatctctttttttttcaggcataaatttatttgagaacaagagaataatgtttctattctatcctttctaatatcaagctggtctttaaaattttttttaaactgtgtcaatttcctaactcgattcttttcggtatgccgacaggttatttcaaccagcctcgtcctaacatttggctcattatactattggcacattcatgtctttctctgtaatcttcacctcccgtgcttgtttttctctcagtgaagtacagaaagccaaaacttaggatttgaaatgtcgtcttcactgcctggaccaatggttttcttgttttattgaaaatgaaagagctggccgggcgcggtggctcaggcctgtaatcccagcactttgggaggccgaggcgggcggatcacgaggtcaggagatcgagaccagcctggctaacacacggtgaaaccccgtctctactaaaaatacaaaaaattagccgggcgtggtggcgggcgcctgtagttccagttactcgggaggctgaggcaggggaatggcgtgaacccgggaggcggagcttgcagtgagccgagatcgcgcccctgcactccagcctgggcgacagagtgagactctgtctcaaaaaaaaaaaaaaaaaaaagagaaagaaaatgaaagagctatgcatttggtgaaataataaaaacacaacctttcatctctgataatactgagcattaaataaaattataggtgcaattattttacaggtaagttttactttctaggacaaagtctagatacacagggcagtactgactgccccgaggcctcggtctctgcaccaattggtctcatcttatttcaagtgctctcgtctttgtcctcctcttctcagttacatctgtgtaacagggtctgtccagcgtttcatttctctaatcaccttgaacattgctcagcagtattactaacacatgagcctgatggtgagacttttgttctcaataaataaacacaaactcaatgcaccttcccaggggctttgcatgggacctaaatattctttgagtcctgagttttctctcctctgaatctttgctgtccatcaccttctgccatttgaataccctcttatccaaaccaaaatcctaattccagtacagcttttcctttgtgataataccactgattttctagtacaatatacgcccagctcccaattccagctctgagctcctagagttctgggggacttcacattgcccatcttcttttgcagagtgttatatccaggtgtatgtgcccagctctcctaccagactgttcatctgcctgtggcacggctccttgcacacagtacgtacaaggcttggtaacagaatcccatgttcattgaagggcctagactgatcacattttaaataatgcacaatgttctcacgtctatttaaggaagaaacaactgatttctatcttttaagattgcatttcaagaccatatcaaaggctttgaatctctcaccaagactaacaatgaaaaacaaatttggccaagtgcagtggctcacacctgtaatcccagcatcttggaaggccgaggtgggtggatcacttgaggtctggactatgagaccagcctggcagcctgggcaacatggcaaaaccccatctcttctaaaagcacaaaaattagcttgcgtggtgacacgtgcctgtaatcccagctactcaggagggtgaggcacgagaatcacttgaacctgggaggcggaggttgcagtgagccaagattgcaccacagcactccagcttgggcaacagagtgagactctgtctcaaaaaaaaaaaaacaaaaaaacaaaaaaaaatgcaaatttgatcatatttaattgaatttgtttcaaagtaagggaaaggggagtatgcaagggcgacatgtggcctgttcttctgaaaaagcaagaaaggttatctttatacaccagatcaaggtattgacagctacagagtgaaattccatacacaaaaagaaaattttcttcaagtgaaaaaagtaagtggccaataaggtcacattcaaaaattaaaaatggatgccctggtcttgattactgataccatttttcaataaaagtaaccagagctccttgaagaaataattgattttaggactaggacatgaaatgtacaaaatgatgcgggagcatcttgtagtaccagggaaaaaaaaaagtcaacccttagcatgaaggtgtaagtcaaaggcacatgggagactggagatgcattttggatttcagattttttcagattttggaatatttgcatatccatcctgcgtcatcttggggacaggacccagatccaaatgtgaaattcgcttatgttatatgtagtgtatccaaatagcctgaaggtaattttatacagcgtttttaataattttgtgcataaaatgaagtttgtgtacactgaaccgtcagaaagcaaaggcatcaatatctcagccacccacatggaaaatctggtgttgtttggcatcaccatcattcctgactgaatttatttgctaccaataagcaatcattttcctgctcttactcagacgtgagtacttaacagtagaaaatactactatttttgtttttgaaagagtcttgctcttgttgcccaggctggagtgcaatgacaccatctcggctcacggcaacctgtgcctcccgggttcaagcaattctcctgcctcagcctcctgagtagctgggattacaggcatgcaccaccatgcccggctaattttgtatttttaatagagatggggtttctccatgttggtcaggctagtctcgaactcccgacctcaggtgatccacccgccttggcctccgaaagtgctgggattgtaggcgtgagccactgtgcccagcctaatactactattttttaaacagtaaagatacatcctattaatacagtgaaaaataatgtgtttaggtaactgggcagcacaggaaaaagaccgttttcctttctcagctgttagacaacagcagcaacaaacaatgcaggctttcagttgccacctatgatgctgtgtttggagtaaagggcactgtacactgtattttttttcttttttaggtgataagaaacatctgaagcagttgacagatcatgaagcgggtcctctgagaaatgagaggcattctgccggatggcatttttttttttttttgagacgaagtctcaccctgtcacccaggctagagtgcagtggcacgatctcggctcactgcaacctccgcctcccagtttcaagtgattctcctgcctcagcctcccgagtaggatggcttttaaaatgttttctccagcgtcatctgcctcattaacagcgatttttgtcttagaagtctctctttgagtttctaaatggacatgactgcttattctgttaggaatgcactccactctagtccttcaattagcccatcacattgtcactgtggcatctgtatgcacattttctgccgtgttaatgtcatcttcattgtccaattgtggcatcatgttggtgctcaaaacgttgcagattttggaacattttggatttcggacttttagagtagagatgctcaggctctactacttcttatttcagagaaaaacataatatccaaataactaataaaaacttggttggagaatgcagacttctagaaatgactgtttaatctgcttatgataaataatcctctttgctctactgcaaaggggagactactgctgttactgttttgtgtcatcatgtcctgatcagacaaacactgatttaaaaaaaaaataaaacaagtacattgtatatgtaaatttagactgtaataatatatccttgagaaataaatattatatggactccatttttctctgacagtcaattaagcacaaaaagatttttaaagcactgatttttgcattcttaaatgacaaatgaagtcttcttgaaataagatttttaatgatttagagaaatatttgcacatacactagcttggtgttgattctcaatttttaatttttttttaatcctttccctggcattttcatcgtttccttttttttttttttttttttttgagacagagtttcactcttgttgcccaggctggagtgcaatggtgggatcttggctcactgcaccctccgcctcccaggttcaagctattctcccacttcagcctcccaagtagctgggattataggtgtgcaccaccatgcctggctaattttgcattttttttttttttttagtagagatggggtttcaccattttggtcaggctggtcttgaactcctgatctcaagtgatccacctgcctcggcctcccaacgtgctggggttataggcgtgagccaccacgccaagcctatccttcccctttttctgttttgttatggatgatgaatgtcttaaaactactgaactccttataccttgatatggttagtgagagcttccttgtgggatggttctgaatgattttctctagaacctccatttgaacatcttcctttcctctgctcactgtaccagtctggggctatcaaatcacatatgctgataaatgctacactatgactggtgaagccagtgctaaaaagcagcttctacatatggcacttccaaattgtgttattgctagcttttccagtgctttctctactagggcatccactgcatgtcacctgctaaaatgcaaaccacatctttaatgaaagtctgttttattgaatatataagtgactatgaaatttcaaaatgaaatttgatggcaatttaattttataataaatctatatctatgtatctcaccaaagatagcctaaatctttagtgaggccacacattcatttttatgaaaattcttcacatgagtttagaaatctcccaactaagaaaaggacaagtcagatcttagtgtcctgggtggcttagcatttcataactgccagagaaccatgaggaccttcctgggactgactcatgggagttatctgcaatgattttatgtttcccaatgggtcatattttcattggagattatttactatgcctggaatcctaatgcttggtgtctctaatgagaaaaataatacaaaaaaattcaatattcagccaacacaaatttatatgatctacaaaagaaaggaatgttttcagatcctgggcttgattatttttgttttcgatgtgacagatttgctgaacaaagcttacaaatctcccttttcctctctgctcgctactaccccgacccagaaaacacacacacaccccttcccaaccggggaccatctgaccgttcacacccacatcaactctgggtcgccatgcttttctgagggacattgccttcactgagagctcctttattctcagtataccttacattcccagccacagtactgaacttctcaatgcttgcaatgttcccttggagtatatcagttgagcaggcggaaaaaaaatatctggaagtttattatttttccaccaatatatttgacaccacctttggagagggaacaaaaggcatactgtcaagcggatagacctggacaaaatgttactgtttgttcctcacgagcacagaggtatatttaagcaaagaaaggcattccacggctctcccgggacttccttccttcagctgaattataccaacatgttcacaccactgagggccaggctgctggaatttaaaacgcagacctctatctgccagtgcttcgatcccacggctacaaacattcacattaggattgaacctggctttcaaacatcatgagataaatgggagtttactgggggaaaacgtgtgccctcatgaaactatagtagaagatgcggaaataggactgtccctgttcagcagattctatactaatacaataaagcctcaaagtcaccagaagtcacctggccttgggttatgtttcaaatccaggctcactgacattcatgaaacctttggcaacacaggccaagtttcgtgcaaggctgggtagaatacttctttcatgtggaagctgggtgaaactcggtggctttggctagctttcacctgaagtttcacattcaaacaatccaaagtttcaacgtaaaattcaggggtgaagagaaacagaaagaaaaaaaaaacaaaacaaaacagggggaaaatggcttgcctgggaatggaatgatcacctaccattctccaaaaagatttcatcctggtgccatttaattttgccgctggactatcacctctagcaatatatttgcactcagccctgcagaccaaggcttcccagtactaagggagagtgagtattctagctagacgcaccccatccccccaacaaagcccaggctcaaaataacgggaggatttaaaatggtaaccatacacataaatgcgatgattgacatgcttcttataatgtagatttgaaggggaaaagtggcaatgaaatgcccaggtttgggaaacttaaagattagactgaacatctctaggtttttctactataaatccaagttctggagattcgattgcatctgctcctaatccagggagatctctgccgtagctttctccacagctccgcccctttggagatttgtcctgtggccacttgcgtttgtccttcttagcaaggtgcagaggacggggcagactgcgtcagcgctgaggagctagcgtccttgactgggacttaaacagtctcctgacaggattaggctcattctactcctaaccttcaacagaacacgcagggaccgtttgccagggaacgtcaaactctgtatttggctgaggactgtgaaaataccttgtgcttggggtgggaaagaagaagggaacaaatgtcacacacacctgtgctttcttcacaatgaagagaatattccaaagctgattgaatggctagtaagtgctacattttgcccattttaggaaatacatttttaagaaatcccttatcccttacacagcagaagtttcactcgtaaaacagacttctggctactaaggttttttttttttttccagttttcttttgattctaattttctttttctttgttatttcttcccgtttttgttactcagacgatccttatgtggttaaaatgcatgctttcctttgatatgtgctctgtgataccaataaacttttctgaaaaaaaagtatttctgaactccaaagatttcagcatccatgtttttaaaaagcaccagttgggccccaaggcacacggagattctgaggcagcagggcagccagcgcggggctctgtgcactctcatttgctgcttgctcttacacatctgccagacaggggccatgaactgtcctgaagtctgtgttggggagaactttaccagagaacacttttcttacaattgggggtccctctagaagtgaaatctaagacagatcagtgaggaaaactaaagctccaataaattgtttaaaggaaatgctatgaaagcattaaaccaaaaggaaaaaaaaggagactttttactgagcatagtaaatagccacaatcaaagtaaatgctgtgtttgaagttaaagtccacagatcaaagtacttcgcaaaatgtcaagtgcaagcgtaacgagggggagaggggagccacagaaactgacccgaagtatcacattgtcacgttagagaaacctgccagcagatgtacccagcaaaagacagtcagcttagtaaggaatcctcaacactgtcccctaaaatgtgctaggaacatacaaaacaacaataacaaaaacaaaacccccagattcccccaaatcaaccactctaattccacacgagcaatgaacgaaacagtgatgaaaggagaacattatacaatacggctcgctcattgcccttaaagaacaattacttatatatattatctttactcaggtggatggttgcatctttttcctctttttttttttttaatgcccctggaaagttaaaaataaagcagtctaaacaacaaaaatatgatgtctgaaacatcctctcattgctctggcaatcaggcttaattagacctctgatccatggcttagtcatagtcaagcgtgtactgcaggtcactattatgagagctttaagcaaagtttaaaacttacagccacaaaaatgcccagatgctcctgctgtattctggaacaccgtgtttacctgaaaattgttcacaactccccttattattttcactataagtaagttattttaaagacattagttatgaacataccagaaaacaattaaataattccagaataaaaaatcttacctacaggcagctgagttcaacagttgctctatacagaggaagtaggagtcagtggccttttacatgtagagattgtttatttagccctttttaaaaggtcttgaactccagaggtttaagattaagtccaatccaagtgtctgaaggaaaaaaagcaagagagaggcaaatgagagagggaaagaatcccagctgctgggtggtgctactgttctgagagcatttgagctattttcagcattaacagcagccggggttgtctgcaaagggatgaaaatgccttgcccagatcgccaccccccactccaggggggagaaaacaccaaccaggaaacccacaacgacttggttcattgtgcaaatattcatttaaattttgaggaaaactgccagcaccattgaaaacaaaacaaacccaaagttgactggaatcttaaagaaacacagtgctcctcaagttttcaaaatgaattacctgattcactgaaaacgagatgtcctacttatgctttattgagaaggaggcttttcttctgatatttcctagggggtcttaagaaatagttgagagccctctggtagcagtatctgttgtcagtctattcttaagactgaagacaaatgatttcttaaaagagcccgcacctaaatttccagtttcatcaactatgctatttttgaaagctactgggttaagcgttgacatctcttatctattggcagagactggggaccattcagtgacatgaggcagacaaacagtgacccctgcttctgcctccacaggccaatgaagaaatcattctggttgggtcactggcaatgactgacaaactttgagccttcattttgtttctagaaataaaaattaagaagtcgtattcattcattcattcagcaaatatttatttggtgagcacttcagagcttactataagccaagcactctgggaatacagtggtgggcagaatgaagtgtccttgccttcaggggtttagagcacacagatgcagtgagaataaataaaaacagaatttttaaatattttccagactttttcacatgatgagactattcacatcatggcagctgaagactgagatctctttctattgtggatgaaggaagatactgtgtgtcatcagaccaacttcaggcttccattgagtcattgtgcctttacaccaccaccagggaggaaaattacttactttctaccaaggaagcagttaagtatgtttatgaacgctttcattccaatagatgaaatccctggtttttttcaaccccctactccccattacaaaaagaatgcttaagtagtcagaaagtactgctgagaggctttccatcgggagatgaaaagagagtcttcaacctgaattcagtataaaaaactgccggtggctcaggcccgtaatccagcactttgggaggctgaggcaggtggatcatgaggtcaggagatctagaccatcctggctaacatggtgaaaccccatctctaaaaaaaatgcaaaaaattagcaggatgtcgtggcacgcgcctgtagtcccagctacttgggaggctgaggcaggagaatcgcttgaagccgggaggtggaggttgcggtgagctgagatcgcaccagtgcactccagcctgggcaacagagtgagactccatctcaaaaaaaaaaaaaaaaaatgccctgatatattttataattaatgtgagggttggttgctagatgcttatatcaaattcaaattcaattctttctttgccattaaagaaagacactgaaatagattatggaaaatactgaggattatgccatgtgaaaaaaaagggttacatgactactacttcaagtactatttaaaaacagtgaaatcctttggctcaatagaccttatattaaaactgtatttcaaattaaaaaattataaattaactttgaaatctctaatctgaattttataaataagatcaactttgttttaaaaatgtataccaggctttaaaaaatgactctagaataaagcatttttcttttcacttattttaaatggttacattttactatgtcttaaatacctgccaatctaacatgggatatttgtttctcttggcctcaatgtggaatggtaattctactggtaataattggaagcctagctgcagacagacacattttttaattgtttttttctttttcctccttataatagtttataccaaaaaagggtataatgcatttaaatattggctttccttgagaagctatggcattaaggaaacaaagatcaacataacccactctcgtataaaacagggataataatgagttgtcatagggctcataggaataatgcacagaaaatgcttacctgggtaatgtctgacacacagcaagcatttggtgaaagtcagtaccatcatctctgctgtaagtgtaaagctttgctctccaaatatggtggctacatgtggctactgagctcaatgcggctagtcagaactgagatgtcatataagtgtaaaatgcatgctagattttgaggtctttatacaaaaaaaaaaggtgaatgatgagaaattactcagtgggtacgatgttcattattcaggtgatggacacattcattaaatccgtgactttaccactatgcagtccatccatgtaacaaaattctccttgtaccccacaaatttgtacaaataaaaatagattaatgttgtctcttcctaaaacatgtaaactatcatatcatttttatattgaccacacgttgaaaaaagaatgtaaattatgacattaatttttatattatgtgttgaaatgacagtattttggacatagtatgttaaataggatattttgctaaaattaatttcacttgtttcttttttactttttcaaatctgactgctagctaatttaaaattacctatgtgacttgcattctatttctactgggcagtgccatgcaggccaacggttctcaaaaggtagtgagcatcaatgacccagaagcttcgtaaaaacagattgctgggtccaccccagagcgtctgattcagtaggtctggcggggcctgaaattctgcatccctaacaaattcccgggtgattcttgacctcactttgaaaaccgctggtcttgggccttgcttcttaaaaaagtagtccacggaccaacattaacgtcatcacttaggatcttgttagaaacgcaaaacctcaggccccacccagacctactgagccagcatgtgcattttcacaacatccccaggctgcgtgtaaacatgttgaaacttgagagaaatgatatgaagtagtgtctgtcatccctgggtgaatataaggtaaacttttacaaacaccagtaccccggccccgcccctagagagtcagatttaatgactctggatgtgactcgagcatctgcatacgtgaacagctgattccagattaaagcaagcactgagtcccatcagactggatgtggaaaggccaggatctagatcatttgtacatcattaaggcatagttgacacagatcaaaccatattagagggtatttacatcccaaaagaggatcttgttaaccccaataactctacaattgttagaactggtgagaaagacccatattttggagtagagaggccttctgttattcgctccacctctgttccggccttaaataaacgagcacgccaactttaagagtgtgtctgaataacctcattagtttgccgaatgacttctcacattttcaggcggcacctgagcgttgtgtgtttcacagagcttggtaaaaataaaatcctcactgtaagagagaatctgggctcacgctggtaacatttaaaacttccaattctatatgcaaagaccatctgcagctttgcttctcactttcttggttgaacctttcagaaaacttttaaaagtgcataatacttaagagtagagtctggagtcagggtgcctgggttcgaatcctcatcctgccacttacgcgtggctgtggctgtaggtcacttacttagcctccccatacctcggtttcctcctctgtaatgagacctttttttattgggttgttgtgagggtgaaaattgttatttgaaacagccatggaaaaatctgctgctttgtaaattttatatgaatgttggttaaataatcaaaatatatttgaaaaactgtgcagatttccatatgtggctaaatttagtaatttttaaaagatactgtggtgatttccaaggactttcatgggcgtgagtttttgaacacatatatttagagggtttctctgagtgttgttttacatttttttcccaagacagcacagaattctcaattgattcctcatcgcttcctattatttgagaggatcccagtaggaaggaagtaaatgtagttttcccatgagtattgttttctagagaacattctttacccctgcagtcctttgaagagtgagttgtgctatagatgtttagagacctccctggtccctgtcattctagtggcattgtctagtatcccaggagaacaatgtgtcattctcttagtcaaatattttagtgcttagggcgaggcagcaagaccatctgaaacactggcgtgagtttcaaagacatattgaaacagcagtcagattctcctatagaaatcagctaatgctgactaaaagaagggatggggatgaacagggaagtgctgaagtcacgcacattgtaagcaaaatgaaggctagactaagtagagtaacatttttttttttttttttttttttttgagacggagttttgctcttgttgcccaggctggagtgcaatagcacaatctcggctcaccgcaacctctacctcccaggttcaagtaattctcctgcctcagcctcccgaatagctgggattacaggcatgcatcaccacacccggttaattttgtgtttttagtagagatggggtttttccatgttggtcaggctggtctcaagctcctgacctcaggtgatccacgcacctcagcctcccaaagtgctgggattacaggcgtgagccactgcacctggcctggagtaacaccttttatgcttgtctgcttcaaccacactcaatgaagtgaagcatatgcaagaaaaataaggatacctggtagctctgggcacgtagcaagcatccgtcgggtcatctacaggaacctcacccatggtatgccacctgctgaacaatgtaatgcatgcatcgggctggaaactaaagcccatacattgagtgactttagaccagtcatgcaagctccctacacttgtgtcctgaaaggcagatagaggcatgggactgcaactgccttactgactcttaaacctatgctttctcttgggcttatctggattacattcggcagtctgccatgatttacgcctttttgcagcactgtttgaaaggagtcaaatcatacgtccaatgacttctactgcctggttattgatgttaagtaaatactttttagtaggcgatttgtcatcacatgtgtcattttgccatctgggttgaggtttatcaagtgaggtgaaaatcttaacaaaaggttaaaggaccagtatcattgaaagagattatatagaaataacttcttaaaacctctgttagaagctcaattttctagttgaaactttgtttcatttatttatttttatttattcatttatttttgagatggagtttcactctgtcacccaggctggagtgcaatggggtgatctcggctcactgcaacctccacctcctgggttcaagcgattctcctgcctcagcctcccaagtaactgggattacagacatgcgccaccacacctggctaatttttgtatttttagtagagacgggtttcaccatgttggtcaggttggtctcgaactcctaacctcaggtgatcctcctgcctcagcctcccaaagtgctgaaattacaggcatgagccacggcgcccagcctgaaactttgttttaaactggctgcctgaattctttgtgtatttaaagagcacctctgctgtttatgtaaccatgacttagcttttcttgttatttctattccatttgaaattgagcatatgcaacagtcgctaaatctgctatgaaaattgtgaagccttctccatgtggcccactgaaggccctgcacgatctggtgttctgcagcatttctgcccagatctccaccaccttcctcccagtgccattgcctccagcctctctagcctcccttccattgcctcccgcctctccagcctcccttccattgcctccagcctctccagcctcccttccattgcctctggcccctccagcctcccttcccttgcctccggcccctccagcctcccttccattgcctccggcctctccagcgtcccttccattgcctccggcctctccagcctcccttccattgcctccggcctctccagcctcccttccattcctggactgtgcctcatccagggccctggcttgcctggctcaatgtgatgggaatgccttccctgcccagtggcgaatgccatgcagcctccagctttcacgtgtctcttcctcaggaaggacttccctgctccaccagcgtagccccgccaccccctttttttaactcgtaaagaatcaccttcctcattccttctaaattcaggttcagttgcttgaatttgttggagtaattgatcggagcccctctcctccactagcctatcagctcccgcttgcccctcacatgacttacattcctcccgcaggtactgcattctgcctggccctaagtaggggccaatacgtagttgctgaataagtaaatgattaaataagttctgccgaaggcattaagcaacacaagagtacattttttggttctatatttatcagaacttgtgaaataaaaagtatctgatcatgtaaaaagcaaaacattatgtattctaattaagcagctgtttccaaccaagacgattctctgaaacattgctttgtagctacatatttggtttagaagctgtcttaagaggcaggtgccacttgcttttcccttcaggatataatatgttctgttatcttaatttgcatttattctaaaatagatttcaataaaacaagttacttgcattcatatatcatattcctagacctttttcacaaccatgtgatactctactagggtagagtgaggtccctgataaacatttcttctgattagggttattgagagaattatgtatttgtctatatattgcctggcagttataccacctgaaaccatatgtgattatttataatgtagttttatgagcagacaggcagatataaagtaacacatcaaccatgccacctggtcaggccatagtcattccaatggtatgaaactctttcttgtggccatattatgcataagttataaacagacaatgaatggtcactgactgagaagactggagatttgcaatcttattttctggcaaatagccaagtcatgtcaacaggagagataaggagagttttgtgtgtcatacactgtagagcaggggtcaaagcctgggataggagagggcttggtcttcactgcatttatttgaaaggagctatggaaacttttcttctaccacttgggcacaggaaggcttgctatggcccaacaatgttttaaaatgtattctttacacatgtgtaaaacactctgaaatcatcaagatacagcatgaaacgtatcttttctgagacattaaaaaactgaataaattaatccaacaagccatggcacaattccataattactatgaccacagaagttaatttagcagggatagtacataatacacaccgtgctaggaaagtgtccttgaaactcatgacggtgaaggacgaattaagcccaatgaaggacagttgaccagcattcaagaggtagaaggaactatagattccttatatcaagtacatgagaaaaacttcctaaatgaatgaggctggaaacacaaaccctcagagactggacataggaatattttctgcgttgtctgtcttctaagcagactctctctctacttctacttctgtgttagcaacgactacagtgctgcagtaatatagatctcctcagttctcaggtggccaagtgaggccttgggaagctaaagttcctggactggccacctctggctgttagcaacctcattggtttacctctgtgcctgcaaatattcttgattttatgtatagtatattatagagaagtctggaagggaatgctttaaccagcaaagtcaatccattaaacaaaaaggtatgggagagacacgttaagagatcagtaaccatgttgtagtttaaaaaaaaaatgcgaagtctttgttcagaccctcggggtaagcagaagtagactggtctccagtggcaggcatgagagggaatatcctgcccgcagtgatggacattttggtttcaggcagagaggcaggaagctgccctctgaatcagagtaaatgctcacattttgaccttctagcaagggccctctttttcttggcaagaattccttcgaggatcattttcagtttgaggttctgtctgatgttttattttacaattaagtcactattcccatattcattactctgtaaaataagtcaagtaggtaagaggtgtggtagacacttccttctgcctcctgaggatccattttgcagccttcctcactacagaatcctgacagtacggccagttaacaactgacctgcctggattccttgcagtttctgaccaataagctaaaggcaaggcatcctgttgaaaatttcatatgcacagtaacgacactaacctcccgagaagagggcttccttgtccttttctttcttttttgagacggagtctggatctgtcgcccaggctagagtgcagtgacgggatctcagctcactgcaagctctgcctcccgggttcacaccattctcctgcctcagcctcccgagtagctgggactacaggcacctgccaccactcccggctaattttttgtattttagtagagacggcatttcactatgttggccaggatggtctcgatctcctgacctcgtgatccgcccacctcggcctcccaaagtgctgggattacaagcgtgagccaccgcgccaggctgtccttttctttctaaccttgttctgctcctctttttgtagactgaaatgcagatgtcattctgtgggggtgcatgctaacagagagatgatacagcgatggagagaggatagagaggaacctactctgggctacctgtccgtgggatttcttgttatttgaggcaaacccaacctggtgaaatgactgtattgaggtcatctgttccatgaaagctagaaacagaaacaaaacaatcatctaaaaacaaccttccttacattagaccggctgaacgacagcaataaactattaggcctgccattaagatattagttaaaaaatacttccagaagttttgaaagaacttctgggcatcaacaacgaatgcttacaacagttgtggcattaagtctccggcccattatcatttcctaatggagcaaaatctgccatgaaaaatgagccgacatgcctaacgccccgggagctgcatcatttgaatatttttgactctaaatatagtgaagtagttggctcttttttctaaaactacaatttactgatcagtgatatcaagagaaataagaacacagcagtgatcaacaggaaacacaaaacaggaacgcattgtttattctgttctcggtggacactgccagatcattgttcagagagctttcaacagggttgcttcgatggagtttagggagtttttaaatctaaattgaagatgaaatgtgtcctcgggacagaaaaagcaattttgaaaaggttattcaaggccataaggtattgactttgagcgtttaaaaaaaaaaacaaaaaacctgtaagaatcttactgtggtttcttaaaatggtgaatgctgtcagtcataatggaggggaaggtaggtttgattaggcggccggtgaattttcagagttaaacaaagttaaaaatacacaggcaacatgaaaattgttctaagcgttcctgtgtcatggtttctgattaagtatcatgaatggaagaaatgaatataaatcataacgattccgttttataacagacagtctcgtgtaaatattttgtctttctagtcacatgtgccaagagctgtgtgagagtgtaatgatggagagcgtggtctgtacttacccgccaccatcaaacccaactctattactgccagcttctgtggctgctacaatcttcttgggcttcagttctcttacccaccaaataggcactgtgtggcccttgactcataattgttgtgaggcttaaatgagttaacacatgcaaagctcttaaacaacagcaactcacaggaggccctccccacgtgttggctgaggctgtttccatcatcatcttaagagcatgggcttggagaatcaagagttctgagttaagtttctggtacttcctcgaattagctccctggtttgggcataatcgttgagcctcattttcctcatctgagcaatgggaatatcgttcattaccttaaagcattaagaagaggggtgaagaatataatgctggaaaaccacacctggcacactggaatcattagataccattttgtttacattacacggaaaaaaattatttgcaaattgatcttcaaaaatatagagacttttactttgctgttggggaaaatgaaatggattgggcacacctagatattgaatttaatttccttatcatttatttcagatagctcacattcaaagttttatgttttgggtttttttttctattttaattttaaacaagaatacatgggactgtcaaacaactggattaagaaaatccccatatctgagctaatcactttgtcctatgattgacataacagtctccttcgagcaacagcattaccactgcttcatttagtaagtagagaaggctaaagaggaaaggtagtggcgttaaaagaaatgacctggaagaaatagagaagaatggactttgtaaggccctgtgagagtctatcattcctctagcagggggaggagcagagttataatcctatctaccttgttacaaacaaatacacactaacttaacattgattgactatggttataatgaatggtaattgaagaagtatccctctatcacagcagtgattacattccaaggaaagaactgagggtttggaaccaggcacagctgatctcaaggcgtggcttctcccatggcaagccatgtcactttaggagagttacttaatctccctgagcctggatttccttatctataaatagcagacaggctgggcatcgtggctcacgcctgtaatcccagcattttgggaggccggggcgagcaaatcacttgaggtcaggagttcaagaccagcctggccaacatggtgacaccctgtctctactaaaaatacaaaaactagccgtgtgtggtggtgtgtacctgtaatcccagctacttgggaggctgaggcaggagaatttgcttgaactcgggaggtggagtttgcagtgagctgagatcatgccactgcactccaatctggatgttcatccatttttttttttttttttgaggctctgtctcaaaaaaaaaaaaaaatagcagacaaccccatctacctctctgggaggtttctgagaggattaaatgagactttgcatgaatattggctactccatcaagtggttgcagaggaggggttcagtaggctgttgttgctgtttacctctttttcctactacactgcaggctccttgaggataggattcctttaaaaacaaaatacaaccagttcccagcacagtggctggtcgctagaatgtactgagtgaatatacaccaaataaagcaagacagggatactttgaatggaaagatcaaacaacagcaataatgaatagcaggcttgacttgtttaagtgaaaatggttaagagagactggcgtggacaaactgaactgatgcattggggaacagattaagtaaaaagtacgtaaaagacaacatcttcttcacacacatatttagaagggaaagataagccgtaagggacagagaaactgttatacgacccgaggggattataaatagcatccttaaatggggctatttctatatagcctctctattttttactttgtagaaagattgaatgactttgacctatgatttctgagagctctgtctgatttcttttttaatttacaaaagtttttatataaaattcaggtcttctcatttctctctgagcctccctcctcccatctgtctccaccctatcctaagtgcctccactttgggtactcttgggttttatggctaaatccagcaacgcagattgtgggcgggcaggtttcccgtattgttcctaccgcccatttctctacagcatttcttaaatagggcctagtctggagactttcaggacgagtgttatagttctcacttttcatttaaccttgaatcatagctggaaagcacattacgaaacctaggtaatcatcccctacacattttgaaaatttgggagcagaagatgattttacaggtaaagccatgaccagcgccagggtctaagaaacattgttgcggcgaatgggcaggtgacatcacatggcgcaggcagcatgttccagatccagatctgagatgggagagggctttccacggggcctgccgggctgttccgtgagcaccagggctgctccagcgccagctgctgctttgttctgcctgggagcagctttgtcggagacttgctactcaaacccctcatgaactaaatgagctgttaatgctgttcgcaatcgtagactcattgaagtgtcaggtggtagcatcaatggagcaacagaaagaggttttcatagagaaagaaaagagataccgacagagaaaatggggtttgcaataatttcagtaagaatggattcagcgggggaaagaaattaataggctatatcctaaaaagaaaaacaaataaaatttggtgcttcaaagtttcaaattaggcacatttcagttgagtcatagccagacactcaagtacggcagtgtgatctcagaatcagtcaactatcaaaggagaatagcaccatttaagataattagaaaaatgacttcagaaatgagataatctcagagaggaattattcgtacaaggctcgctggtgaaacttctgaaaaagagaaccttgcagctgagttcactttatagcattatattagggtatacttatttggtgaattttataattataccctgtaatgaatcttacctgcaaagacagagaaagactcaattcaagccacccttctatttgcatatataacgttgggtaagagaagaaggaattggaaagctcttcaccaacggtgcccatcactgtggccaaacgtgggttctaaattgcagagcctccaccattctgcaacttgaactctgttttcgtgttacagattaagatctatccacttggcctattttaaaaacagttgcacacatttgaacacaccttcgagactccaaattggacttctgtaccaccttctattttcggtaaccacaagggtgctggaaattcaagtactaacaaacgccacgacctacaaacttaagaacatgagctggagaatacatgattcctgggccgcagaacacacctgcgctctggactccaattattctttggggcgtttgacttacagatcaaggaccaggtcaggtcatctttgtttgggatgtttatactcttttttgtgaagtcttcaacattgcattgctctttttcttaacactcaaaagtcagcttaagatccagtgttaaagcttatttttgtgtttctttgagattaatatgatatttccattttccatgagaaatgagactgccttccttctactcttaagcagtcctgtagagaactcctaatactcattcatctccactcaccttatccagattcgaattagctacaaaggtactcagggattctatgcaataattattcaaaataaagtcataacaattttattatttagcaaagtataatttatgaaataaatcatatttataagtataattaatatataattgtgtattagataatagagtaattgcttatcaaatatggaatatatttatatataatcaagaaattaaatataatttcttataatgtttaaatataaattattaaatataattttagcaaataaagtcataatttcattctatagtctcctctatttttatgtttaaatggatacattggtgtcctcagaatataccatttttttacaacagaatcattcaagagagacattataactttttaattctcttgatttttaatgcaatatttcattaaactccttttaagcattagaagtttttgaaaatgtgccaggtgaggtattgttaggtaattttgctgctattcttgcttcttgaccattttctcactgttttagtgcatttggaaatgagtttgaccctaagtttcttcctacctatataaatacttagaaactcttgtactgtttccaaatcaactggagcagtgcctccatgggctacatttgccgttatctgtttcactgagaaacaatatatctactgtagttaaaaagttcatgaatggtccttgctaatttctaggctgttgaaacatgtctctaatttcacagattttgaggaggcaagagatctggagttttatttctttttttttttaatagcatagtgttggatttattcaggatatgagaagacagtcatctgcgcacaacacatttgctatgaaaaaaaattgttaaactacacttatctccactcactgcttcagtggttatgttaactttgtcctgagagtagctagcattggggtaagatgtaaaacacaaaaataatgatgtattattcgatcagtctattaacccatactgattagtggccacactcaaaaagacatattgtagcgaaaacattcccaattctcactcacatgataaccaccctggctctacaagtacaatacgtgtatctttgccacttatctgttgaatgtgtactaatagcttcctccaatgaataaggactctaaacttcagggatcattacaaggtacctgaggagctgggcgactctacagttggaattattttcacattaaaagagccaagaaatctatgaactcatattttactcaatttatttgtgcagccatatataaatagatggtctattcatgtaaaagaaactattatttcaattctaagaatgttaacttcattattcataaactagtccattggtctgataagaaagcatctctcatctcacagacaaatactctaaaatatgtttatcactaaacaactggctttatttagggaacaattcaagattccctgatcacattttctgaaatgatccaattttgtcactcagcattgactctgtaccacagaaattgcattcctgttccacattgtgtcaatggaaaggaaggctgattttggtacttagctatgaatattccatactctctgttctctgaaaaatgtgaacattgagtagaaaatcatgagtatgggggaaaaataataaaatatatgaatgtgcttttaagagcatggcaatgtagtgaggcttattaaaatgccacttttcataaacaatttaaaaagtttctctaagtactaatttgggaaagtatgctaattttcaatacttaaaacctacatctgtttaaattagaatgagcacatttttgccacatgtcacattttattaccatgcaatggtaagtataaatttaccacctacataagaacaaaatatgggcaatacatttatgaatacattaaatgtttaagaaaaagcttttctgcacttcatatgatcttgttttgtttgtacagactcatgtttgtgagctgggcaagttagcttcagatataaggtatacatagaccttgggtgtggaaggtccaggagggccatgacttctgttttattcatatagcacagtgcctgccccatagaaaaaacctagctcacagtggagaaaagtgaatgatggaataatggacgtacaaagccagccaaggtgaggctgtacagtgtttatcataaacagtggatgttctgaagatgacctcttgacttgttttttatttttcttactctaagtgcctcgggtgaactctttcacctagcatgttaggactaatctgcaacgtggaatttattataaaagtgagtgctcatacttgatatttgtcacactagatactcttaaaaatgtgaaaaaaataagattgtttttcccccacaagtacatgccgtcagagtaaccattttcttctttagatcagagtgctaatagtcaacaaagggaaattgttcaacatgtacagagccccaagactctggattccttttaaactccatgtgaactgtatttggttccaaagtagagctaatcattcttaatccaggggtaaaaccaccactgccagtaaacagacaggccccctggcattgaagatcaagttggtgatgatcagttttctaatgggacagcttctaaataatgtcccaatttaaaattgatgcaaattttgataatggaaattgacaaaatgtttatattcagagggttaaaaatttgttttctattgcttagtcttgtggcatcctagttagatgtctaaacatgattggtgctacctaaatttcctttggccccattctagatacatctccttattttgaaattttcataacgttaagtagatttagaaaatatgggacggcgtggtggcttacgcctataatcccagcactcgggaggccaagatgggaggatcacctgaggtcaagagtttgaaaccagcctggccaatatggtgaaaccccgtctctactaaaaatacaaaaattagctgggtgtggtggcaggtgcctgtaatctcagctcctcaggaggttgaggcaggagaattgcttgaacccaggaggcagaggctgcagttagctgagatcatgccactgcactccgacctgggcgacagggtgcgactccatcgaaaagaaaagaaaagaaaagaaagaagagagagagagggagggagggaaggaaggaaggaaggaaggggaggagggaaggaaggaaggaaagaaaatatgaacaagcaaagagaagaaaataaatcttcagaaaaaaaattgttgacatcctagactgttttttttcttcctccctctttttattgtcgtgctatttctgatcttgaggatacggaaatttggtgttcacttataaataacggtttccatagagcccatgagcaaaaaatacagagagaatgataaaatgagaaatgtaacattttcttttggctgatctgtagttcccacaaatgggcagtctagaaaactgttgacagtgcagggtttggaatgtggccgactcaagctggaatcccactttccccacatgtgtgaccctgtgcaagttgtttaacttctctgcgcctgtttcctcttctgtaaaatgagaataatgtactcatcagagcgtttgtgtgaatagtcaatgagaggtatttaaagaatttggcacgctgcctgacacactgtgcattgaatgaatggtggccattattattatttataagaatacttactgttattttactttcttaactaaccctgcagatcgcaaagctccaataccatgtgatgtgaagactcattttagatcagcccaagaaaaacaccattaagcaggtaaatccaaattctgttgggaaaagatcatatgatgcattctcaagcaagtgcttcaggattgtggcactgcagtctctactagcctaggcagtggcaggatggctgttctttgggaataaggtctttagaaaacagtgagctcccacattctatcctgtcatcatttttgccgtgaatactccacataatttatctccagatgattagtttgccttagtgcaatgtaattaattgggaccagaagatacaagagtgtgtttgttatactctaatgaagtttctttgagttttaagttggacttcaacagttaaagaacaacatgatcacggaaagtcaaatggattgtatattaagaagatttttatttatttatctattatggaaatttatttttattctgtgtatttttttatttttgacccagttgagccttgtttggtcaatacctctgggagatcttgacaaaacaaagcgtgtctgggccaaagatttcctttccatctctggggattttttttattgatgatgaagttattatggactgagagccagttatgtgccaggccctgtgaggtatcctttgcacaaattacttcatataagagaacgactggtcctatgatctatgcacagcatccttcttttacagagaccaagcctgtggttgaaagatatggagtcacatggcagcggccacacctcctcgaaagctaaatccatgactgggccttggtccccgcaggctcctgcctggcctgccccttcctgtcctgcaaaattggaaggacattggtgcagaattggaggagccctgcctttgacaaggcacatacaaagggaaagtctgtcaaaaagcatttgttttactttcttttttaaaagaaaaaaaaatactgttatttactgacttttaaaactaagtgaccaaacattggtgacataaaattgtttcttaagtataacaaatgtcacttcaaattgttttttggattttaaaaataaccaggtaaagaaatgacgttagggtggggagagagggcagcagaaagagagtggagagatggagaaggaggaggagggaggaaatccaggcagtgggtggggcacggccccactgatgagtgtctgagccatgggcgcttggtgctattcagggaggcaaggtcctatgttcataaataatgtactacagggacagtttgaaagtgatcattaaatttacatttttaaggcaggggagttgcagtcacagccacaaatataaaaatctaaataaggtgtcttcaagcattgtcctgggacaagaactgcagatacatggcccagcctcaactctctagatatcctgctgatctcagggaattcagatggtgtttcctgggtccagttctcccccgccacccctctgaggaagcccaatctaaagcatccatgttggatgcttttaccatgacaaggtgtggagaaagaggaatttctataagtagaatgataatgaggagctgccagatttctagcaggctggggactcggtggttccccttgacatgatgcttctgggcatgactgaggtcctgggtgtgtgactgagggtcagggtgatggtgtctgagcatgattgaagtcctgcctatgtgaggaatgtgggaaggatataacaggactggtgcacccagacctctggcctggggagaagctgctttcacctccagccaggaagagtggctcccagcagcaataccccacagtaactcaaagtcattaatcatctcactaagtaaactgtgtttgattcacagtaggcaagagtgttcacagatgatgcctaaaaacacaagtagtgtgtataggcgggcttcatgagcttgcaaactgagcatgtgcacctgaccctgtgcttagaacggccaggtgttctgtttgataccctgctgtcatcatctataacttattcatcatacttttggaattgccttttcatcttgcgctgggccctgcaaatttatatagcagattcttgttgggtaaatttcaacagagataaacaaagtttccaaagtttctgagactccaatctcacatcctacaccctcaaaaatagaagaaagaggtcggggcagcttcggcaattccttcctctctcctgccactgggacaagctcacctctgctgcaccctccctgcctcagcaatctttgatctgtaccttcagagaaggtttttatcctagtccatccccagcagacacctcctgcccagcctctctctgaaggtctacatggcaaccacgggctacatgtggctcccgggcacctgccttgcttgcactgagatgtgttatcctgcaaaatacacacaagatgcgaaaaaaaagaatgtcaaggaaatcattactattttttatacttgttgaaatcatattttggctgtactaggttaaaaatattataaaagttggtgtcatctgtttccttttactttttaaaatgtggctgatagaacattaaaaattacataggtggcttctctttgctgctcaatatatttctattggtctagacattttttttaaaaccacatatccacctaagtgttccacctatatctccatctcagaaagtctcaaaccagtttcactatcttcttcccccaaaacactttttccatgtcttgttttcccaagacagaaacctggtgattaaaccatagcctgcttctactcccaaatgccagctgagaactgttggttctgtctccataatctctccacgccagcacttttcccccagccctactgtcctgtctcagctgagccattcatcttttcttcctggattactgtactgtcctcctacaggaaattcccttattttttttaaattttcttgtagagatgggatctcactgtgttgcccagggtggtctcaaactactgggctcaagtaatcctcctgcctctgcctctgaaagtgttgggattaacaggcatgagccaccccacctggccctatgtgaaattcttgaattcattcccaccctacctcagtggtgctctcacaacagagaaactatcttataaaggaaatcctatttcaccttcctgcttgaaatgtctcacagttgccctgccatctggctctggtctgcttgctcgattttactcactatctctccatatcgggcatcctgcattccagccataccaatggctcccagggccctgcagatttatatgaaatccatcgctccatgcctgggcgctgtggccacgctgctccctggtcacggtgaggctgggcatgcctgggcgctgtggccacgctgttccctggtcacggtggggctgggcatgcctgggcgctgtggccacgctgttccctggtcacggtggggctgggcatgcctgggcgctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtgaggctgggcatgcctgggcgctgtggccacgctgttccctggtcacggtagggctgggcatgcctgggctctgtggccacgctattattccctggtcacagtggggctgggcagcttccagagcgaatgtggacatattcttaggccccacctcacgcacttcttcagagaaacctcagaggctcctccacaagccacgggtacccccagatttccctcactctatgcatcccatgcgcctctagcaacgcaggaccacactcgagtagagctgtctgtgccgaagactgtttggcagacactgtttcagatgcgttccagacacttaggagagcgactgacacagagcagggcttgactgattacatccctcgctcatttctcccggccccgtcaccttagttcatgcccaagttttcctcttgtcgaattcatcgacactatcatttcgtaatcttttcttgtgcccttcatttaatttgatactgttaccagttatatatttttcacccacaaatatgatcattacttttcctctgtaaagaagctccaatggttctctctctttctctctttttctttccctaaagaattaacccaaactacttaacatgatgatgatcctgatgctgatgacaaaaataggcatgggtggccattcattctgcctctgacgtgccaggcgctatgccggtcattttgcagtaatctcatttaatcctaatgataatactcagatgtaagtgctattatctcttccccctaagtagggaaataggggtcaggaaaagcccaggagcctgttccccaagaccaagttagcactacagagctgggaatgaattccaactttatgtgactgcaaagctcttccatgcccccacaccaccccacgcccggttctccctactgttcctacattccagacgcaccatccagcctgcaatgtgctttcacaccatgttcacctgcagacaatgctttctccatctaatgcccctgccttcaccatgcacacactgaagttgcctagaagggtcagtcacactctactctgtgccttccttctgcctcggcacttgtgatgctgcgggattatcagtttcccctccctcatcccaaagactgaacagtcaccaagagtagcaagtcgactagtcaccactgaacatacgcagcctggagaatcagaggtgcacggtgtgtgccttttacatgaactcatgcatacaccaagaatgatagtaatgcctgctcacatttgtttagcatctcccacatgccagacctcaccctacacaattagaatacataatccattcaatcctcccaccactctttaggataatgtatcatcttaatccttatttattttttccagaataaacttgtgattctaacaacttcaacataaaataaataacttttgctcaatatcaaactctataaaatcactaaaattggcccaatatcctgggttttttaacttgcattatttcttcctgataatgacatttaggccagtcaaatcctgtattaccgttttaaacaaagaaaaaaagattatgagttgcttttaaaattcacgtgtgacaagcagaaaaaactcgtggaggcagtttcaacatttaacctaagtgtacttagcaactacacttaatagctttttaaaaagcctcgtttttaaaaaaagtggatctttctttgcagagtgacttaaaatacatcatcatagtcttattaattaaacatgttcttatcagaaaaaagcgtctcgaaagctagtatatatgcttaattaagctgtatgcaaccatcagtccatatcttgaattaggctacatgtgaggccctgatttgccccattctttctgctacccagaacagcactgctcactgcctaccagtgtttccagcaaagatataaagttctacatgtctaaacgtttttgccctgatatcaaaagcaaagcaaaacaggtcttctccattcccattttggttaacagcatcaccatctgcccactggcctgatccacccagaagcctgtcttcttttttgaacttgaaatactcatgtgctttatttgtataaattcccattattccctcactgctccaaaaatagagaagaaagtaacataaatgtactgacatcaatttgagaactagaacatgttaccttcccgaagtatccatcttggatatagggaaggagacttagcctcataaaagcacatgaaggaatgctcagaggaaatactctaaacctagttttctggaattggtaagcagaagctctggagtcagttacaggttgtgagccttccaccaagaagagccacctaacataccaaaaaaataagcatgagattcacttaaagtttgacaaatttagcaactcctttccattgtctgcattttagagaacctattgatgctgttgtaacagctacagagaatcgtgagatgcccagtgacattggctatagtggtagcaaaccgggtagtgggaagttttctaacaaatactatgtaaaaggagaagcctgagtcttttaacaccacagatcaaacactgcaaatggtaggacgagcattagagtcccgctgaggtcgctgagacttacacttcacacgaattgtagtggtgcctagatctccctgaagagtggcagaagcagccgcccatcccttaaactacacatgtacctggcttctcaagactccagagtttacttagagatgagtaactagagcacaggaatttggaagagagtctttctataaactcccaggaacaaccaacaccagtagtggctgacgtctgtgagaccttctttgcgtcagatgcagtgctctcatcaacatccaacacacgtgcctttaatgcctgggactatggcgacactcatttagatgagggaactgtggcatagagggtttcgtacctcggcttacttcactgcaatcggctttctaaaccagaactcccacccgacaatgtgtgagtccaaagtccatgtttctaggtgcagtggctcactcctataatcccatcactttgggaggctgaggcagacggatcacttaaggccaggagttcgagaccagcctggccaacatggtgaaacccgtctctgctaaaaatactattagctgagcatggtggtgcacgcctgtaatcctagctgctcaggaggctgaggcaggagaattgcttgaacctggggaggcagaggttgcagtgagccaagatcatgccactgcacttcagcctggatgacagagcaagactccatctcaaaacacaaaaaatacaaaaagtccatgcttctaaccactagcaatcaccctataacatattcccctcaatgaaaaagactgaatccaagaaatctcacctgcgtcagactttctaagtcatagagatttatagtaataattttaaatgagtctttgactttcagacccagcgtatgaaggaggagagtgtgagtcagtgccgttcctgggcgtccgctgggaacttccctgactgtccttctggctctcaggagtggagctcacttgctcaattcattccagtgtcccagaggtcacagtctcccctctgtgagctgggctgtcctcggtccctgggcctatctctttgctgtcctccctgggatcttgcccctggggtagccctgcttcccttgcagctttcttctctgctgctggtgccttccccagggctgtgcatgggcttagctctttcttcatttctctccctctctcctcttttcttcctgctgtcttagctgggccccctccatccttttatttcctaattgtacctgttgcttccatacccttaaaagcatactccattttctccctagatgtattgaggtataattgacaaagctgcagacatttaaggtgaaccacgggctgctttgatacaggcatgcactgtgcactgatcaccacaatcaagttagtgatcacttcttatcttttttgtggatggtaagaacatttggatctactcccctagcaagctgcaagtgtgcaatgtggttttattcactacagtcaccacgctgcatgagatcctcagaacttatttgtcctataactgaaagtctgtgccctttgacctcattttcctccccccaccaattcctggcaaccaccattcgactctgtttctatgagttcaacatttagactccacatataagtgagattgtacagtatttgtctttctctgtctgacttgtttcacttaccataatgtcctcatatgtatgctgttgcaaatggcaggattttcttcttttttagggctgaataatatcccattgtgtgtatatacaccacattttctttatccattcatccatggacaggtccttaggttgtttccatatttattcctttcctttgtatgtatatccagaagtggagttgctagatcatatggtagttctggttgtaatttttgaggaaactctgcacaattttttacaatgtctgtaccaatttacattcccatcaacagcttacaagggttcccttttctccacatcctcaccaacactcgttatcttttgactttttggtgatagccatcctaacaggtgtgaggtggtgtctcactgtggttttgacttgcctttccatgatgcttagtgatgttgagcacgtttccatacgtctgtttgccatttgtatgtcttctttggaaaactatctatgctggccctttgcccattttttaactgaatcatctctctctctctctctctctctctgtgtgtgatgctcttgagttgtaaacacatttcttaatctttccatgtgctttaatctcagcactttagcaactgtcaagaacaaagttcttttcaaaaagttcatctcaaagttggccactgactcgtaacaggtaaaacccaatgagcacttccctgagcctcagtttcttcttttctcatgtgaaacagtgatgatagtgcatacctcccagggctgttgagccagactcaacaatttacatgaaagcactgagggggtgccaaatacatgtgagtggtataaaacaattcttgatgctacaaagcttgcttttccacactattgtcaaaatcccaccttgttcgagccccaattaaaataccattttctctaatccatctttcccgatcctctaacaaacttcaattctctgagcaatttattatcatcttctggaactccattgcttaagacgatcaaagagtttctttattgtataagttacttctgcgcatgtcttttgaaggaataaataaatgcattgattatatctgccttatagcactccatcaccttctatcttaaattacagtaactagcgttcctgtcttcctgcactaaattgtaagctctttcaatggcttcctggcttattctctcatcttttcctccggtccttgatggatgtataataaatgaatgagtaaattatatgaaaatgcaagtatgatttttttaatatacagttacaacttcgacatccacagttgggtctgaccacttgttaagttgtacccagaacttaggtctttctcgctctccacgttccctatcaaggccatcttttcaataccaaacaaattagaaagaatacaatcagctaacttacactaacatactaacaaatgggacaacagtcttcaaggtctggaagaggagagcagagaactcatcattgcctgctcaagcccatctaccaggaggggaaactccagatactgtgggccacttggcacttaggaactcatggtactgatctgtatattgggcagatatagttttttggtgatagtcttaaaaatcatgtgtcacctgtcatgacacttgccagatgaaattctgattttatttcccaagagaatgcactgacaaattaataatctgacctttaaacgggtgatatttctccatgtcaatcaacaagaggccattctgttttgttgaccagataaaatactctttcactctctgaggggttagcgagagtgcatgcagatttctccaatgctttgcttttggttggaagcagaaacatttaaatttcaaggcaacacttttcctaattcctactgaactcaaaagctctagtggttcagtgatcccattggtaacaaatacttagagggccagagtccttctgggtcctatccttacgctcctgttctctcctcctctcaggccttttctgcaccatgcaaacccagcacctcttctcacaggctgggctaaaggcagaatgcaataccatgactgaggagcctgggaatgaggcaattcattaacagaacattccccaggaaacataattttctgatcataatctctttgttcctgacagttgcaaaattaaataccagagccaaaaaaaagtgaggcaccgttttaagggtatgttttcctaattcgatcttcaaaggaagcacaagcttagggttcgaaatcattatgatgtaatattatgccacataataatacatagatccaatcattttaccagataaccgtcaatataaagcactgacaggacatttgggacttcgggtcaacaggaaggtggtttttcaaactaaactatattatttatggctttgattgtcatttacttttacaacataagggtgatggtaattctgctcttctgccaataaatctaaaaattaattgaaaatgtagtcaaaatccttggcacactttagaaggaagatttttttaattaaaaaagccatattaatcattatataaatgagttatattagtcctgtaaaattaaatctatggtggaaaggaagtcagtgagtgatataatcggatttcagaacacatatcatataaaaagttatgtttctaaataaagtgagtgtgaaagaattcaggatatattatcagtcatctgagttactgccctaagacagcccttctcccaaaacagatatggtttctctgacaaagaagataagtgtgccttctcatatttttattattttcttaactgtcagacataactcatatgtagttaagttgctcagaaggttaaattcggaggaaaaattctacaagtggtttaaatgagccaaatcatttttggttgcgtcatgtttcctccgttgaaaaagtctcgatgacttaaaaaggattgctttgatacttagcttagtgttttacccaaaaagcatactgaccaaaaacaaacaaacaaaaaacccataacaaaacaaacatttaaagatatgtagaccagatcagttttctcctgatgaaagtcacatggaaccacacgcaggttaccttgctttcagcaggtccctttccttgggtgtgaattttatttgttacaataaccgacttggcctagttactcagccatccttcgttcactcttggtagtggacatggcaagatggtgggtaaaaacacgtaaacaagactgctctctcgtggaggtcactttcacatggaaagactggacacgtcaaaacacttcattaacatgatataaaaataatacaacatgtaaagtggtatcggcgcatctaagacaaagcgattcaatgttaaatccctctttgggaaataatttaagattgcagaaaatgtttctgagaaattccaatgtaaacgtccttaaaagtccctactttttagtatttggtattatacttatagattttgtgattttccagatttttcattaaaagttaatatgcataaaactcttgggatggtagcaagtacagagtgaaatctatataaattattattattatcaatatcttttggagtgaacaaattgaacattttttgaataatcttttgcgtagttgactgaatactagttaataggtttctattgttttcttgagttaaatcagaagcagatattttgattgactgtgtaaggtcttgcagcttctatggttttttttaacttgaaaaggtcttcccagactgatacctctttctgtcttgaactctctgttcaactatattctaaagccttaaaatgaagatcttcaattttataactctggatttaaacttttctttcttattcttttttattttacaaaagaaaattttaactctttaggttgattatatttcttgatgaatgtgactgtaccaagaggctttaaaaaaattgagattagaaatcagtttttcttatcttctgaattattcaccatatgatgtgttgcatttgagctttatctatgcttctggtaatatttctgtcttatataattgttaaagtataatgcttctcaccaggaagactatatatatatatatgtttaataatagcctttttaaattttcatgtgttttttcttctcctttgttttctgatttttaaaaaatcagaaaaatgtctgaattgtcactttatctgtagattcaaagagcactttctaatcatgtgttggcattagcacaacaccggggaagatctgattgctgtaagccgttcattcattcagcaaatactgactgaatatgcagtatgttgacctgtttgctgagggcctctctgttccggctgccattctaaagcgagtcaagttttccctgtaacttttattctgcagaagtaacctgtacctttttccattctcttgccattcaccactctcctgacctccctttgcgtaaactggtttaagcctggcgctctaggtccatccaacaacaccggtctattcacactgtagcagagcaaccaagcagttatacaattttcatcttaactactagtaatactatgctataaaaattttgaaacctagattttgagatattgagcaaactaaaatatgtagtatttactatagtgcaagaatacgtctgacgggttaaatgcacgcgttttggaaagtgctcaaacccttcaccagatgacacagttatagcacaacaacagctgaggttattgttatctaatctcctttccctcgttaactttagcacagagaactgaaataattgggtgtgaaggcatcttgataatctaccaaaaaggctcatttttaagcagccaagcgttgctctcttaaacttttgttgtttagtagcataaagtgtaggcaacctgtatgaagtataaatatctggtattaaaaagacccagtgaggcagaagtcgctgactcctctcaataggtggaagaggattctccatgcagccgaaggcttaatgaagcacatttccaccagccaggctgctgcctctgtggtgttacctcttcagaggactcagtgcctctgagaagctggctgtcctcagcgagaagtaagtacagggacttctgtttagaggagactagaatgaatatttatactaataaattttctccaacatagccaaaatctcatttgaatatgtttttctttctgtgcatttaaaacacttgccattcttcatggcatcccatgcttgtactcttagaggatcttcacgagtggcacagctcttggctagaatcctatttttttttttttttttttttttttttttttttttttttgagacggagtctcgctctgtcgcccaggctggagtgcagtggcgggatctcggctcactgcaagctcctcctcccgggttcacgccattctcctgcctcagcctcccgagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcctagaatcctgtttttgctatagtttgttggactccttgcggctaatccttgcagctatattagtctctgagggatgctgaattgaatagaacatcagaagatttggagcctgacgggtttatgttgcccctgtcctcaaattcaactattccagaaaaaatgtactaggacaaggaacctgaaaagaagaactatttctaacaatggattggatgaactctcccattcaaagcagaggatataattcattataagacttgtaatttactttaaccactgggaaaacatctcagagggaagagagaaaaactgaatttctgattaaatttaaaaaatcaaaaatttaataagtaggcaaccgtataaatgaacagaaaaaaacaaaatatcaccgaaactttcagataatgttctttgttaaaaataagtttccctaaattataatatgaatatataaagagaaattagaaaatataatgagaacattaccaggcctttttgttttctttcttttttattgtgtttttgtttttttgaggtgggaaaatctttgaaagtaagacccttgattggattcaggaaagtgaaagctttctgaatttttgctcaaataatgcttctctaaggtacagaatttaatgctgaatttatgtctacctcacctgtatagggaagaggaaaccactgcttttttggccaaaattcctacttggtaaactagtatatttccgttttgaagaccaaggtgcagtgaagtgtggtggagttccatatggatctgttatgctgcaaacaccaaagtaaaaacccgtctttgctggttccccgtcatttattcagcaaatatcatcttaattgaacttaagctgaaacgtgagttcttatttgccaatactcagaactcaacagttgcagaagtgtttccttttaactgcatgtccatgtcttgagtttttcagaaataatacagaaaaacatattttgaaaacatatttatctgtatttttccacgtgacagtggcagtttaggatttaacaggcatatccataattaaattgttagtttgaggaacttccagaaaattatctaatgcaatcatatatcacaagtcttctttataaaatacaagtgcaactcatttcattatgctatccatgtagttagacataactgagacctttaaaaatattataaatgacttaaaatagaaaatgttagaaacagtacaggcatattacaaaatcatggtttctgaaatctaattactatatgcaatttaaaataattaaacatgattagtctttaagatgaatagaaccaattccaactttagctattatttaattatagcatgctgtacattaaaatcagctggaagatagccaaaataagctttaaaggacagcatgataattaagaattgctatttatcttacttttattagaaaactcaatgctggaatgaatgcaataatgtcaagaaatatgaatttaaataatttcctaaatattttactttctaatcccaaatatcaggatattttaaacttcctcatcaattctactttatatacaaaaattcatacagtattaattagaacttttgctttcaacacagatatcttaaagacaaggaattatgtatttataacttcttaataaaactatgggtacattcttatttttgattgtggcagttttttcataaaaaggctactgaaatcaggcttatttaaaaaatactaataatgttatctaatatagaacagagggtaggaagtctctgtaaacaaacctatatctatatcaagagtgattctaagagaatattctctcccttacccaggtactcaagttgtagggtaacataactagtgtaacgtaactagtgatttccagtcaccttttaggtttacttaggaacattaaaagaaatgctgccattgtagacttcatttcaattatttaatctctttccagttcacgacctttactttcttctggtttcagcaagaaaaacaacttcataagtgtcttacattataatcggctactaatcatcatcaactcaacattagttttaaacagtctgattccataacaaatttgtaatagggatattttctatacattttataatagccatggatagaaaaatagtattatttatatactaaaacattcaagttgttttgtttaaaacatacattgtaaaattttccctcgggaaatttggatttattataggacagttgtagcttttatgaaattgggatcctgaagccatattttcaaatcagaaaaatgaaagcctcattgttgtttttcaaatgttttaagtttccttgataaaaggcagtattaggacttctatttctaggtcaagtctatatttacagtaactaataggaaaatattgaagtctgaggttaccagtacaatgtctgaatgcaaaattctggacactggacaaagtactttagaatcagaggccagcaaagctctggaaggctgtgaacagggacaaatgcaatatggttcagcagacagaaagtcagaagtaagattcagatgtagccaagcagggtgggggacagtgaggggggatgtctagctggacttgaagggcgtatgaaagcagctgtccttgcaggggagatttaaaggaaatgactcttcagggggcactgcatttgcaaaaaaaaaaaaaaaaaaaaaaaaaaatctgatatagtatgttttggaaattccaaaatatttgatattgccagcagaagagttggaaagtggcagaaaataagggtctaaaaatagccataagcgaaagtgcaaagtcttgaaggatagagattatgtctctgaacctggttctcaaaattgttgaattattaactatggagatgcgctgtacagaattgaacttaaaatggtcatctgtgtatagcatgtcatcttaaaaggttactaaaataggaaagaacttgcacaggtataaagtgtgtgccattcctcccgtgggctaagggtcttgtctcacttggtgccactatcaatgcaacaggcacagcagtcgggtgtgccctggatatttctacacctcattcttctaaaagctcccccaagaaaaattaataggaaatcaggtgcttgctgcaggtctttgcactgtgtcaattctaagaaatcctttggcagtgtaaagctttgaaggaaattaaattggagagagattttctctacctttcattcagctcatatagaatcccttacttagctgatatttttgctcatagaattggactcagaactaagtctgttcatttagctttcctttgaatgttaaacataatgaagtacaaggccgtcacctcaccattttatcccctacaacccgcataggcgtacacttatcaccaaacgtttgcacatgtttggctccactgagattcttagtctctatctttatattttgactattttgacatttagaacaaaagtttggaaaactattctcctactgctttagcattctcttatcttagggcttatgaacattgctacatctctgaaacaggcggttcctgcccatatctatcagtgaaaattatacttaaaattctgaagagactcatgtcatccagattttggaggaaaaaggtagcaaataaaaatatacttcttagaagtagatctcagttactacttattttaaatttcacagtagattccatcttttgtagataggggttttgttcaaagtttttgaccaaacatttttattaaatattttcaatagtattataagtgatctgacatttttggtaacaaaacaaccaaagaactgacttgagtaaagctgaaatgttgctgaaccagaatctaatccttactccgtcattttcttaccagggattttgatttgactgaccagtttcaatccacagtaacagctttgttcctaagagactataaatcaaggaaatactcactaccaggcaattcctcctgcaattcggggtctgtgctgttattatgaagcaactgacagcaaacatttgctgcaagtatgagcgcagatttggatgaggtgtgcggtgtttttggtttcactctttatctctgaaacctatctgcttgtgagaaaaattgtgcaagaaaagaagttttactgccacatacctcagctgtcctagaactcaatgcagaggcttcgcttcctttctttccttggattctgagccgggggagcacaatgggggtcttgtgctctgggccagcaaggcatgcagatactcggaaaggaggtgtgaacggcttccaatacctacactgtttgctttacaact

SEQ ID NO: 2075 - DNA, 226814 bp, Homo sapiens; identical to SEQ ID NO: 2072

SEQ ID NO: 2076 - DNA, 371274 bp, Homo sapiens; identical to SEQ ID NO: 2071

SEQ ID NO: 2077 - DNA, 71527 bp, Homo sapiens
atgcattttctcttagtttaacaagttggaataaaatacacaatttttataaagataaatgtcaagaagaaaaactgaagtatacttccaagcaaaatttattagatgtctattcaagaaaaacacaatgacctttgcttgtaagaattcaaagtcaattacctggaagccaggtatgaatagttttttcttttaaaatcagatacagagagtagaaacagtaatttttcttaaatatgacaggcaacagatattgaagtcttttctcataaatggcatcaaagagaattattcatttatcagcaaagctgcatgcagttgacttaatttcaaacctgaagcctttaaaatatgaagctggttatgaacttgacagaaatcaaggtaggctactcaacgatgtttctttaccttcttcctaatgaaattcccttgtcatcagtcagtagatatgtacatttcatttggcttctacgatcttttaacttcatagatttttgcataaatgctatctgacagaatcacactatctaggggtgcttgtgatctgtgagataaggagaggctagtctgctgaaagtgttgtcgcaggataaagaccaaattaggaaacgcccctgttttctcaacaactagtctgtacaaaaaaagagcaaacatatgtacaaaattctagaggctacgtacattgtgaaaagatcaatatcactgtccatgaaagagatgccataaaaagttttatctgtaaggtgctcaagatccaaagatgaacagttcttatgcaaagtcataagaaatacaaagctagttttcggagcaggtgtaattcaggcactgtgaaccatattaaaccttccaggtcccaatatcattttttaaatttctgcttcagggcagaaaataaaacctgaatgatttaacattgcttctaaaaagtgcctaatttattcctaggaaatattttacacacaccaggaaaatcaggctcaacatattcctgtcctcaaatgtagccaggattctgagttccatagaagaaaaataattattatagtaaaaataattgtagtaatcctaatccttgctaaaaccaactttaatacttgtgatgcttctgtactctatttctataaaataatgtgtgagattctattacatttccataaaatgtacaacatatcatatggattatatgttctcatacaatctcaaatgtgtatgtgtacacacagtgaaatcttacctactagtattgcttacagatactttcaggtgtctgttagaataattctttgcacctctcactaacactgcttttacttacattttttcagataaataaaacactaagagctcattgttcatgatgctgatcattacattttaatataaaatagcgatgcaactttacaacacaatagttttcccctgtagcctagctcagcctcttgtattgtcatgattattaccgaaggcttttatttacttactgtttgcacttctaaaaaatgcaaacaaattgcagaaaaagactcctatttgaaaactcacattcaatcagcaaaatcacactcatccaaattaactcgcctcctcttgctttaaaggttgtaatcactgtgcatattacaacatgtatgtgcaggcaaacaatagctaaagtacagttacagttgtcatattgtgtaaaccaagacactaggcaaacttgtgaaaagaatacacactgccaagcgaagaatatgaaaatgcaaaccacagcattccccaataaacaattttctggtcgtcttgggggagaacatcgcctggggggagatgttgaaatggagccacgaggctggacagcctcctggagacactttttttttttttttttgcctcaaatatttgaccatttttaaatatcatgatttttttctttctgatcccacattttgacgtgtcaaagcttagagcaggaagtaggaatccacactttcacggagggggaccagcctgccatgtcgtccccaggctcacagcagcggcggctactctgctggtggtttggtggcaggtggagatggtgacggcgcattggaaaccgtaaggcatgacaacgggaggcccgcggggtgtttcaggcgcgttgacgcaggtgcatggctggcaggcggcctctacagaaggagggagcgcaattcacagcctcttgacgtagtttccggggaaagtaccaaagaatttggttcttcttgaggtccctgaaaatagaagcgagtcatgaaaggggggtgacaacgatatcagttcatacacatgggcttgaatacttcccatttacaaggcctcggaagacagcaagccccgaggggtttggaaaagaaggcaggcaactcacatgaagcccataggcagacaaaataagcagtgttagctggttgcctgacgctctcactgcccctccggcataaatgctgcgctgccatcgcggcaggctaaacagaaatgctgagcctcccaagctaaagggaaagtcagccctgctgaggaggggggcggaggagctcagtcactgaggctgccacaccagagtcgggggtgagggatcaaggcgaggctgacaggtgacagggtgagtggaaaatcctaagagcaaagcttctcagggaccagcaacccgcgcaacacaggtgcgacatgaagacatcatctgtggcaggctgtcgctgttccaacagttttatcatcttacagaagatcatggtcagtgccacatcatttatttaaaaacagcactgccagagtccttcatcgagtatacaatttttcaacaatttacaaatcattaatgaaaaaaaggattaagcactatttgtgtgtgggagttctatcagtggcatgatttttaacatggtgtgtgtttaaccacacgcacaaatggctatcataattatgttcgcctctggtttcaaataatgtaattccttggacacttcttgtaaaagttggtgcactaaattgctaaattcttctttaggcagcgcagatggaccggataagggtctctcaagcttcatctgtctcctatatcctggcacttactgccttggtttgatggctgtttttctttttccttggctaggcaagccattttacgtttctcctccctcctcctcctccctcctcctcctcctccttgtttttgagatggagtttcgctcttgtcgcccaggctggagtgcagtggcatgatctcggctcactgcaacctctgcctcttgggttcaagcaattctcctgccttagcctcctgagtggctgggattacaggcacctgccaccaagcccagctgattattgtacttttggtagatacggggtttcaccatgttgaccaggctggcctcgaactcctggcctcaggtaatccacccgcctcggcctcccaaagtgctagaattacaggcatgagccaccgcacccggcctttttttcttcttttaatggaaataaaatcagaggcttgtggccgcaccagggcctcaattctttcatgattttgccaccgatggatgtctagagtgagccctcctctcctctcacctttcctctcttccattctctgccctgcagcctgtgtttccttttcacctctttctgtggcccagtgtaaaatacttttgtctacaaatgttttcccagaagacctctcgtctttttttttaggatggtaaagatgaagttgccttttaagtgggaagaatggaacgtctctctgcttccaccacaaactaaagttaaggtgagtcactgaatgttcgggcatctacgtcagacctaggaaacgggagagctgttcacttaatctcactccctctgaaattagattctcactgtggacaactaacattttccacagcacagagcgttgatatttctcttctggggaccatttgttgttgttgttcttagatctcaatctttcctggtttttgctatttaaagaaattgtcttctctcagttgagttggaaataaagctcgcagaaaatcacacatagctgaagcagtgaatactaaactatattaaaaatgcaatagccttgggattacattgtgcatatgaatgtctgaaagatcaaaggcattacgaattcaaaggaagctcggccatcacagcaaaccacgggagtgagcaaactcaagcaaattacaaaatagccgaaggtgcctgaggaagaagcgcacatacccacaaaccagccgtcatcacacttttccatgacatcaatgacatcactttctctgagctccagctcatcttcattcctgggagtatagttatacagagcctgaaaccttaaacaggacaagggaatgtgtttaaaaacatcttgacaccttcatgaaatatagaagatagaacaatattcattcttcctttaacattcctattcttaacaacattctgttgggtggtacaagcctggtaagcatgtaaatagcattctattggatggtacaagcctggtaagcaggtacatagcaatatgtagatcttcacaggcattagaacactctaacaacattttgaaactcacgaggaatatccatgaaaattgtaacattcataaattggattaaaatatgtcaacatgtataagtcagacccgcatttcagttgtccagccatctaacgtctatcatttagacattaaataatagtacaaaatataaaataagtgatatttgtattatttaactgtttaaaaacaagaaggaatcacaattttagctagccataatcagaagcaaataatgggggcttgagaattgaattttcaaaggttctaaatggagatagacaaaatgtgtcagacatgtctttttaatcactctgtgtgaattactatacaaaggaaaattattttttttactaagaggaattctttagatcagtttaatgttatggtttggatcagtgttttctgaggatgtagaattggaagatttgatgtaattagcctatgaagttgagtagatgtattctatgtgcagttattactgattccatttcaagcagactatggacataagtctctttttaaaatgagtcccagaaaaattgtatttgattttaaaactctctcttgaaataattttatataaaaaagaattattgatagaatgctatcactttcctttcccggcctgaattctttgacagcatatactgtggtggaaattgatcaataatgaattcagacactgaatttgtggtaagaaaacaccatacattataataaatagtaacatgggctggtgtttttggaaaatgaaggcgaaattactgtagctgagaaggtcaagaagaatttgataggcagttaacatgaaaacttcttcataatagtactaaaatattaccagtactgtgagggggtttttaaaaattgggaatttgtttctgctgctttctgtaacagtcatgtcattctgctaatgtgagaaaataattaccactttctagggtattttagattttttcatgccaacttaaaaaagttgataatcttgactaccgctccggaacaagaatgatttatttttaattactttatgagtcagaaaataatattttggtagaacaaaactattctatcatttaaactcaaatcttatgtcattaataagcaacagtgacctactggcttccccccgttcatccagcatttggactgggggagctggatagagttggcttcagagaatgcctaacaacatcccctagaaaatattgttttccctggcctggcaccaaagcctgaaatttcaacattagaggcttcttctcctgttaaaacttcatccttccagtagaccttacagccacttatatccttttgagcatgggcttctgaggccttttcttgagagaggggtttgtgattatggggaagggcagagaaaggcagctagcatcccagagtagtggccaaaaagacaggcaggtgtggaatacagaaacgtcacctgatttggatgtttgcatgtggccagctttgctaggggtagtccatttattttgttgcttgtgtaaagaatttgatttggaggctgctcaggtgaaggggtggtatcttttgtgtatctgtggggaaagttcacggtcccttttccagtttcacatttgagagagatggtggttcctgggctgctgttttgatggatacacacggcatttctcactttgggaaaactgattcttttattgagcttctcaggcttgaaccctgcccaggctcatctccacccactcatggagaccggttacctaaggctgcaaacctcagctgctggaaagaatctcaaggtctcagagctaacgcaacaaaattggcacagactcctgcttcatttttgtctgatgaaagccagcatgtttgtccaaatttatttaccattctggtttaattagaccacagaaacaaaaacaaaacaaaagaaaacccacggagttttatggaaacgtaaacacaccttcaggaaatcctcctgcctctcctggctttcaaagccagtgttgcacaatgggaaatgaagacaaatccaatgttaaaaaatgctgttgtgaaagatgtgttggtgaggtgagtgatggtggtggggtaaggatgcctcaaaaagaaaggtgtcttttaaacaggaaatgctgagccagactggaagccctctcgataacttgcaactttttctagaacatatttcactaaaactctgaattgtagtgacataacattatgttcctactttggctcaaaacttatttttaaatgaaagcaactaagcaacaccctaaaatcccactaattcaggctataatcaaatataaatttaataaacaatgttttctaatatacaaatcaggactttgaaaatgtaacatatctttcattcataaacactttgaaagctgtttaatataacatgttggtaatgcaataaacctaaacagccctggaatttattttttatcatgtgatcttatcatcgtttgggtaaataagagaacaaacaaaagctttagaatgacaagtcgtatttagtgttttccagttaagcgatctttttgtttgtttgtttgtttgagacagggtcttgctctgttgcccaggctggagtgcagggccatcatcatggcttattgtagccttgatctccctggcccaagtgatcttcccacctcagcctactaagcagctgggactacaggcgcatgccatcacacctgactaattttttatttttatttttgtagagatggtgttttgctatgttgtccaggctggtcttgaactcctgggttttggccttccaaagtgctgggatttcaggcatagtgactgcacctaaccttcagtgagatttcaaatgattatcactgctaacctgttctttccaaaatacagactttcccgcaacaagaacacttttctgcctgtgctctgtgagagccagtctcatccggagctgctttttgctaagtttcaggtctgtgaggagcaaggaaggacttgatggtgataaaggcaccaggtcatatgccaggacctgccgcaaggaggaggctattgttagcctgttctgctccaggtgagcagagtgtgggcagtgggtcaggatccccagtgtgtgctcagatatgggggacaaggggttaggtccatgaataagccttcccaggggtctcactctcgactcacagtgtgggcagaggccaacaggaagctgataactcctgaacgtctctcagggacaaaatgggcccgaaaaagaaacacacagagagaatcttcaagacaacgtgtgacaccttcaggctgatttaactcatgtatcagaaaggagaaggaatttgaaaggaaagtttgaaaaggcattttcctggtgctgtggaagtaatcgcatgtaactgaataacagtgagtgttttaatactgcccttttcaaatgacccttctaagcatgtaactttggaatgatggaatgatcgctttaggtcttttttacactgaggtccacttttaccgtctcccagtgggtgtaaaagtaaggttagaacatgttctgtatgtctttgaagctcgcagttactcgttacacagccagcagagcagagagggagacagagttatccatcttaggaatcactgaagcattgggaagttttcctagtgtgtcaattaaaatcttctcagagaactatgggttcttttaaaaattagtttctggtcactgtcataaaagatggagagactattacaatttctcgtaatttaagaggcctcatgttagtttgatctttcacgtgcaaagccatacatcttacattttggtacagttgtccattttgtgggtcaaggttagtctcaaatttagaagataagaagaatacttacggttcccccccaccttgaatattttcatgagtaaacacaggacgctgtggctgaaatgaaatgattttcaatgtaatcaatgtttaaactggtactaattaaaagataatttggataatggcatggtacttttcttgacatttaatatttcctgttgtaaaaaaccaagaggaagaaaaaaaccaaataaaagctttctgcaggattaataattaaaatatttaaagggagctttaaattaaagcaaaataagcaaggtcaaatgttttgaacatgtctacaatctagtctgctcaagctttaaggaaaagtcagggtttggtcccattgatttttcaaaggccaggaataaggcaagaacatagacggcaaaccactagaataggaaatatagacaccttcatacaaccttattctccagcgttttctcaaacaagcagaaaataaaccacatttagtttaacagcaaagtatccacactcattctttcaatctttccttcacagacaacattttcacatacagcacagaggaaaatatcaataggcagacatcccatgctacatttgaattaacattttctgttctcaatgtggagagaaaacatgcatttttaaaaagagaaaacagaactttggaatgcaacgaacaatatccgggtaacatgtaacattttaccttagaagagaaacattggtagaaatttccagtgcactgaactctcaaaagagtttcttttctttttaaactaagcatcaagaccagtatctgtaatagatacttataatattggaaatgacaagccttagcatcccatatacccacattaatattttcagtgaatgaaagttaacatgtttgttgaatatataaactcagtgtaatttatattgactacctaaactttaccttttaggggagaaatgcaaacaaatcattcataatccatttcaaaagcatttgcttctaaatgatagctacagggtaaaatcagaatttgcatggcaattatataagtgactgtttgatgactactgaaatagctattagatccatgtccttagactttgggaccagttcttagatttccatagttatgagtggattactgataggctgaaatctcttgctgccaattgtccatagaaaccccactgatccaagcttggatggataattctgaggttcctttcagtctacgagtcaatgattcacccacttcctaaattctttatccaccccctttctatcctacttgtctatctagcataagactaggtactcacagtactaaaactgtaagctctgactcggttaactggaaacctttattaacagtgttcttagaaatttcactcaacagtctgtggatagaatatttaaaactagagtgcgtaagaattactgcacacaattatgacttaagagtgaaatagtttactcctgtaaatcaatatgactactaatgatgtatctattattaaaattggaagatattcatattttaagaaaaattatgactaaccagttttccaaccatcttaaaggtcatttaattcaagatattattaaatcaatttaaatatataagatggtaattgtaagtcattgataagcctgtatcatattacctatttcaagttctcttccagtccaataaaactttatatatgtataaaactttcatgcagaagtaagatttgtatacatcaattgccattaatattattttgtaataactttccagtctttttttctcagtcttctttcttatttcaaatgtctgcagaataatgttctcccacgtgtgtctacatatcatagttttcttaaccattcctctcttttttttttagttttgaagttagaattggtctagtctttttttttttgctatcataaacagcaatgctatacacattttttatgcaaagagctattttcttcttttgaactattctttagaatatattcccaggagtaaaacttctggccaaagagtatgcattaaagccatatgattttgagaatgtacatgttagtcactgaaaaatactgtactcaaaagtaacttgaaaatgtctaatatgccagactgcatatcatataccaagatagctactactctttccccaaaacaatcatagcaccatttgcagtgcataataaagttatgaataagaaaatattatttattcttgtcttaagagaaaatgttgtgtaaaatatatttcattatgctctaaaattggcatccctgttttcacacatttaaaccattttaatattttaaaattgagtaaaagtttcaacttctacatcatggcatccaatgctttgtaaaactggttagtttcatttcattgctcttttgttaaaatgtgaataccactttaaaaatcaaattgttcattaatgtaaaacaatcaacttttaaagtccgtatatccctttttagttatcatcattataattctactagtttaattcctttaactcaacccacctcatcaatcatttaactgaactgtcccattgaccattatgaaaatttggtgattgctgcaaacctgcagcttcctggatcccacgtccatggctggagaacgtatgttcctgtgtggggcagccagcaccgtccttgctttttttttttttttttttttttgagatggagtctcactctgccaccaggctagaggtcagtggtgtgatcttggctcactgcaacctctgcctcccgggttcaagcgattctcctgcctcagcctcccgagtagctgggactacaggcacgcaccaccgtgcccagctaatttttgtatttttagtagagacagggtttcaccatgttagccaggatggtctcgatctcctgaccttgtgatcttcccgccttggcctcctaaagtgctgggattacaggcgtgagtcactgcgcccggcccccgtccttgcttttacctgtttcccaatttctcttttcccttccttcatatctttcaaaccctgcccctctttttacacacaaatcatcagttttctatactgttcacatcctgaggccagaatcaatcaagacttttcgtagcagagaagttgtgtgtgtcttataatggcgagttttagaacttttcaaagcttacctttaacaagaatcacctccatgttaatgtggataactaggagacagttttgaggaaagctgactaattacagtacttgaaatagtttattttaaaggcatttgactagtagggaatgagtagcaagaacagttatctaagacggctcatctgcgtctttctgttttgggcgttaagcaccatataaccttggggatgcctcagcttccctatctctgaaatcaatgagttggacaagatgagggttaatcgggtcccctcagggattccatgaaggatacacatttccacagatgtatttcctctgctgtgtaaaggtgtccgtcatcagttttacacagagagctgggacactgacattgattggttaattctcatgtgtctcggtcacgtaaaaaaaaataatggttacaattcaactccattttgcagaatggtaaaccaaaacccaaagatactggataatttcttaatacgacaaataggtaaaaaacaaacagaaaaagaaacaaaatggtaatttcgatgtgcacgctattgcatgaaagattactatgatggactacttggcctaccttggctaaaatcagcatcttaattttgacgctgaggtaggtgcaaatgtcctataaggtgatgtaaatagattatctggggagactgtctttcgccctttccccttggtgatgtaactcaaatggcaagtcgcttaagcagagatttgtaatgcagctgcactctgtcgccacctagtggtgagcaatggcagcaacaagctgagagttgtttctgctttatctgcccctttttatccaagttcccaaggctggaaaaattttaaaagcctattttaaaggccgcagagtgatgtggaatagacagtcatctgttttcctaaccatgttcttccctccccacgttttaaatttttgagaaagcatcccttgtaaagccaccagcatttttggtccgtgtccatttctattttgactatctgtgcaggcatttccatttcccctaacttcttagcagttttaagataaatatagaacaatatacacttgtgacattcagagaggcttacatgagctgaacctagaaagatggctttcaactgacacattacaatcactgtgctgggcattttgaacaagaattatattatgcttatatttccttgatgaatcttaagagtagaacaagagaaaaatccagtgaagcatgctgcggttttcatcgtatcctaaatatgtatttttttctgtagccctgactatgtaagtatttttctgtagctattttttaatgttgtcaaaaacggatacaaaagagacaagttttaaacacatgctaatttccaaagccagaaccaatcacaagttgctgttcataaggaagctggtttgaaacatcatggagtctgtaacatcagtaaaatatatactttccgatcttagtgagctacagtctgttgaaaagccgtctaatttatcaaagcttctgcagttatctctggaggattagctatatttagtatcaaataattcttaaagaaggattgactgttactttaaacactaatgcaaaaaaatctctgaaagcaatataagcagtgctaaagtgtttttatctttttttataaaatattagttgtcatatttgcccaccagaattcgatgaaattctcctaataataccacgtttatgtttctagaggcttatttttccttcttaaattatgaaggtaaaacacaactttgcataaatctaaaaaaatagaatatttatggttcacacaaacacacgtgtaatctgacatacaaatacataatgtaaaaatcaggcaaaaaataaaaaaaaaaccttaaggggaacacaagcataccatctcgtggacccacaggagggttatagatgggtccttttcactgcaaaagaagcttatgttttgctttggctctggaaggccattcgggggagtctaagagtctctacaaattggcatttctgtctctatggcaacacaaagctctgcctcagcaacaaaatgaggtcttcctatgcaatgcaaaaagcacaaagtggcatgaatgcagaataatatcgacttttctttagaaataaaaaatgaagacttctgtgaaatcaagcccttgagaacttcttgaaatgcagaagcacggccatgcgataggccagtcaaggttgaatccgggtccattaaaacagaaatgaggaaaggaatcctgacttatgtccagatgaaaatttccaaactccttggctgcattccttagaattgatagtaagtaccatttagagtccatgtattttaaagtactgtagatactatggaacgaagtagctaagggaaagtaatttgacctttaagttcaatcagagctggcaagaaataggaagtggatagaatccagacagcagtatggggacaaaaggcagactgagaggatgtagtgcacatcaccagagaaacagaagatgttagacaagaatcatggatttaaaaaaaatccaaattgaatgacacagaagcaaacatgaccggaagtgtgtgagttcggcactgtagatgcttggcaacagttttttctttgcaggagaaacggtgactagaaagcagtgatttagtgtagaaccatgagacagatgtagaccacaaaacacacgacactcttatttgtagagtagagaatctgaccatgtctttgtggagtttggaaacctcacacacacctaaaagggaagcacatcaccaggtggtcgcttcatcttcagggtgtctccagcctcactttaaggccagttcacagcaaagacaactaaggaagagccagccctgggggcgggggaggtggccaggatgcctgccacaaagtgggggcatgctgaccctaccctgtgggaaccgctgagccctctgacaggtgagccgcagaatctcctagacatcactgggctacgaggaggcttacccaggacacatatctcgctttttacgtcagcctggaaaatgtacaagaagttagttagctctcatcttcgtcacacagacttcaggaggagctttcctggctggctttttccatgcacacacagcatgccaaactcctgcacaacagcagggcagggagggtccacagcttctccagctgcttatacagtttccacaccacaggcaccagctgccatcttaacatggcacccacaggcacagcagaaaaaggttcacagaggaaagctggcatagggaagaggccaagaacatataagaaatgttatatctttttttgtcttttatttttttgagacggagtctggctctgtcgcccaggctggagtgcaatggcacagtctcggctcactgcaacctccatctcccgggttcgagcgattctcttgtctcagcctcccgagtagctgggatcacaggcacccgccaccaggcccagctaatttttgtatttttagtagagacaggatttcaccatgttggtcaggctggtcttgaactcctgacctcaagtgatctgcctgcctcgggctcccaaagtgctgggattacaggtgtcagccactgcgcccggccaagaaatgttatgtctttcatagaatgcttagcaattgggttcaagatgctctcaaacctgccctgctttttcatcttattgaagggatgcaaggtgagatagaggagaatttggcttaatgcctgtcaaatttcatggactgtatcagacatttgttggaggcaaaattttctaacacataagaagaaaataaggcctttttggggggaaacatggtgaaatttgatgaactactgaagtgccaacctgtgggctggactgttttggtgttttttttttattttcagagtaagatctttcatatgacagtgagtaagctgaccttcttttgtgtaggttttattttccttccaatagcggacaggatctggcagtgtactgcctggtatttgatctggcttaagagaacttccggaggaataaaacacgcttaaataaaagcatgtggttttctcaactctcatttagaaaagttttcctaattctcagtaatgattgacctcaaatccccagcctctcgggatgaaatgtgtttggcaccgttgcttaagtgtcgtggcagacgatgcttgatgctctccacatccattctcttcttggtcctcagtaatggggccaggctgttgggtaggcacatggccattctggataaagaccacatttcctgacttgtagctggatgtactcatgtcataagctgagaccgaggggatatatgcaattctgggacttggccttcaagggagaaggtgtaatctcccatcttttctccttcctgctggttcgtgtgagaagggaactactcgagctgccacctgggacccatagcggaagcttctctctgaggatggcgatgagcccacatcagatggaaactcctgggttctctgatgactgcggggccaccataccagtcccggacacccttcatttatgtgtaagagcaatatatttctacgttgtttaagctataattattttgagttttctgggactgtgcttatcccagtcttgactaatacaggggttcaatgcatatcagagctcttagagaaaaaaaataaccccatttagcttttagaatgatgtggatcataacagctggaaagagcacgtgaacatattaggaaaaatcagggcctgatttcatgttgaaaaccgtgcgccggggatccccttctgatgggactgctttagggtgacgagacttcctggtgggaccacaaccactgagttacttggaagaaacctaaaaaagagcctctcactctcctcacagagcttccgctgcaacttgagaccacatgcggcaagtctcttgcaaaatagtctctcggatggaaatggaggctcagcttatagaggagctgagatttatactattttttttgagatggagtctcgctctgttgccaggctggagtgcagtggcacggtctcggctcactgcaacctctgcctcccgggttcaagcaattctctgcctcacccttccgagtagctgggattacaggcacctgtcaccacgtccggctaatttttgtatttttggtagagacggggtttcaccatcttggccaggctggtcttgaactcctgaccttgtgatccacccaccttggcctctcaaagtgctgggattacaggcatgagccaccgtgcccagccaatttatactattttttgttatgaaaaaatcattattttaaaagcagatgctcagaagactgggggaaatattggattcagatttatacattaaacataatttatgtatctttcagtcatctgtaatctataaagtggtaggaacttttacgtttatggaagattctggattgcatttacttttatggagattgtcattgtcttagaaaacactttaaagaatgaaattgcactgacttaacatgagttaactaaacaatggttgatggggttgataaaaatgttattacaatgatttcatgcgtgctatactatgtcattaaaacattactaagagtttattttctctttgctttcagtgctgggttatttcttttctttacaatgagcatcagcattcttgaaatggaagaaataaaaaggcttcggactcagattggcagagtttgtaactgggtcagatgcagaattaaactataatggcctaaaattacgagttgattcaatttgtacttaaatttacaagcacaaataacttcagtgaatatattctttcaatgactacaaaatagatttataaggtttaaaaaaactcagtgggagattcaaaaattgagatttcctcctaaataggagataaaacagagaaaatcactttgatttgctggagttagtcagaagtatctcatgtggtcattaaaatattcttttaaaacatagttattgtgaatacctccattctctcatgtcattctgcaaacaacggaaacttaaagaatatacgagaagaattttgttcttgcagaagagtaaacctttttaaatcctggctttgtcctgatgctacgatggtgcgtcctccgtctttccaaattagagaactcagattctaaggctactttccctcttattgactaagcttaaaaaccgaagaacaagttaaaaaaaaagacaagaaataaataccttggccttaaaaataaaaccacagacagaagagaaaaaaagagaaattcttagccttaggcatcatataaagtggcattatttaaaacatttcctaattattttctgccagctaagaaaaaaaacctcaaagagcaaaagcaattaaagtgtttcattttttacaaagttcctttcacgcctaacaggagcacatagatagactatgtcagcgaatgggtttggtggtagtggttttgagattgtataaatggcacttcctaatacagaaccttagctgtattagagccctaaatttttacttatgtgcagaggctctcatttcacattcaaaagactgaatgtgagggtgagctattgtttgaagtctgtcaccttttttccaaaggaaaatgttttaggatcattctgaacatagaaggaaaacatttcagtgatggactaatttcatgctgtggttgtcattaaatctctttccaaggccagtcattaattttgttaaaataattttttaaaaatagtatctttaggttaaataccagcggaactgtcagcctgcaagtctcagagatggatgctttgtgaagtgctacaaaaggatgatccttcccacatcctcatgaatttacgtcacttttgtggaagaacaaggctcaagacagtcaatgccaaagatcatcctgtctccaggctctgctgaacctgccgatcggtgggaaatgacgggagacaatgagtccactgagaggtgatggagaatggcaggcactgagctaagataccttaaatgtgatgcttctcatgctgacggccaactgaaaacaatctcatcattacttcttattatgatatacattttaatttgtttttctcctcaatctgggtatagctgctatgcaaatatgtcttttaaatgtttggatagaggccacgcccatgatgttaaaagttagcaatcagtatttatgtaacttcgtaggtcttgtgagagggcgcaaatctgaatgcatacatcttactaattaagctcattgaagacatgcaataaaccacactcaagatgcagttacctttaattttggtggattgatctcctgttgataagaatatttagggaggagaggaggtgagcagggctgagaaagtgtagagtccaggtcagaaacagaggcgaagagagaatgaaatggaggggaggaaagcaggtggctgggaaagggtgtgggtgcttgctctcccgaagaaaatgacggaggcttaaatatcgaggaaagacgagaggtgattatgcttgtctcagaatgaggttacatgctctttacggaatttcctctcaacttccaacattttaaagttactaataaccttgggaagttatatttatgacaaattttttgctttgaaaccactaacttcctcttttgaatttgattcaaaatccccaatggtatgatcagtttaatttttcgcatgggggtggctggagataggaacacctatattctatcattttctcatatatttatatgatggctccttctaaaagtgaaggaaaaaagtatttaaaaccctgcaatgactgtaacttgcgtgtaaagtaggttgccaactatagtcagcgtgtcacaaagctggggaagccgtggccccgcgtgcagggtgtgagctggtgctgggatgagccggcctagggtactgtctgtgtcagcaaagccacacatctaatcacaccttcagattgattgaattgaaaggaatattagttactgaaataattgatgtagagacacgtttggctccttgcaatgaattatctatctgttattaaataaggtgtttgttttacacaaatgcaggcctggccgggttattttgaaatacaggaactatgaaagaatttgacttggatagtagcgtaataggaaccatcctttctgttatttcataatttctataattgccagtaattatacttgcttcttaattcacagggtacatttgtgggatcaagtttctttttatttttgaaatggagttttgctctttttgcccagaacggagtgcagtggcacaacttcagttcactgcaacctccgcctcccggtttgaagcagttctcctgcctcagcctcccgagtagctgggattacaggcacccaacaccatgtctgactaatttttgtatttttagtggagatgggggttttaccatgttggacaggttggtttcgaactcctgacctcagatgatccaccagccttgggctcccaaagtgctggattacaggcgtaagccaccgcagctggccttaagtttctctttttttttgagatggagtctcgctctgtcacccaggctggagtgcactggcacgatctcagctcattacaacctcctcctcccgggttcaagtgattctcctgcctcagcctcccgagtagctgggattgtaggcacccaccaccacgcctggctagtttttgtatttttggtagtgacggggtttcaccatgttggccaggctgatctcaaattcctgacctcaggtgatctgcctgcctcggcctctggaagtgctggcgttgcaggctcgttttttgttttaagagagaggtttgcaagctaaagtttctggatattttctgcctttgttgattaaaaccactgttcaagattcttcataacatgaagatacagtacccagttcttaagtagtcaatgtgaagtcaacacaaagagaacgacctctttagaaaatcgaaaggggacagaagtgctgtttttcttttctgttgtctttgtttattattagcattattatttttgcaaagtgccgttatgtcaaaggtatggtgtacagtttctcatcctggaataggacaaatttctgggcatcaacttcctcttctctaaagtggggatgataatgtcacacacctcactgggttttgacgattaaagatgtggagtttttagaatagtgtctgatactcagtaagagctccactattagctatcattgttaatattggaagattacaaagactatatcaattacaaagacttttacaatataagtttatggtcctgaagaaaaatgggataatggaattatatcacatatttacatcatttaattaaatatggtgtgttttcatatacccactccacccccatcttatatagtatttgtgttttttgtttaaaaaaatctgttagtcaaaataggtatttattaatatgattaactctaatagctaatcatggtaaggccggttagttcttccataatcagacaaaattaaaatacctcattactgggttttgctgcattgctgtcctccttgggggtcctaggatctgtgggggtggctatggggtgttttaggcagttgggtttctcctcctcctcctcctcttcaatgtgcaggtgtggggtgccctctgacccatcgtggccacaccaccaggcgtctccttcctgaggttctggcggccctctctggatgcctgacacaatcccctcatagatgccctcatcttcctctccaatgaccggaaggggtacaggcaaggaacccacgctggtgcacgcagaggccacaaaattatcccctaggacttctggtgcctttttagggtctgagaagccccttctcatttttctcaactctgcaaagttgctttgagttgtcgttctgggatcctgaagaggctctgcatggtaaggctgggctgcagccgaggccacacccgcgtgagtggaaggtgattcggcaggtgcagtcgctggggacaatgggaggaggacagcaggttcctccttaatttccaggatggcgtcctctaggatggttggtttggcttggtcagctgacaaggttaaagcaccaagcttctccaattcacccaagaagttgtccaggaaacgaggtggtgttggggccaaagggtttgctggtagacatgaggctgtcagggacaaccagccctggccagttccctggagagctcctttatctgagccaggtgagactttgtgggtgggaggaggggctggttcactggaagccaacttggaaatgagcacggattatgaagttaagaaaaaataaactaagaaaataataataatgcatcaaaacatagcgatggagaaatgcagaaaagatgcggtggtgaatatgaaaataattttatgtttaacatagatttgaagacatttagaagatatctagatttgaaggtattttgctgaaatttaaatacataaaatcatttatgttaattagaaaagttacttcacaaatgaaactctactagttttggaaggggtcttaaatgtcaaacaagataaagatgatatagagattaccaggacagtaaaaccttgagagatttatttttatttatttttaattttttaaaaaattttttagagatggagtctcgctgtggcacccaggctggagtgcagtggtgtgatctcggctcactgcaacctctgcctcccaggttcaaacgattttcctgcttcatcctcccgagtagctgggactacaggcgcatgtcaccagtacagctaatttttatatttttagtagagacgggtttcaccatgttggccaggctggtcttgaactcctgacctcgtgacccacccacctcagcctcccaaagtgctggggttacaggtgtgagccaccgcgcctggcccttaagagatttaatgcttacttactttaaactatgttgaaaagatattacaggtttccagatactgacttagtagagtataaatgactccagagaaatgttaatgtagaatgaaaactaatagtgaagtcattttatttcctgaatgtgtgtagtgttctcttgtcctgcaggatagcccaatcttttaaacgctgacaattttctcacttatgtttgcaaggtgattacaacatatgaataaagtattttagatcattatatgttaacaaatttctaagtgaataagttctgaaaactatgtctcaaagacaggaacccatgatcagaatgaagctgagcttacataactacggcttcaaagttttaaaaaatccaaagtaaatatttacatagaaagctcatttgatgctaacgggagggaggacttctgcttcagctcccgttctctttcaaagcttgacatttatgtaaatcagaggaggtatgagttatgaagcttaatcttctgaagtaaaatatacttacttctacatacgtagtattactgatgtattttggatatagtaaatgaaacaatacatttgaaattttatgcaaaggtattaaaagtagttctgataaatatatacaccccatatgtacccataaaaattagaaattaaaaaatgtagttccagaagtgccacttactaacattggaatacgtttatctacccttaccggactagagaaaatgctacctgctatgtgcctaaaagccttgagaagggacctttcactttaggtctctccaggtagatgtctttgatttggaaagaaaaacatctccaaaaagattctggagatacactttccagctgattgtttaggataacactttacacagggaagcagccctcttgctcctggggacttagtgtgtgtgagtgggtgatgcatttcctacttaacttttgactcctgtgtcctatagtaggagtggggtattaattagatttatttagctttttttttttaagtcatcttatcgtgggatgacataaatatcacaaaactcatgtgagcatcttaatacaggattcaggacctgggctgcttagctgctgacacacagtgagactgcacgtgtggtttgcgcctaggtagacagccactcctgttaagtcctgtagatgctgagttttcaatgatataaaccactcaagtctcattcagcagtctacagaagttcccttactagctagagttctagtttataccccttgttacataacacagaagttttcatagttagatttggaaagtctgtgaaatatataataatttcagaccatcaggtttccactttcactttctgttatgccaggaatattatgtagatgagaaagaaagatcttgaattcccttgtcattactgccaccatcaccattgctatctgatgctgcgactacgctgtgccgtcaccaccacagtcaccgaaatacatgtcagcaggttaaactgcttagctttatgatggacttgcttataccgaaagccaaatgaagcatcctggtataactagatcacaaacctatacctataatacaaaacccatacaattattttgttttccaaaagcatcagaattggattctaatgcactaaaagcagaaatatcagaaataaaatcaacatacattttagtctcccctaagacaaagacagtatgtcaagaaatgtgatttaaatgtgtcaccagagtgatttataaattattaatgagttctctgtttgtaaatatcagttagaaaataggttctgtagcgtttagtatattttggatgttatcatttagaaatacattatatttatctttctaaaaatggttgtcacttccgggaagttttcttcattaagcctgtgacatcacagcatggattaccagttgggataaaaccattaagtatttcttcctaattatggacataagcttctcaacatattttttccccagcagtgagcaataaaaaactggttattagtgaaatttgtacatgcctctgtttaaaatctggtattactttaaaaacttgaaaatatattcaattacagttaaattgtattcacatcaaagatgaaaacattgggatcaaaaatattatattgccattaaatattatattaggacatatggaagaatttgttagatgtttaatgagcttttgtacatacatgcttttcttccttacaacattttatttgaaggtacagttgctttgaaatttctgtgatagttatttaaagatgactgaatggtggataagacaaatatatgcatgaagattcttatcttttctctttatcaatagaaaatactgaaggaaggatgctgatctgtaaatgctaaggtctggtaatgaagtaaatatacttaagaagattctggaaaactataaccaatcaagcaaacaaaattggatagtaccaaactcttccatatattatccatgaatacagggttgagggtaattatttgcaactgaaactcagtcttcaaagaggatcacaataaataaaatgccaagacttcagccttctaaaaaaaaatgcctctcttaagatggcagattcttagatcatttcctcatataaaatccttctcaggctcattttcaagaagtagtttaggtcactgggatgctatcttgaaacagttttttcatcggaacatgaagtgacttcacactttagtaacatctgatatgttgattttattttaccagctctcgatggtttagcttttcatgtcctagccttgatctcaattaaaataattaataaattaggcaacttaatacattttttgaatgttgagaagtacttaaaacattttggaagtcattggcaatttaaagttttattcctagaagttaatgagaaaaaagacccttacatgcctttcataaaaagaatataattcatcagaaaaataagaaaaaatttcacattgtgagtacagacaaatagcctttttacattcaccaattaaagaagcaaagcctcttttaaattacgtattgagaaagataatcatctttagcccgctcaagtgaaacagtagaactggcatataactgtcctaaaactgataaaacaaacttgaggacttataataaccgacaacattttcatttaaactaataaacatcttgacttatagactctaattaaaaatttttgctctagctcattttccatataaaaaacttgtatagatttgtcaacctaataacccggtgttcttgtgatatactattttgagatatacatagtattttgtgttgtgtatatttatatttcaaattataaatcacaattgtatatacatgtatgaatatatgattatatttatttatatgtaaagattatattatatacataaaatttacatatataaaaatgaagctttaggaaaaaattatttcagaaaacatttatgtacacaggagtacagatatatatcatacgagacttcatgatactctcgttttctctttctctttcgatattttaacttgaaaatgaaatgagcaaaattaatcattaaatctttatgccagcacctatttgagaaacactgacttatatttactgatgtggcactcacacatgtagaaacataatatgtaaatctctttctctgcaatagatatgatattctaatctaatatcctaaagtcacacaccgattatcttacttggagcttccaatattacattaacatgatagagtatgttcttaccttatttgagctcaagctgtgaatcctatcactagaatagctgtggggtattggagggtcagggtagtcctcagcaccttttgtgttcttcttgacgacctccacataggaaacagggaagatgccttgtctgttggttcctgggattttaccttcataccagttttgatcaactcttttaagaagaataactctatctccctgttatgaatatgagaaaaatgcattagaaacagagatagaataacatgaaaatataattgtcaatgttttctatgaaaaaataggtttccatttgggcaggttttataccttcagtttttgtttaatcaggggagggcaagtaaggtactagtgcttactagaaaaatacacatgatcaacatatatgtaattgaaatgtccattcaggccatcagaatcttccctaaggatgcctgattaatgtgaacgggtttatacttgtttatgctggtattgtgtgaaattatttgtctaagttatttcaaaaagcagaatagtgtaaaaggtaatgtctcaatgacaataggattattttatctctggcaggttcagtgcattggccttctgtaggaagagcttcagaaagtgcaccatagcttgctgtgagggtctgtctgaaatgggttacagaaaacacctctagaagggagaacatcgaatggtacaccgttttctttttttatttctattttttttttttttttgagagggaatctcactctgtcacccgggctggagtgcagtggtgtgatcatggctcactgcaacccgcacctcctgggtttaagaattctcttgcctcagcctaccaagtagctgggattacaggcgcccgccaccaggcccggctaattttttgtattttagcagagataggggtttcaccatgttggtcaggctgatctccaactcctgacctcaagtgatctgaccgcctcggcctcccaaagtgctgggattgcaggcatgagccactgtgcccggccccttttcttctttaatctacatgcgctaagtagtgacagagtgaactaaagggatgggggaaagagagcgccctagaatatcaatagctgtgacaagactggcattcccctggtcttcaccctgacaatggaaacccagcatccatctgagtagttggtgaccattccatacttgtcattaaagatttgaatagaacccttggctttcacaatgatagaactttctagaatcacttccacctgccatgaccgagccagtgctgcagaactcagtttaaactttaactcaaaactacacgtagcctagaagtaggcaggcaagttgatgctaccgggcaaaaactgcagctgcattcagcaggtgatacagaagctcgggcagcggcacctgatggtgtgatggagctgaaacagtcattaatctcagcccaacagggcacccttcttcaggtgctacccaagaagaacttcgaccttgagtagcacttggaagttctctttgtgttgaaacgctggatggttgattttgtgtgcttcaccaccgctgagcagaacatactcaagaaaagtcagtctcaggctggatgcaatcgctcacgcctgtaatcccagcactttgggaggccaaggcgggcggatcatgaggtcaggagttcgagaccagcctggccaacatagtgaaaccccatctctactaaaaatacaaaaattagccgggtgtggtggcgggcacctgtagtcccagctaatcgggaggctgaggtgggagaatcgcttgaacctgggaggcagaggttgcagtgagctgagagcacacattgcactccagcctgggtgacagagtgacactccatctcaaaaaaaaaaaaaaaaaaaaaaagtcagtctccccaaatctgaaaattgcaccgattttctagtataccaagaacaggtagttgctaggctgttgtgtgagctgtaagaggcattggtgaagcctttctgtagaacatggaacaggagacagagttcatgtaatgctctgtggttctcatgctaggtggggcagcccagaggataggaaagaaggaatcggctgatgatgcagaattaagactgatgggagagaatgagacaaggttctgccaggaccagaacaaaccaggactgtggtattgctcttcatcgcacctggctaaggatttcactagtaggtgtgggaggtcctagagccactctaaatattactacctcgcctgtgttgtgtgcagaggcagttacctcaaacaaatatatgtcatatttagaaagcaataagaataattcatttatcattctcaattatgtaaactagcaggttaaaagaggtttttgattgtttttttgtgtttttttttttttttttttttttgagatggaatctcgctcacctgccttggcctcccaaagtgctgggattacaggcgtgagccaccatgcccggcctcgaggcttttgatattattaagaagagatactaggattggatgggctgctagagaaatttgggtcaattatgaggcccaaagaaggatgatccagggaagagcactgcagagatggctcttaaagcggctcccccaagaggaaggatcttctttacctaggaccattcctagattccaagatagaggaagataaggattggaatatcttgtttttaaaagactgaaaaataaggcagcaaaacaacatattttgaagtgtatcaaactgctttttccttttgtgctcccgaatgtataagtccttgattttcagccccatgcccggcttcccagactaagccacagagggagaagcctggtatcccacggggaactcctctaaaaggacacagggaccagcagggaaccgtgactctgggctgccttaaagagtcctttgtagaaaatagggtaaacataaaaatgtctaaagaaaaagataacctattttagttttgaaaatatacagccttttcaaacccactgaagaacaaacaaacaaaaacaaacaaacaaaaaaccagctgggctacctttctcagtgacagctccacatttgtgtctgcgttgaagttgtatttggctatagcttctccgatttctccgggctgggctggcggaggtggtcttgcaggctgtgctttctcaggaggtgtgagtttctatgaaggaaatagtcatttattctcaaatctgcggtgacctttgaaaccaccgccatccaagagagaaagggagaggacctacctctacgtatgagatcgggaagatgcccactctcccgtggtgttctccctcataccaattttgatcaattttcctgaggatgtagacagtatctcctttcttaaatgacaactccctggaagagacacgttgacatggtctttttgtgatgtacagcaataattctcaagatcaacaccctcgctagatctgcatttgtttggcaaatatacttacaatattaaaaaatccaattgatattgagtccgattagataagaatgatccttgcaaattcttagaatgcacttaaaacattataactttagaaatgatttcaaacagagtaagtataaacattccattggatataaatcacagacagattaataagaagtttaaaggaggggacagactcttgctactttaccattagttcagagaagaggcattttgaagcttggaaaaatgatggaatagttctgcactgattttttttttttttgtcctgaagctagttggctagttagttactagccccccagccccttttgatgtactgaagcttacatgaaggaaaacaaatatcatgtagcctcagaatagaagtgccaacaccagaacaaattttatttgtggatctttgaagttggttgacaggtattttaatagaatatcttgataaggaatttattttgtgtaacagaaaagatcttacacttttaattttcagtggggcaagaagaatgtgttttaagtgcaaagacatatgccaatgcttgcctttctatcttttatttacaaaaaataaaaatatttttaagacactatatttttcaattttggctgtttctaagaaaattgtaggtatatttgatttgggtatttataattttaagttataatgacattatgcattttgaataattcacacctaaacttatcaccttcactacatcaatttttcctggcttaatcacccaggtgattaggttggttcattattttgcctccgcaattattcttggatggagggcgattaatttgtatcttctcccaagagcctcattttgcaatacatctgccctcccactctggaatcttctgcattgttttgttcagaattttcattttttaatctttttttaaaaaattttggttcagaattttcagttggatcatttattagtataggccgtttgatggagagagatttatacctgatggagaacacttctcattgattaaaagaattaatcgaaaaaatggtggtatattaaaagaatgatcacacatttagaagtgctaaaatcttcacaattgaaaatgtgttaaattttcagtaaccctaaaaacaaagaagattcatggagctttacattcaaatacagtgcttccttcttttgtgcaaatgcctaatgtaaaaaacagaaaacaaagcaaagcaagatatttaatgttcacaacacaacagtttcatttgtactaggtatgttttgtttctggaaatgagactagctttttaaaatataatatgaacatatgaatcagaggcaaccaatttttcaaagctatgaaaaagactcttttgtatttgtataggttgcatttaaaattttgaagtccttaagacacaggaaagtcttactcttaagttttcaaaactgtgtccctctcatctcagacctagaattttaaagtcccatttgcttttttcccctcacttttatttttatttgtttttgagatggagtcttgctctgtcacccaggctggagtgcagtggtgtgatcttggctcactgcaaccttcacctcccaggttcaagtgattctcccacctcagcctcctgagtagctgggattacaggcacccaccaccacccctggctaatttttgtattttcagtagagacggggtttcaccatgttggccaggctggtctcgaacttctgacctcgagtgatccatctgccttggcctcccaaagtgctgggattacaggcatgagccaccgtgcccagctgctttttaaaattaagacttctcagaagacctcgtgagccttgggtggacacccttcctacttcacatcccctgccattcctcaggtttttatatatttaagaaagctatggattgatttttacaaagaagaaatgaaacgtgtgctccgtaacattattttataaaactgatatgcattgtacaaattgtcacaccatatccacagaacagtagttaggaccggagtacagtagaaacaaagcatcttatttctctaatttgaaaaaaaaagatgtaagcttttcttcaggccagatttaagccatgttcaacatcttaatttctaaacaggatttttcttatctagttcatttcctatctcagcagcattaccaaattctgagtgatttatttatatatgtcttctgccagagacagtttctagagctattaactcatattatatgcatttttatgagtaaattattttggttattatatatatatatattcagtgtaaacaacatataataatttaatgacaatttacaatgaattcaatatctgtcttgaattctactggagaacaaagtttcttaaaggtctgtgcacataggccacaaaaaatctgggcaacaccctcttatatataagtctgcttatgtgcttccgcaaccacatgcctatctgctgagcaaagaataaaggcaaaagaaatattgcaattcaggatggtgaaaacaccgacaccaaaagaccaaaggagaaaactttgctcagaatctctgagctttgcaggctgaggatggagacttcaatacaggaatctttgtactaagttctagtcatcaaccccacaaactatgcttggaatatttggataaataaatgttatcaaattcccccagctagtgttaattactccccaatactttatttatttacttattcattcttttttttgagacagggtcctgctctgttgcccaggctagagtgcagtggcgcaacctcagcttatggcagcgtctacctcccggtgaagcgatccttttgcctcagcctcctgagtagctgggactatacaggtgtatgcccccatgcctagctaatttttgtattttttgtagagacatggttttgccatgttgcccaggctggttttgaactcctgggctcaagccatctgcctgccttggcctcccaaagtgctgggattacaggcatgagccactgtgcctggcccccaatacttcattaattcattattgacacaaaattctaaaaacaaatattcctaaattctttttgtttttcctatcctttagaattcattgtgttctacctaacatgtttaatgtaatttaaaactcagtaattctcaactaaacttaaaataaaaggtaattctgaaggaaccatttaattagagtagattgctgcattgggaattagacctcatttgtaacagatcctactgcaatgcttatctcttaaagcattactaacatttaaaaccaccttaaatcatatgatgagtatttatcttacttacttagatgtctgagccttaaaatcataaacagcttttgcaggcaatttctgaaaaggaagataaacaattagcactaatttaaaatttgaattttctacaagaaagtagtttaatgtgccttaaagaaaaaggaaacctcagggaatcatcaaacatatgtaatgttaatcctgtaagcaatttataaataagtccattcattcttcatttagatatttaagctataataggaatataatagaaggcttattcaccatcatatttaatcttaggaactaaggtagattaatgttataatgagagaataaaatgcctgcagaggtttgcatcctaggcatcattttggctgttacaaaggctcttcctaggataaatgtggagggtcaatggctctatgttctatggagattgacacagctccctctgaatcataataaaaggaccagatgtcataaaagaagtaatcattcccttcattagacacttattaacatattagcaaaaaatattagctcaattatcactgggaggctggttagtgggcaaaagtataggtgtgatcatcttgcattccctagagggctcaggaatccttcaacactctgtccaccagccactcgtcttttagttgtgatgtgatgtgacacgtgcccatcctcaaactctgggggccacagatctccctgaggtaccctgtaccctatagctagctaggccagctcttccttcctcaccaaccaacaatcccttcactccattcttttcccccatgactctggtgaactttaggaatcctggaccatttctaacttctttggggatcccacaggctctggactacatcagacgcctataagatcctctggagcggctaccagtccaagtccagcttttagtttccatccagccgtcatggctccaaggcagtttgagcaagaactctagccccggctcagggccctggacagagttcagttggtgggtggttcccaggggcagtatcccgagaactgggctggttaaaagctctttttagggatcctctccaataaaaggaagccagcaaaaatgatttctgtaggctctgtattgatttacaacacagttgacatcaggctttctcctggaccagcgggccaagaaattgtagaggaaacctattgcctccacgaggtgccctaactcaggacacttttaggtcataatggttaagttcatgggcatcaggtcaagactcggagaagcctcatggccaaaactgggccaccactagggaagacccacagctagggtcagggtgtggactgcttctagggtcagagttgctatgctcaggccccaaggaaaattgtttctagtttctcagtattttcacatttcctgtccgagttcgttactggtttgggataatttttggctggtaagtgctgtatcaagtgtgttgctgtgaaagactccaatgctattaaattaactacctctttttctggagttcctcttctttcccttggtgcacttctccccatgtcagtcaaagtggatgagtaacttctaggggactcacggtctattggaaagaacagggccagtcatggtgagtatccacttaattacaagccaacctgttccgccattttccctggtggccactacttttttccccaaatttggagagacaccgttatcgaacacatgggcataaaactcatagttcattacaaagttgtgaaataagacacaaaacaagagcatttcaaaaggaaaaatatctgaggttgcagaattataattgtctatataaatatgattactacattgctgattaattatattgccacacccagtaagacaatttatagttagagggatttttcatataaattttttccaaagctttctgtttctatgcctttgcttcttatttataattactattataagatttacagaggatggagaatttgaaaatagcaacaatttgtagaaaaagaaacattttgtggagtaatttaagactgtagtaatgaaaaagaaagagataaaaccaaagaaagtatgaggatgacaggagggtggtgatgaacattctccttctgccttactctcccctcttcgctcttcctctgtttttaaatacttattgaatctcaagatgccatgctgtttatctacgaccttcctttgtgcccagatgataaacaccttatcagaaagcaaagaaacaaagagatattgtttcttcttactccaagcaaaaaagggataaacagaaagcatcatgtcagttgccaaattgcttatgaaatattgaattatttttgttcatcttaaagcaaagcataaataatcacattacaaaattttgattgcatgtagttcttaatagtatcttataccttttgcacttacgtgacttacatatggagatgtaactagacattaaatgtattccagtagtctatgttatagaattttatcagtacaactgggtcaatatttgtcaattctttcttttatcccttaaatatatctagttatccagactaacaagaagcattaaaaataaaatttattttatccatctatgaaagaatttaaagtgctgattcataataagaaaacattgttttaggattttgactactttgatgatgtaaattctaagttaatatacttttatgatcatagggcctcataatgatcataaattttaaattactttttctaacccagggaatataagctatttttcacttgggtgaaacacaattggaaagtaaatattttactaaaaaacaaaatacttttaaatgcatttcaaagcccttccaagttacgtttcaaaaatgtactcctatctgcacataaaattgagagatggttatattaggatattaaaagcctggagaaggtagctaatttattaaaaaatgagattctgacacatttcaattagtgaaaattttgaattgtagaaattgattttttaaattctaatttattattttgaagcatgttgcttcagcctaagggtaggcaaagataaacgtaagtgtatagtgtagcaaaagtgaaagcaaacataaagactaagtagatttgtgcaagttaattaacaatcgagccatatttgacactagtatgaactgtgaattatgtctttttttttgtctgagattatattttatactataaattctgaattattaggggtttgaatctcttttctgttatctactctctgtgtgaccttggacgaatttcctttcctctctgggcccaacttccaaaattgaaaatggcttttgaaataacacccatttcataggcctatgccagttttattagataatgtatgtaaagcactctgtagtgtctggtgcatagaagtttctctgttgaccaactttcagcccggaatgttcattccagcctcttaaaatttacgtagtgaacagatgtgctgtaagaattaatgaaaataattggtcacaaatattaaaacaccctgggctgtaagttatataaatctcaaaaatagtcctctgcctttcaattgctatttattcttgtgttgccacttcaaagttatctatgaaaatagagtttagagtcactgttagcctgaatagtgtaattcaaatttcaatacaggactgttttagcagaaagagaaagtgaatgaattaagtaatggaaaagagaaaatgaatacactaaatggtggaaatgggacttttatatatatagcttaaagatacattcacaaaaattttatcaccattgtgtccttgaaatggagaaagctattaaacaaaccctaatttctttgtgtccatcaattactaatcacatatttcagttttgcttcttgaatgttttgatatagtatcttctatatagaatgtgacaaattatttattaactgaatgaatataaagttttaacgttaatataaacatttttaaaaggctatttgtggaactataggttttgattcatgtcacaacgtaatttattgtctcaatgtgagtagtggttgtttcaaccctaatgctgagctacaaaatggccttccctctcgttttcgaaagagtaaatttttgtgaattgatgatcactttaagccacacatcaagtccaaatatcacatgggcaaatgagaaatattcagtaagacatatttgcacaacaagtttttgcttcacaacacataacgacgccaaatggtctcccagctcgggagtgatgagatgttggaatggaaaatgaaagagctggagggtgggtctctgaaccacaaggaaaaagaaagaaaagctcatccaccttggagtgcaccgccacggtcttggtggtggcagctgctgttggctgtgtccacgtcttggaaagaggcactgcggggcattctcccgcagtcattctggtagggtggacaatgaatagcaccatcgggaggcagtgggtggagaggctggtgcagggggctcctcctcagcgctctcagggatgagttcctctcgggaacatctggcagcagctcactgatgaggcggtgcaggatgctgttgtccggcaagctcccccttttcttttcagctttaatttggtcacagatgtctttaagggcagagtccagagcctcaaacacagatgctttacattttgccttttcagtctgtttcttaggagccgaattttttttcctccggaaaggcacaggactgactagaaaagcaagtttagaaaggccagggtccatttcttgccttctgggctcctcggtgttttcgtgtctggctctttcgtgttttaacattgtggtaaatcgagtgtaggaggccgggcacctgcctttgcaggagctgatgaggtggcggtggtggtggtggtggtgatggtggtggtggtggctggatccgtaaaagctttcggaggatgtgaaggaaaagtgatcaaagtcactttcactgcagaaggatgacccctctaggtgaatgtagtcactgtggtcggacacaaccccgtcctggtcgctgtcggaaaactccacgtgtgctcggggctgctcatcgctggtgacttcaatgtgaatgggcaccagggcgttagactggcagcctcgccggccccgagcgggggggccgctttgattttcttcctccagcaaatactcaatggaaaaccgcctcttgggacataggccattttgcggtggttctagggttacgggagacagcatgtcatcccctaaatttggcatggatttggacttctggatcagcttttcgaattcggagatgcgtgtgggcaccatgtcccggggcacctcctccgtggagcactggctccaggcgcgcagcaggtccttgtgctgctgctcgctctcgtactgcagaatcctggacttcacggagcagatcacctcggagttcatcaggtccttgcggttgatgcggtgcattttcttgtacatcttcaggaaccccggggcgttgcgggctgacctgtgtctgatccttgatctgccgttactgcgaacctccgggacgtagggggacccccacgccatggggcagctctccttggagtcctcctcacataacagggagcccatgctttccgacttgactttcgggtccgggaagctatcgcagtcgtcgtttaggagatcgtcacagctccgggatttgattttgggagagacggtttcttccgtgctgctccagatttctgcgttttgccgggccatttgccagccgttcttgaaactaatggctcttggtgagtcccgagggacatccaagtgctgtctgtaagtgctacagtaatctaactcactggaggggttgccgttgagccctgagtaactgcaaagggatggacatattttgctatcatccccaccttttaatccagagcagcgtggtagaagagagacatttggagaagttaaaaggttcacaaagagaggagagcatgtcagtaaagcatcagacagcatagcaaggagaaagcagttagtgtgttttaatctaggtgctgattgttcacacatggagcttcaactctagagaagaaggtctaattctaaagcgagctaatactttttcagtgaatgtagctttgcagagagagttgacaaaactgtgtataagaagcaaccgacgtaagcaaatacacctactcctactgcataattcatacacctttctgacaatattgtttgccaaaacacaatagtgctgcttcagctgatagcatgatctggtagtgaaggtttaacaattagtgtcaaaagtgttatacccttacgcaatttaatagggccggaatttgagcctcatttgattcgtaatgatacataggtgaagaagggtttatacatttacatcgaattaatactctcatgactatatcaaataattttttgtgggttttagattttaaaagctataaggcaaagtattctccaaaattgcaaaatcaaaatgctgtgaactattgctgctaacatttttctagaaaaaaatagctaaagctctttaaacaaacgaatttacctcttaaattgctctacctttaaccttttattaggtacaaaattctcataggaaaactgaatataatgcaaaactttcatcagaggtgcatataccatgctttttttctcggaagagttctttgaaaaatcatttgcaatttgataatagagatctacatttggcctcaattttgaatagctatggaaatgttcttttgctttgctgagtcaactaataaatgaggagccaaattatatctaataggacattttcttcctagaaataaaatctaatggaggaaaatatctctattcaatacttataccttacaatgttctctaaattctttaaaagtagataagcacattaggtagatctgtactgtctgggaaaggaagttgatttaacattccctgtgatgaaacaaatatctacatttatcagaacccttttaacttttggctagtatccaagaataataggtcaatggcatttcatgacctacttgttaccttaagatattcatttgaataagtgagttgaatctgataaggcatctctgctcctcagaggaaagatgtgatggatggggctcacacgccctgaaccatcagctgatatcacagctttacaaggccttaaaagggctaggcatccacctactcagagtccaatcatcacgaccagaataccttttgcacacaaatcagctaccacttttaactaccatgtggcaatggttttagtgactatagttgataggtgtagctgaattggtctggttttatagaaacttacattagagctcaatttctttacacatttcaaaatctctttctcttctctttcaatcccaagatattagaggagattgtggggtcccacatttggtagagccctagctccctgtaggggctggttcaatcctcactctccatctcagaaatattcctgtcctcaaggaataccactaaatggtcttccagaaaccagaaggagtgacttctttcaacagtgagctccctacacttgcagagaggagacgggccatccagaaaaaaaggcttggtgattcctcagtgatatcattatggtttgggaccaattagtcctgactgtgagctgctgtgaattgaccactgtgttacatggcaggaggtggatgctccactgttcatgtgaaggtggcccaaaatatacagcaaatggctaaagaaattaataggtcggatttttttaaaatctagaattgaataattttttaaaaccctccaaaccaatgtatattttagccaacaatttgctctgttgctgcttgtaatttttatcctataaatttgactaatttgctagttgtagaaacattagaaaattttgactatatgtcaatgtttacaaaatacatcttttagtagcctgatgatacattatttgatactttcaatttgtttagaaagggatctatttgggggaaaaaagcattagcagatgctagtcagagttctttaagcaacctaagtggctcgccagcttgagtcagtctgggtgggaagaaggctattgttctaaaactatattttattccagacactgtaggtgagagctggcacatgccactatcactgggccagctttcacacagtgctctaggctaaaacgtaaactagtaaattgttgtgttttcatttactatgctcaccttttgctcttgatggggaagaaggagaagagctagtgaaagactttgtaagagtggtgcttgatcctgggaggtccactcggcctgggctagtcctgctcgcactttgatctcccaagccccgtggtggacccactgcaggctcgctcttcctccgcttcctgaagtcactggccatgcttgcagaactgaaagaaggaatcagatctgtttgattggcactggaggaggttcgggtgtgcaccagaaaaaccggtggaacgtgctagtgacaatggcgtaactcctaaacctctatccccaaaactgcattgctaggaactcatcccttgatgttcaacatgatttctctagaaggatcttttaaaaaatgaatagaccttattatttattttgagatggcttctggctctgtcacccaggctggaagcgcagtggtgcaatcacagctcactgcagccccaaactcctgggctcaagggatactcccgcctcaacctcctgagtagctgggaccacaggtgggtgccacctcacctggctaatttttttaaatttgttatttatgtagagacagagtctcactatgttgcccaggctggtctcaaacccctgagctcaagtaatcctcaagcctcagtctcctgaagtgttgggattacaggcgtgaaccactgtgcccggacaactaaatttttttagggcagttttaggcttacagaaataatgactggaaagtgtagagagtttccttatagtccctttcctcttgcacagtttcccttatcatttacatattcttttggtgggtacattgtcacaattgatgaatctttcctgatgcgtcgtcaccccaagtccatagtttacatttgagttcatgttttgtcttaaacattttaggggttttgagaaatgtataatgatgtgtgtccatcattaatgtgtcaatcatataaaatagtcttcccgccataaaaagcttctgtcctccagcttttcatccctcccttcctcccgctcatcctggcacccactgatctttccacacggcctccacagtttcgccttttcaccatgcccagttgatatcatgcagaatgtggcctctcaggttggcttcctgcactcggtgatacacttttaaggctcctccatgtgttttttgtcacttgatagctcatttctttgtattgctgagtcacattctattattacatggatgcgccacagtttatgtatccattcacctattgaaggacatcttggttgcttccaacttctagcaattataaataatgctcctaagaaaaccacctgctggtttttgtgtgaacctaagtttttaaacatctttgaacgtcaaaattctcctatagtgtaatatgttgattgagaattcagtgctataatttgtatcttgtatcttttctctataaagcggagttctaacaacatgaatatatccagaggggcataccaaatacaggaaataactgaaaaaaaaaaaagacatcaagagaggaaaatctctctcacctcaagggttgcctgcagcttgtcctatcatctctatcatcttagctttagaagatgttatattggaattccaacattttttatttaaataatgaatgaaggctgagtatgatggctcacgtctgtaatcaagtactttgggaggccaaggctggaggatggctcaaggtcaggagtttgagaccagcctggacaacctagtgagactctgtctctacagaaaataaaaaagttagccagttgtgtcatgtgcctgtagtcccagctattcaggaggctgaggtgggaggatagcttgagcacaggagtttgaggctgcagtgagccatgattgcaccactgcactccagcttgggcaacagagcaagaccctgtctcatcagtcagtcaatcaatcagtaccagtaatctggtcagcaaattaactattaaagattccttcccctcagttgcataaaatactgtcaatagtctagaacagcagggagtttctgtcatggttttgagtttgagtacagtatcatttaagaccaatgttaatgaatgaagccacatatggcacagcacactgtgcatgaaatcactggattcttagacaagacttgtgtagacaacagtgataatagcaacagcagcaaccccagctcctatggagcccagcagaatgctatgtgctttctttatgtttttgtcttatttagcccacacagcaaaccgatgaggtatatgctgttatctcagttttacaaatggtaaagtgaatacatgtgtctgggatgtacggaagcaagcggagaggcagacctcagaactggtttgtcctcttctgaagaggatgcatctcctagacctgtttttgctgggactgtcctgtcatgtgagggtctgtgtgtctttacggcaatctgtagattagattaaaactctaaaattcaaatattttaggtgcatagatagaggcagaagataaaaaggaggggttccagagttcctttctcagggatgttattgcagttggatggcactcagaaacccaatttatgattgacccaattcacaaagaaatctacatagaagggtaaattaatgctactagataaatatttgttattgatgttacaatatggctgggagtttgtattattcaatattactattgaactatgtctgaatatgtctgaattttgtgatttgtttttttttttttttttagactgagtcttgctgtgttgccaggctggagtgcagtggtgcaatctcgactcactgcaacctccaccctcccaggctcaagcgattcttctgcctcagcctcctgaatagctgtgactagaggggcatgccaccatgtctagctaatttttgtagttttagtagtgatggggtttcaccatgatggccaggatggtctcaatctcttgacctcatgatcttcccccctcagcctcccaactgctgggattacaggcatgagccaccgtgcctggccatgaattttgtaatattttttaaaaagtgtgatatttaaagctaatggaacttacttcaggcgaactctgagggaagttaggcctagcggtgacaagctatcttgcctcaatttcttttttttctctctccttgccaactgtgtaaacttggtaagttactaagcctaggtgtcactttcctcagagataaagtggggacaatagtatttaaccatagtgttttcttaggattgaatatgttttgtacttatgcctcatttattggtagtattaataacagtatttctgatttgtgtggtcaaagtatgattaacaaatacgtgtataacactttttaatctataatttttttcaaatatattattataagggccatttaacaacattgaaaattagttacttataattcccatctaaagaaaagaaaactgggtataggggactaagggaagagaaggatttctcagtctgtgaaggaatttataattagttcactaattttttagaaattcttgaaatgatcatataaaatgatgctgaaacaaaataaaacaacttcatgaggcatggtacttcaaataaaaatgagtgatacatgatactcattactacttcactgaataattttattgttgaaaaagaaaccactggtatagaatattctgctacaacataataagattcttacctcatgggtctttccaggcttctgtctatagaggactgatacaaggaggcctgttaagataggataatagtaccatgaaaaattttaccgtggcaaaattttgttcacttgtcaacattaaattaggtatcctaaaaagaatattataaaaattgaggttgaaagtaccattcattatgactataaaaatgtcttcccaaagagagatcatgcgacctgatttctacttgggacctatctgctttcccttctgatataatgcattgcagttctctgtgtagctcaaattatccacaacccaagcattgcatggggggaaattaataatattttctcagggacactgaaataagagctaaagttatcctacagcctgaactgcagaatcttacctgttgactgtaaatagaaatttcctacagaaaggaatggtttgatgttttaaaaaatttgtagtcatcattcaatccttataaaacatcacattttaaagtttttgttattgttgttaccaagtattgtcttcagaatgtaacacataagcagaacttaagacaccattcatctgtcaacatagacatgacgtttaaataaaacccacagagtttgacttgaagaaactaaataaagtacctggtacttcaatcaggtaaatagttatacttttacaattaggtgagttcagggctagtttaaaataaatgagctaatgaagcaaaatataacttttttaaagtgcgcttttaaatttttccttcattctgaataatacactgaaatagatagtaagcaaaaatgataatatgaattttttattttccatggcatctgctgggataattgctaaaatatctaaaaggcaagagaggacactgagctatcaagtgtttgaggtgacactgtggtatgatgtccagaaagcacagggagatggctgggtgcagtggctcatgcctgtaatcccagcactttgggaggccaacgcgggtggatcacctgtggtcaggagttcaagatcagcctgaccaacgtggtgaaaccctgtctctactaaatatgaaaaacgagccaggcatggtgacacattcctgttatcccagccacgcaggaggctgaggcaggagaattgcttgaatctgggaggcagaggttgcagcgagtcgagatggcgccactgcactccagcctgggccatgagagtgaaaccccatctcaaaaaaacaaaaacaaaaaacaacaaaaaaacaaaacaaaacaaaacaaaacaaaagtataaagaaagtatagggagatgtataccaagtatagatagttttgcctttggtcatatttgatgatcaattcatcacagataaaatttggtttgatgaagaactggaattctagtttaaaaacatttgtctgtatgaaagcttaaaaatgtcagccagaaaggcaaggtttgacaaatgttgtcttaagttgccatcatctagaaacattttatcagagtattaaacatctacttagtggaaatcaaatctcactttacaaactatttctataactcagttttctattaattggtaaattagcaccaattaatcaattaaaacaatacaattttgcaattctgtatgtatatcagtcttacaaggtcccttttgcataacttacgcttctattaactaatattttaatttaattctatcttactaaatgaaaatggaatcttgtctagaaacaaaagcatctctgcatgagaatattcccatcctccttttagacagaaaaagtggattgtaatatttttagttcctagaaaatatttagatttctaggttctcaacaaatataaaatcaggagaaaagtttggtttgctagtctgatatgtgtacatggttattttaatttgctgagctctgaatcagacactgggaaggtagaaaaatagatactaaatatgaaagaaagcaaacaagtaaaataaaatcagatcgttatattacaattaagaaatattaattctactcgtttgcagaagagcgacactgaagagcctgagagcatcggcgtctgtgcagatcacggctttcgtgggacaccctcacacacagctgatcaccaaaaagtgtgaagttcacaacactcttagaacaaccctacagtgatcagaaaatttgaattgtcaacttataatgagcctaaacaatattgtaatgtgaaataaaacatagtgtaagaactgattgtgttttagggttaggctaagaaactactatttctccttgtactggtttctacattcaaaataaatgaaaaccagttttgcggtttcatgtacactcagagaaagttcagtattaaattgtaagataagagtaaaaaatctagattgatgactgagagaaaaacttgtacaataattgtaagaagtgtactcatcccaaaatgaaaattatctccagaaaagaggttacaaattttaccagttatgatctactatttacatattaccattattttaacacacttagaaggtcaatttagtgaagtacagatactgaatcactctttctgttaagtagctatgagattaaattttgcttaaatatccgtaactgttcttcattaatgccagttttccagttatggattaaaatctatgttattcatggtatataccaggcagttgataaacggtagctaaggtaatgtctaatcaattacatttgtttttaccagaaatgtttaataacaaaaggttattaaagacaaaatccagaaccttaagagaatatattttcttacattctgaaaaactataatgtgaaattaataacatagttaacatatgctattagaatcatacagcaccccctctcaatcccagagataactggcaaatagatcaactactggcaaagtgctttttatgtgttgtttttttttttttgccactaccatcacataatagaatgcatagagttaagtttctactatttttatgcccaagaattattgtgtaatattaattaacagaactcttttcacaggaattcaatagttaacaagaaataatattaagtaagtaatttgtttttaaaagatttatcctctaaatatatatcttggaagtgctgaaaagtgtgatataaaggaaatagcacagaaatgaaggttaagagagatatatttttttttctgccactatcttaccatgtgattttggacttatttcttaaaattattgcactctacttttttttttaactgaaaaatgagtgaattggacatgatgcactctaaattccatttcagttatctatgaaccaactaccttaaaaacaccctagaaatatctgagaaaaatatctgaccacattgaatttcaaaataaattcttgggttgttcatatgttgaaataagactctttctgcagatattaaggtaacataacatacagaatataaccccttgttttatttgattttcttcagattacatgcctgcctgcctggctataaaatgtaagcctttagaaataactgaattcaataacccagaatgttcctgattactctattttaccttttatttaatatataaatattttgatcacttctcagttttaacacacactctgatgtttaccacagggtaaataatttgaaattgcaagttgagacgctagaaatttgcatattttcttgagactctatacctgcaattccagtggtcaccactatgtgtcagtagtacctcctacaacacaacggttctactggttgtgtttcccagttgcacatatttaagacttttaatgaaaataagatatttattgtgttatagtattcacttaagaccacagagcaactaatgtgcaaaaaacagtttatttacttcgttcccatgctagttgcttctaagagttccttgcaaggaggcttttatatagctgatggctagcaaaacagtgccatttctgcttgtgtcttctaatgagtcatttatccactttctaaagtaattttctgcttttctttgcagagagcaggttaacaagcttttgactctgaatcatttctgcctgtatcattctctctttcaaataaaactctgattcaaataaaaatatacattggctgccataaatttttcacctagttgattattataggctcttaagtagagattgcaaacgcatttcattttatatgccaatgataatttgttatagtggctgcctggattacagtgttgaaaaggagtagtcatgtctgtcatgggtatgaaactgggaagttgtgatacacaatttccaggtatttgccagccctattcttgactgataatacaatccgtaagttgtatttaggaaaatgaaagaacaaaaataaattttagaaatatatgggacataggcatctgattatccacactccaagcattataatagaatggttctaagaagccttcttgtagtattttactctgtctcataaaaagaggtggttaatatatgcactaagactaatacttttgatttttaattttcacgctgctgaataccagaactacatagaatagtataactagcagttgtggttggaatgattcttcacccagagtccagagatagccaacaactctggtataattaatgtccaggcaatgatactggatgcaacataatgatgcaaagatagatattttttcaaaaatagcttagacattacagagaattgtaaaacacagatgtgcagaatcacagtcacagcctctaagggagatatctgaaaaagagagaataacgtgtttttacctcattgaaaacaccagaagaatgatcttgaacatagtccagaggctttttaggaggctgggtgtagacgcaccacagaagcagaagtgtagggatggaatggaggagagtcaatggcagcaaggaatgaacatgtggaaaaggtgacaacagttagaaattgagtgttgacagcaccagctacacaaacagaatgacatgaatggagcaaaatgggggcagctgggaggaagtgtgcaacgtctgcaaatattctcaagcactgggaaaattggctagtgttcaattagtatatttataaattcattttgtcaaatttcattagcactcctagtctctggccacagaggaatgcaaggtaaattaaagaaacattaaaggagcaagtggatagcatgctggtgagtttccatgtgtgactgaaaatgattatggaaaatgctgataacttaggctcagtacagaatagtccctataagctttctttttgaattattttattttattttattttatttttttgagacagggtttcactctgtcacccaggctggagtgtagtgacaccgtctcagctcactgcaatctctgccaccagggttcaagtgattctcccacctcagccccctgagtagctgggattacaggcgtacgccaccatgcccagctaatttttgtatttttagtagagaaggggtttcaccatgttggccaggctggtctcgaacccctgacctcaagtgttccgtctgcctcagcctcccaaaatgctgggattacaggtgtgagtcaccacgcctggccgtccctataaactttctaaccaacagcaacaatacatataaaataaagctagagaatgtttttccttgaaataaaatacatttacattcacactaagatacaaatgagaaaaaatgagagaaaacattcctcctatgagataataaccctaagaaaaatcctttggtttatattcgtttacagtcacttttgattcagttcaataagctaccttgagtctaaccaagtctcctttgcagtttaatggacaaaagagactaccatcaccaatcagtaaaccatatatggtccatatgcaagtatataaatcagcatatggtatagaaatggttatatcctgatttctaaaaaaactatcagtgtaattggtaggttatttaagagtctaaaacgcataaaaacgtgtgtaactgacacacatcaaatgcactgctgttggtggatacagttcctaatcagggaagttgttaactgaacctccagttgactattttttttttttttttttgagatggagtctcactctgtcgcccaggctggagtgcagtggcgtgatcccagctcactgcaatctccgcctcccaggttcaagcgattctcctgcctcggtctcccaagtagctgggactacaggcacccgccaccatgcccaactaatgtttgtatttttagcagagacggggtttcaccatgttggccagaatggtctcaatctgttgatttcgtgatccgcctgcctcggcctcccaaagtgctgggattacaggtgtgagccaccgtgctcggcctcaagttgactctttatcccaaacaggctaagcaataaggcccaacctctgggcttcctctggcgggagtctggggattagagaagctgtgatggctttcactagcaagtctggaaattaagatccacaggacttcctgatttttttctttccttatatccctaatggtaaactaggtacagtcatgtgttgcataatgacgtttccgtcaacgatgcacctatatatgatggtggtcctatgggattataagactgtatttttaccatgccttttctatgtttagatatgtttaggtacacaaatacctaccattgcattacagttgcctacagtatggagtgcaggaacctgctgtacaggtttgtagcccaggagcaacgggccatagcacacagcctaggcgtgtagcaggctctagcatctgggtttgtgtaagtactctgcgatgtttgcacaatggcaagtccacctgatgacacatttctcagaacccgtccacatccttaagcaacacgtgactgtattttgtagtgggattactctggcagtatattatagtgagaactgcccagagattttcatttttctttaacaggctctgcgtttaacttcttactctgccatttactattttgtgcacattacttaacccctccagtccccattttcttcttcttggcgggacatcaggaggcctcgaggagataatgaagacagaagcccgcactctccaggtgcctgatgtttgctcagcaaacaggactcaatgtcaaggtgctcttctgcttgaactagaccaaatagactgtaaacaaatacaaatcttctatacagctgtaataattgtctgaatattccatcacagaaactacctcaagattttgaacttgtaatgaattagatgtaaagaaatcttaatgaatgacctacaaaccacataggaaatgtctgagcacatttgaccatttggtacagaaatgaatctggactacgctgtaccaagtgtgtgtatacattatgcattcggcctttgttctctgaatgacacccacgtctactgataattgtattttagaaatcaaacagtatactcctagttttcttatattaatagtctagcctcacttaccgggcgtccaaactccagttctgaaaagaatttataccagggctcattttctaaatctatgtcatctggatttatgcgatcagtctagagcagatgtgaaggaaaagggaaggaaaaggcacactgagcaaagtgagggaaacgctgtgtggcatgaaaaactcacgcgcgcattgacacgcaaacatgcatcaactctcaccccacgaacctcagcaggagagaacggaggaagtaaagtaaaacgagtagcatgaggatgtgaaggcgagctccatggcagggggtccctagctgtttcctgcgtccatcgtttctgattggcataagttgtgggcaactcttgcttgagttgatccacttacgcttgaggcatgaactatggaccactctctgcggcagcgagactgggtctggctggcacgcctgatgtttggaataggctcaacccagtcaccaaatagctcttttgggcgagtcacttcatcgtccctgccctcattggtggctagcagtcccagcatgggagcccgcagtctgcagacaattcactcgggtgcaggcaggtggtaagcctgggatggggaagggtgcgggaggggtgggaagacaggcgagctggggggagggggacagggcattggggggctctcaggggcctgtggatgagaagattctggggcctggatgggtgcgagcgggacccgggggagtgggagtcgccaggctctgagcaagcaagggctgcacctgcacctctgccgggcatgaagaaaggtaaggaaggaaggagctcacccgggtgggagacagagccggggcgcgcgagcttggtgtgggggcgccactccggggcggaggggaggggctaccagtgacttctccgagtcgggagctagaaagaggcttccggccaggttcccttggaacaggtgtcggagttgttgggagagggggctgcaagaaagaggggtgcagaaactggttcattagatggaggctctgggcggaaccgcgaggacaccctggcagcgcgctgtgcctgcgttaggccgggaggggagaggcctccggacggcgaagtgtccctagggacccagacgcctcgggagcgatccgggccgctgcgaagccctgcccaccaggagtggatccccaggattcacctcccggctgcctgctctgagctgagaaggggatctggttcttcacaataccgtggatggcggggaaggggagggagcctggggtaaaatcccatcttggtttcctcgatgttctaatttagagaaaaagccagttttataattgacctgcttccctgcagaggtttctgaatgttgtttttaagatgaaaaaactagcagtgttaatataaacagttggagaaaatacatacaattattctagtaatagaaaacagatgtagagtgtttaccttacccagcagtgtccttaatattttcaaataatacatggctgactagattgatttaggctgctgattttgtagtaaatctaagagcttaaagtactatatacaagttattacttctttgataattactatatgacactaattaaatgtggtacaattgaagagtacagtatcttaagtcagaaaaaaaattctaagaaaaattatatggttccctaaaagccattcactctggctaggagaggagctgtgactcccaagacatattctaggaggactattaagtgctcactgcttcagaacaattcaatatcatttgcttacaattcttaaagaaactcagggacttaaactgaatagcgacatcttggttgtgaaaaaaatgctatgtaaccttcgcagtgctgggagcttgaaatgttccatattccaacaaaagccatgattttgacattgttctactgttttattgactcgttgcatttacaagttttgctaatgatacacagtctacacttactaataaattatactcacagtgtttttagtgatgtgactttgtttcaatattttataataaaagattataggagtaattacagacaatgatagaaaagtttgaggcatcgtgacaaaatagtgcaaaagcctaagttatccaaaagatgtagtgatcataattataaagactgtgtagtgtccctgggaaatgcttacaatgagataccaagcagtcaaaacggaatctaaccacgcacctgtacagtagttacaaaggtattacaaagcttgtctctgcatgaacacagtaaagaagtcacacatacacaaacgactacaatggtgttctggtattgcgactgtttgttttttctttcttttaaatattattttgctttattgttgtaatgttatttttgtaataaataaattcagagagaacatcctactattagacataggaaaatgcctagaaatcttgagatatttttccttctttatgccagtattatatttggtttacacctcagaagtaatagtgaaattggtagagacaaaatattctagtaaccaatttgctattttctgttgaatttaaaaatttaattcaatttatatttgattcaatagttgcaatagtattaattgagattttaatgtccataaaatactatttttctccaattattatttagatcattatagatgcataattgttcgtgaaatggctttgctggagctggtttttagggtaactgacaggagagagaatttccagtaatttctcttctgtttagagagacatactatttcttctacaggaaaactaacctctgactcttttaaacttcatagtttctaatgttacacactgaatgatatcattaattattataacttctgttttcaagaatagtattttgttttgccaaggggagatagaaacttctcttagaggaaacgaatctgtttaagaaacattatgaacagcagagggcagccaacttactaaatgaataagacttgttagctatgtagcttcactttgactcccacattaagaaaatatgtaacaaatggatataccaagtcctgatttatagtaatgcatctctatgatagaatatggaaaaggaagcagaatatctaccatcttgcatcataccttagaatggcagttttccatgaattatgcttttgtttatttaaatagtcaatttatagttacaatgggcaactatctagaatgcatgccaatagaaattagcagagaaaacacccaaaacaatgatagctggtaattatcgataactttggaatgcaatgaaaggcacatgtttgagcagagttgtgttaaaggaagtgttagtggcagaactagaattttctctttgctgtggttgccgtattgaatcttttaagtcatgcaataattaaatgtcctatggtgacctggaggcactgctaaggaacacagaagcctcgcaacagtcagtgacacacatacagatggtcagtcaacagatggatatacacacaaatcactaatctcagtaatttaacactttccatgtggaacatggacattcctttgagtacagcactaatattaacactcagaaactcatttaggaggtatgattatggtttactctaattgctcataaaaggcaaaagagcaaagatactgatatgcatctttctagccttggtgtgatttttttgttgttgtttcttttcattaaaaaaaaaaaaaaacccaccagcaaacctccgtttaaaactaactttgttagtcatcagtgcaagaggacgtgttcaagaaaagctacaactataaatcacaagtgatccttacttaaaagctaccaagggtgaacaactttaaaaattttagtgttttctataatttaaaagcatttaattgcttttgtggttatcgagattccactaagtattctcagtgaggcatgtgctttctatacgttgttctaaacaaaaagaagtgccagggctattttgtttttcaaattacgctcattccattttaagttttaatgacattgactaccgtgttttatatttattgtggtttcacaataaatgctatatacattattagttgggataattcttaatggtcatcagatgaaactccttaaatttttatagttaagtattgactgacaatctttattgataaagaagcttaagttcattaagggtttaagttgcatttcaactctgctacagtgttttcaatgactattttcttctgcttttatcattatgttcaagtttagttattgtaggttagggtaacattttcatatattttttttttactttatcaagcatacagaggtcctaaacaaatgctttattaatttttttttttaaatttaacattactcacctacaaacatatccaatgcaatgggatataaaggttttagtaatataatcccagcagagtttttatgattgtctcatggaaaaattaaattgtggaaatacggttctgatttgtggttcgagtcagttcaaggcaaattcctggtgactgctaagtacttttccagatcaaacattaggcccaattaattaacatttctaaatttacagtcacatgagtatttatgagcttcaaaaaagtgcgctcacttttactttccctgttaaagaacataaacgcatatgccactgattcctaaggaagatctctttgccagggtcttgggaagatttttgttcaaacagtactacccccctgccttctctgtatcccagggaatcgtggaattatgagtcactactaatagcagtgtgtcaaacccctccaagaatgttttgagacccactgggccttttgcactagaaatatataggcttcatggataaacaacagaacaaggattcagtccctcaccaactttttccactgactgcaagggtgaaacctgtgttccttcattcacttagaaattccacgaatgcatattcactgaacacctgctacaggccaggcatcgtcccaggtgttgggatacaactggtggaccagtcacagccctcgccttcaagaagctcaagatctcatgaggaacacagtgtgccatgggcacacagcagggagagcctccaacctaatgcagaggagtcaggcacattccctgggggaggtgggactgtgctgggacctggaggatgggatagaattctccatgtgaaggaagaggtggtggggagagcttttcctggtggggaggtgcagcctttacagaggcccagcaatgcgggaattgaaagttctctgtgcagctggaacctagcgaggcagggagggtgggaggagagatgaggctggagaggtcagctggagcccagtcacaggtcttctataaattatgctcagggtttcagattttgctcgaaggacagtgaagagccagagaaaattttgagctggaggttttataaagattttctaaagattgccttcgctgtggtgtggagactagactggagaggtagggaaatgaatcaggtggctgtcactgtagcccaggcacggacaattgtgggccagaagagaggagcagcagtggcacttctcctggcaggcgacactgagtccactgcaggagaggggaaaacccaagatgaccctttggaaaagtgggcagatggagaggccatgtagagattcaaaagagcaacacagaattgcccaggtgttgtgtatatttttcaaaaattgaaaatgaaaagagcaaaggaatgcttccaaggcatcttggagtcaaaagacatgagaatgcatgaataagaccttgatacccctcagcgctggccatcgctgcgacgccactctcattcagcacgcctgctcttcaacctctagcctgtattttcaacacttcagaatcttatgtaaactatatcagtacgcggccagtctctacatcaccacggcccacttggctctttttgttttctaatttatagaggcaattgaaacgaagtcaggactaatttttttaaaaagatgatgagctggtcctacactggaaaggctggccaacatgtcccatatggccagctcaaaccattctgcttaaggctggtcctctccaaaattgtttaggagggttaacatttttggttctttctatttctccataagatagccattctcacttccttccaagtttctaagttccttctacttatcttctcctgtggctgcagagacctatccacactcgaatctctgtcacactcatggctccagagtttcctgtcttacaaccagtcacatctactggtcctgtgtggtaactacttagggcctaagtttctgataaagtaaatcaagtatactttattgtaaattagccaataaataaattaatttatactgcaaaatcatcaaataagggaatcaaataactgctacttcaatgtgtttcctgctcagccacacctggagtggctgtacagcagcgaccaagtgcaccaggcatcagtatgcctgggctcaactcctagttctggctcccaccatgtgtccctggggcaaggcgagctaatgtgtgtttcagtctcttcatctgtaacatggaaatgccatgtgtctgcttaatagggctgctggaaactttacatgagataaggcataaattactaattacagcgcctggcatatagtgagtgctcaataaagatttacaatgattgctattgctattattattgctattgtaaaacgaggagtctttaaagtcttttttaacccaaagacaagagtaatgtgacaatttcaataacaatgatagggtcaatgtataaaccctaaagggagcaaagggagggttttttaggtgtgcgtctgttttaaccatataagaggctgtttactttgcacaaactcagatctagtcttgcatagatattaaatgatagacttgaagttcctcaaggtagagagtgtgtcctgttccccgctgtgcacctcacataaagcctggcatgtagctggtgctcagtcagttttactgaatgactaaataatagaaacatcgtggtgggagagcgtctaaaaccaatcctgtttcctgacaccacggctaccaaagcattccaataccattaccatgttcgttatcctaagagtctcataaattactagaaagatcattaaaattttgttatttaatttaaatctgagatatattatttcactgttttcaattttctgcaatgatgacattgtgtttcactcaattctcattctggaaatttcagagtagcatgatactcaatcacagaaactagtaaatgggttacaagtttgcaatggtgcctgcaaatcagtgattttttttttctttcagtttttcttttgtagtcctgttactctaaaagatatgagttatttaaagaaagggtaagaaggcttagacaaatatcatgtatgaattatctgatgataaggttttgaacatgcttctccagaacacaaccgcaaacacagggtttcaaagactcaatcaaggacactcatgttgggtgtggcaaggctagagtttccaattaaaccacagggctggccttggattatatatgagtgtgatttcttggagactcttgaaggagctccacaaagaaaactctctttttcctgttcactgacacctaaaattcttttaaagcaaaaatgagagtaaattgcaattgattgcaaatgttttcctagaagtaggcttggaaggagatgcagaggaactgtggagtttcaaagaaaatcctgaggacactgatttctgaggggaagcaaaggacatgcaagggagtattggggaatcaaaaccaaagaaggccaagggaagacctatgtgtgaacctgcgcttcgaggaggcaagtggttcttcttaagtgtatagatatttttgtttgcatataattaaataattggaaaaaatcctgcaaagtgaaatataatcttgatccattagaatgacaatcaatcaggaagcttgaggcttggtaacctgaggagggatttaataagaagcaattaaaacaacttgttatgaaaagggcatttggaaaattctcccttcatccaaagaaatattaaaaagccaatatggaaaacaagggatggaactgcctgggtccatgtatattggggagattaattaatgatttttctcattagcaagctatgatagcaattaagtattgcacttatgaacttttttaaaagttaaactctgattaatgattaggcacagttagagttacatgcaaatgaatcttgcatataaatatatatatgtgtgtgcatacacatgtgtatatatgtgtatgtatatacacctgcatgtgtgtgtgtatatatatatatataaatacacacacatacacacacacatacacttgtatttggtcagtaaagacaatatattagaacatgtatctttcaattctgagatgagatgtacaaatcattatacaaaataaacatgatttctaagtgattacctttgtgacaaaaattgctaatgggtctgaaattcaggtttattggggagccctgggagcccagcgagctggcatattctgtttaatgacaagtgcttactggtctttcatgctgaagaattgatgacttgccaggttcatattcaaaaatactccttggctcagaccgaaattttcttgtgtccacttttctgtctggaggatcccagtcatgcctagaaataaacaataaatcacacattaaaataatcctttttgcttaaagcaattgtgtaaaaccagttatctgttttcaacattacttttagcatagttttaaaaaaaatctctcaggataaaaagttaacctgtgaaaaataccacattcccccgccactggctccaaaagtcacatgaggggtttgtagacgcgcagagagtgagtccctgggttcctaatggcagctgtgtatatttgtgcttaaaataggtggcagtatgctctgctgaactatgagcatttaacccaccactttgtgacctttgggatccttgatccaaagtgacaaggagtaatgcacacaccatgtttgatcttatttcttgaagtgggatcatcgcttgggaagagcacagaagtgtcatgtgggttggcgtgcaccagagcaggcagtgtggaacaggaggtcgtcttttggtgtgagccttgaaaaaccagagtcaaacatctcattcatgggaaccagcacttttcccccaaggaatatcttccaagaggctgtcagaagacttacgaaggaaagcttcaaaaaagggtttcacaaaattaagcttttctaggctactgagctaaagaagaaggcttctttttttttttttttttcgagacagagtcttcctctgttgcccaggctggagtgcagtggtgtgatcacagctcgctgccatctcactcaaactcctgggctcaagccatcctctctcctcagcctcccaggggccatgatttttaggaggaaggattttctgactgtagataggggtaattctgcttccatggaatggaatgaaattcttgctccatggcccgttggaaatagaaatactctaagagacagaattagggacaagccctagctttctactaaattcatgactgatatggagcaagaccccttaaactttctcagtcttcatttttttccatttgtgtaaaacacagacagcaataatgtgttgttcttccttgcagaggagttttgagcattacatgagataatacatatgaaagccatatggaattttttaggaggttatcatatgttttaatgagatatttaattttaacaaaacatatcagatgggtaatacctttaaatcaaaacgttaattttggttattttttgatgacaaagataacaatttgtgtctagaaaactgtttctcaattttaaggcctcacataattcatcctgaggagattggtattaaaatgagacccctttcacacacgatgtgtgtgttttggtgggatgctgtgccctatatgatcatcaattactctattataaaatttttatttgttttttttttttagtgaagatgggatttcgccatgttggccaggccagtcttgaacctctggcctcaggcaatccacacaccatggcttcccaaaatgctgggactggctgggtgcagtgactcacgcctgtaatcctagcactttgggaagccaaggtgggtggatcacgaggtcaggagttaagaccatcctggccaaggtggtgaaacaccatacaaaaattagccgggcgtggtggctggtgcctgtaatcccagctacttggtaattgcttgaacccgggagtcggaggttgcagtgagacaagatcacaccattgcactccagcctgggtaacagagtgagactccatttaaaaaaaaaaaaagtgctgggactacaggcatgagccaccacgcctggcctgatcatcaattactcttaatggtacaatagggtgttgaatacaatttttctggaatgggtatgataacacttaataaccagtattaataagaaataatttttatattcttatttattaattgctaggatagcataggccttgggtttaatcagagctgagcttggaccctggcttggacataacgagctgcatgagctgagtaagttcctaccattttctaaactgcagtttcttcctctttaaaatagaaagtatctcactgggttgttctcggaatcaaatgatatgacacagaaaaagcacttagcctagtgcttggcttgtaatgagcgctcaatgaaggttacctataagtagaagtattagtcataatcccagtaaaaataacacaataaaaaagtgtttataaatttttattttcatgtagatagtttgtataaaaatatttcagtggagaaaggaaaactcgtattagcttgaaaaactggtagaaacaagtcacagacacttattaactaatgcctcattatgatttttgaataactttccctgctttcaaaaatgtctcttattaatagacctggggaaacagaaaatgaactgcatagcctgtaacctggtatgccaaaggaagtacatgtccattatttctatttacttgtctcttatatgtatgtattgatcaaaaagcagaaaatgtgtccatattacttcaagtctaatttagggcactccagtatcatgaaagaagacagggaaaacatttgctacaatcccagcagaggaggtcaatatggtatatgtatagactagcaagattacacatccgctctctctgtggcaggtgcactgattcttctactgaatgccatgtagacttatttttatcctaagcgaaacataggccaccctggggggaaatgccttacttttctgttgaagaccgatctcttggtcgaagcggcgggactggaggtggaacatgtgggggaggcactggggaggacgcatccttaaaggcattggggctgttgtcggagtggcttttggaaagaggtctgtaggtttgggtctttgcagcagggtgtgactgagcactgtagggtgggttgtacagacctatcatgacaaaaaacaaaagcagacaaaaaacagaagcaaatcacctcttaaaaatgaattaaattatttgtccccctcaaaatagccaatgattgcatagaaattattatcaataagcatattcataatgcatacattagaaggtagtttcttaatttattaatattaatgtactaatttccattaatttattaattacaaatttattctgtacctaagccctgattacagtaaatctttgtcaattatttcagaactagtaataattcagactggtactaggaatagacttataagcactcagcaaattttctcttcaattgtatacactaagaaaatagttcagttttcagagcaagattaaaaacggaactgtttccaaatatcttctaatactttaaaaaccctgatttacatatgaaaattgacatgctaattgtagtcaaacaaaatattgcacacagttgtgtttataaagtgctgtgcaaggtacaaggaaacatgagtcctcaatatgcttagagtgcacctgggaaaatcagacacaaatagaattatgatggaaaataattggtaaaagataataaagaccaaatgaagaaaacacatagtaagaattaaaggatgctagtaggtggtagattgctcagagaaggtattatggaacccacgagtccagagtcagccctgaatgagtttcggtgagcagggcaagaggggagcagggatggtatagaaaaaaaggcagaaaagtgcaaggtgtgaagccatggcttgcacggttagtagagagcaaagagactagctgcagttgactcgtccactgatcaaatgatcagcttgtagggctgtacaaagtaatatatcactgctgttccattcactaatcactaatgtgacacaaacctcaatattaaaacagttataaaaattctaaattttcctgcacccaatcattggagctaattctatttgtacccgttcgcttctcctgaaagtccatgcacatttccacagcaaatgaaaagagacaacatctacacttacagttttgcttggattcaacagtcggacttcaacttttgagctaaataaaggaggtgagtttggtgggcgtgggagcagggatgaaattaagggaaacatctttgtgggcctgaagctatcagtggggcgagccaagacttaaacccagagggcttgctgagtttgttctactgattttccctctatcaatttgtctttggagataggagcacaatcccaaatagttaaagggcctgaatgtggtctccaggggtgcagaacaggaggatcatgcgaccccaggctgcccagaggaccccaagtgaggttgcagctgctgaaggggaggggagcagtgccagcctccgagcctggtctaaagaaagaagaaaaaaaatagttgtgcacctgtcctgagcctgtgactgggcagggagaggagccctgggcagaatcccgaggcaacactcaggagaaagtgatgaagggaaaaacatttgtcaggggtccctccttccagcctgcagacccctgcacgagataccaaggctcgccaatccaagtggcagtgcctggaactgaagccattctattgtgaccactggcaattctgagtcagaaaagtggccccgccaagggggatttttaaactctttcaatgaatggttgcattttggagcaaaaggcagggacaaggtcacagaatactttgtttgacttgtttttggtgaagtgtatctgaaagatcttacacaattgtaatcattctctctgctgataaaagatctttatcttattttgtaccctgggttacagtgtgtcctttcagcctatccttcacactttggttaaacattcctgaagctgagaataaaccaacagtgggaatgaatgagataaaccagtattagttctcatttccatgagaaaagtcaatccttttgttatgcacgctctgagaaaagaaaagaaatcctcctcctaatatatgaactgaaaacatgtgctcaaacagaaggggaaaaaaggtgaccgtgtcgttcttccaaacattgctgagcataaaatagtcattgcgagcaaggaaacccatcctacctgcattgtatgtataaggagtattatacatgtctgtgtcatcatctagaaaatgaaacataaatattatggtaatatagattgtcaccaaaggacaacgagacagcagaacttcagacaaacaacagaaatttgttagaaaagcaacgtatttttcctagttcataatgccattttctttctttttttctttttttttaagagacagggttttaccctgtcgtccagtctggagtgcagtggtgatcattgcttactgcagcctccaaacctccaacccctgggctcaaatcattctcccacattagccttctgagtagctgggattacaggtgtgtgccaccacaggcctctgcaaactgcccttttttatctgtaacatattcgtcttgctgccctcttcgtagcatgcaaagtcaggcccttgtcctcgcttccccagaaacctctctgctctggatcgcaaatttcctttactaagtgctttagtggtctcctgtctacagagcaggctcaggcagacccgcgcaggctcactctcctgatgagagcagacaggggtggacagaggaacaatgtgtttttcacccaggcaacacaccaatttagactgtggacaggggaggatggagggctgaggccagagtgcctggttgtcctccatggggaggcttcttggcagctcaggtgggaggcagaggcacagggatctgtcaccggaggggtgacagaaggagaacaggaggcatgctgaaaagaaaggggacacggagtttgctggggtcttgacattgtgtgtgaatcaaaccgatgcaaaagacgaatgtagtcccttcaacccacaaggacctcatcagaaagcagagcagcagacatacccggcttgtgcaccatgtgaatttgcttaaacatcgtcttgtaccagtccttgggccggtcgactgtctgtaatgaagagagcgtccaatggttacaaactggcttccaatcaacatcgcttctcagtgttttcatttctctattttatgttcttaataacagagtcccattctgtgataaaatgttctgactctttgctatggcttcatgacagtttcagcaatttacttagttatgtgtgcagtttgtaaacatatggccttgtgtttgaatttaggctgagttggaacattagatgctatggttttattttttcaagttatagctgtaccctgcactagagagttgatatttgcacaaatatataaagttcacttaatgtaagttattgttgtactaatttgtttaactccttttggtagataatgatcattatccttagatgctttttattgaatgttctgtaagacagtgttttcagaattaactggggaatatttttgactcaaattgtattctgatcagtgtggctctagagaaataaatttgctatttactagtctaagctactaaaatactgaatgtagtaggcatcccagagtcctacggaaaatttaagaatgtagatattgcttcaaaaatgctaatatgataacagagtgtatacaacatttgctcggctaaaattgtaggttccttgagagtagaagtccttacggatccaggcgtcggacatgaggggagcagtaggctgtagtggaaagatgaaattaatgtagagtcttgaactaagattcaaatcttggttccttaaattgctgcttaatacaccctagcaatacgaatctgggcaagtcatgtcaccttcttgagcctcagttttctcctctctaaagtgacataattatatctaaatcataggattgttatggaaatcgaatgagacaatgtatacacaagacctagaacaatgcctagaatataacaactactcaataaataataacactagggaactgcaaatatttgtagaatgaaataatgaatgaacgtagcctattggatagagctctgcctttctggatacctgtaaaagtagacacatgcttttataatcgtactcacagattttgcttggcaagatcttaccccaactctctgagagctacctgggcaacaggcttgatgattctgcttatagtaactaaacacaccagacgttccaagacagatctcgatttaaaaacttctgttaggactgatacgaaagcattcttatacttactagactgagctttgggttagattttattgcctgatctttttttccccagaaatgtggtcactgcatttttcctctggacattaagggttttgtgctatatctaaatttattttgacctctgagaatatattattctgaaaaatcaccccaaatacaggttaacatgaagggccacttgacttcgttatgagtcagctcttcattctcggctctttctccatggaagagttgaggttattgattgactattcagtcaaaggacgggacatggtggaagggattgcagtggtgaagcaaaggtctattatttgctggttcaaagttgctaaacatgtatctttcaagaaagtttatttttataaaggactgatttctctttcattaaacctcatttcttttactgtaccaaagcaacagaaaatacaacatagtgttgtgcaaaaatgttttcctggacgtgctgatggcaacaaggaagcctactaagtaagtcctatcactgtatatggcaatacatgttgacagacaggtttttttttcttcacttgctggagggcctatatcaggtaggatctcacagtgatgccatctgctagctttatatggtgagcacaaagatgccagaaaatgccctgctggcaaagggaaatatgaagctggaaaaataaaatacgaaaactctatgtccctttctaaaagaagtactctaagcatttaaagttccttttgtaaatgccatcatggagatcgctatgcctaaggctgagaataagaaaatagtctactcaaatttcaggaagtttacttttgtacgtaaaatcattttgcatgaaaaatagctactagcaattcactatgccgttttttctacaaccttgactaaatagacctgaatttttacattcctacagttttcaaaacatcagaactctacactgatttaacacgcagagatttcaaaaaagataaaaaaggacatattttctacatagcagtatacagtgactctgttctatttttttctccttttcagttttgaaaatactcaaacaagtgttatattggaagtagaagaaaagaatcttgtatttcacttaactagctggccttaatgacacaatctcatgggagctgagccctggcgatttttgttgttttgaagaacagcactgaaaggttcacatagatgtcccaggtcacatgagagagggcaatctggagagctgattccctgcattaaaatagctcaaaagtactgtttgttgactcttggctttctagagtttctggatgactttacaaaattctgtttcctcggcataggctggctgtctaaaacgatactgcagcatggtacattgtgacagtaccgcctttggcaaatacactgaatctgatcatcattactttctacacatgagaaagaaaaacaaccttggagagtcttggcctgctgtggctcagagacagcctgacttgacatttataaccacagctatacatggggatgtactctggagggctgtatagtcagtgtaagaggagagtcctcatagacctggaccttctttgtcaagttttaaaggtccaagtaagacaacaattgtgcataaaaattacagttccttataaggaacttctgcattggttatattgtgttttctattttatagaagggaaactggcattaaatgtttagtgtgtttgcttatgcatacccaaacgtgcttttgatttggcagttgataaacattttaaaaattttaagatgatttaattttcatcaaccatctctagcatctcagtttttccttttgaaactaaccaggcaaagtctggttagttaaggaaattatgtcttataaaggaagaaaacatggaccaggcttgcatgtccattatatatcatttattgacctaaaaacatacccagatatctttgataaaatcctctcagacagaatctataactacatagaatcagggctttcttaattttgtctatactatgcctcaagtgccagttacacaaaaccaatgacaccatttctgtctgactgtctatccctatataattagaagaaagtttcaaatttaaccattttgagtcagaaatcttagaagggaaatgaacaagaaaacatcatcaccagaaacatgtaatcatcataaaatgaagaatattggtcataatccctgaacttttctttggcacataaatatggcaatcgtcagtttcaagacagattgttagaatgtcatatcacattcaacgtttcctcaatctaaagagtctaaaaccccagtaactgctgtacagatttactttttggctttcaattgtaatatagatgctgagaataatccattttaaactcttctgtctgtatataaaacacataatccccatataagaatgtaaagtcaaggagagaagaaaatccccacactttatcgttagttctttttgactgtttccaatcttaccacggctttttttttttttttcctgctctctttcccattctttgcctctatcccttattgtcttggctgcccaggtctgcattccaggggagcagctcttggccacaccccagctttacatgggtcttgctgcaaagtatatgcagctgcagtccctccccgcatggcccccaacttcacctgcaaaggtgttgttgctttcatcctgtccccggcttccttctcccggctggcacaagccttctcttccagtggacttggtcagccagctgctgcctgcccaggctctcagaagctgcctctgctactgctgcgttttgccggaaggggctgcccagatacactgagcaatgctttggcagagttttaaaacttaaaaaaaaatccaaacactttcacttatcatcccaggagagctctcagcaggcacggctgaagagggacattaaaatgtgtatttttcttcagacagcttttcctttccatgacattaactctcttcactccaatcatctcacctcccaactcccaaatc

SEQ ID NO: 2078 - DNA, 71527 bp, Homo sapiens; identical to SEQ ID NO: 2077

SEQ ID NO: 2079 - DNA, 190470 bp, Homo sapiens
atgcattttctcttagtttaacaagttggaataaaatacacaatttttataaagataaatgtcaagaagaaaaactgaagtatacttccaagcaaaatttattagatgtctattcaagaaaaacacaatgacctttgcttgtaagaattcaaagtcaattacctggaagccaggtatgaatagttttttcttttaaaatcagatacagagagtagaaacagtaatttttcttaaatatgacaggcaacagatattgaagtcttttctcataaatggcatcaaagagaattattcatttatcagcaaagctgcatgcagttgacttaatttcaaacctgaagcctttaaaatatgaagctggttatgaacttgacagaaatcaaggtaggctactcaacgatgtttctttaccttcttcctaatgaaattcccttgtcatcagtcagtagatatgtacatttcatttggcttctacgatcttttaacttcatagatttttgcataaatgctatctgacagaatcacactatctaggggtgcttgtgatctgtgagataaggagaggctagtctgctgaaagtgttgtcgcaggataaagaccaaattaggaaacgcccctgttttctcaacaactagtctgtacaaaaaaagagcaaacatatgtacaaaattctagaggctacgtacattgtgaaaagatcaatatcactgtccatgaaagagatgccataaaaagttttatctgtaaggtgctcaagatccaaagatgaacagttcttatgcaaagtcataagaaatacaaagctagttttcggagcaggtgtaattcaggcactgtgaaccatattaaaccttccaggtcccaatatcattttttaaatttctgcttcagggcagaaaataaaacctgaatgatttaacattgcttctaaaaagtgcctaatttattcctaggaaatattttacacacaccaggaaaatcaggctcaacatattcctgtcctcaaatgtagccaggattctgagttccatagaagaaaaataattattatagtaaaaataattgtagtaatcctaatccttgctaaaaccaactttaatacttgtgatgcttctgtactctatttctataaaataatgtgtgagattctattacatttccataaaatgtacaacatatcatatggattatatgttctcatacaatctcaaatgtgtatgtgtacacacagtgaaatcttacctactagtattgcttacagatactttcaggtgtctgttagaataattctttgcacctctcactaacactgcttttacttacattttttcagataaataaaacactaagagctcattgttcatgatgctgatcattacattttaatataaaatagcgatgcaactttacaacacaatagttttcccctgtagcctagctcagcctcttgtattgtcatgattattaccgaaggcttttatttacttactgtttgcacttctaaaaaatgcaaacaaattgcagaaaaagactcctatttgaaaactcacattcaatcagcaaaatcacactcatccaaattaactcgcctcctcttgctttaaaggttgtaatcactgtgcatattacaacatgtatgtgcaggcaaacaatagctaaagtacagttacagttgtcatattgtgtaaaccaagacactaggcaaacttgtgaaaagaatacacactgccaagcgaagaatatgaaaatgcaaaccacagcattccccaataaacaattttctggtcgtcttgggggagaacatcgcctggggggagatgttgaaatggagccacgaggctggacagcctcctggagacactttttttttttttttttgcctcaaatatttgaccatttttaaatatcatgatttttttctttctgatcccacattttgacgtgtcaaagcttagagcaggaagtaggaatccacactttcacggagggggaccagcctgccatgtcgtccccaggctcacagcagcggcggctactctgctggtggtttggtggcaggtggagatggtgacggcgcattggaaaccgtaaggcatgacaacgggaggcccgcggggtgtttcaggcgcgttgacgcaggtgcatggctggcaggcggcctctacagaaggagggagcgcaattcacagcctcttgacgtagtttccggggaaagtaccaaagaatttggttcttcttgaggtccctgaaaatagaagcgagtcatgaaaggggggtgacaacgatatcagttcatacacatgggcttgaatacttcccatttacaaggcctcggaagacagcaagccccgaggggtttggaaaagaaggcaggcaactcacatgaagcccataggcagacaaaataagcagtgttagctggttgcctgacgctctcactgcccctccggcataaatgctgcgctgccatcgcggcaggctaaacagaaatgctgagcctcccaagctaaagggaaagtcagccctgctgaggaggggggcggaggagctcagtcactgaggctgccacaccagagtcgggggtgagggatcaaggcgaggctgacaggtgacagggtgagtggaaaatcctaagagcaaagcttctcagggaccagcaacccgcgcaacacaggtgcgacatgaagacatcatctgtggcaggctgtcgctgttccaacagttttatcatcttacagaagatcatggtcagtgccacatcatttatttaaaaacagcactgccagagtccttcatcgagtatacaatttttcaacaatttacaaatcattaatgaaaaaaaggattaagcactatttgtgtgtgggagttctatcagtggcatgatttttaacatggtgtgtgtttaaccacacgcacaaatggctatcataattatgttcgcctctggtttcaaataatgtaattccttggacacttcttgtaaaagttggtgcactaaattgctaaattcttctttaggcagcgcagatggaccggataagggtctctcaagcttcatctgtctcctatatcctggcacttactgccttggtttgatggctgtttttctttttccttggctaggcaagccattttacgtttctcctccctcctcctcctccctcctcctcctcctccttgtttttgagatggagtttcgctcttgtcgcccaggctggagtgcagtggcatgatctcggctcactgcaacctctgcctcttgggttcaagcaattctcctgccttagcctcctgagtggctgggattacaggcacctgccaccaagcccagctgattattgtacttttggtagatacggggtttcaccatgttgaccaggctggcctcgaactcctggcctcaggtaatccacccgcctcggcctcccaaagtgctagaattacaggcatgagccaccgcacccggcctttttttcttcttttaatggaaataaaatcagaggcttgtggccgcaccagggcctcaattctttcatgattttgccaccgatggatgtctagagtgagccctcctctcctctcacctttcctctcttccattctctgccctgcagcctgtgtttccttttcacctctttctgtggcccagtgtaaaatacttttgtctacaaatgttttcccagaagacctctcgtctttttttttaggatggtaaagatgaagttgccttttaagtgggaagaatggaacgtctctctgcttccaccacaaactaaagttaaggtgagtcactgaatgttcgggcatctacgtcagacctaggaaacgggagagctgttcacttaatctcactccctctgaaattagattctcactgtggacaactaacattttccacagcacagagcgttgatatttctcttctggggaccatttgttgttgttgttcttagatctcaatctttcctggtttttgctatttaaagaaattgtcttctctcagttgagttggaaataaagctcgcagaaaatcacacatagctgaagcagtgaatactaaactatattaaaaatgcaatagccttgggattacattgtgcatatgaatgtctgaaagatcaaaggcattacgaattcaaaggaagctcggccatcacagcaaaccacgggagtgagcaaactcaagcaaattacaaaatagccgaaggtgcctgaggaagaagcgcacatacccacaaaccagccgtcatcacacttttccatgacatcaatgacatcactttctctgagctccagctcatcttcattcctgggagtatagttatacagagcctgaaaccttaaacaggacaagggaatgtgtttaaaaacatcttgacaccttcatgaaatatagaagatagaacaatattcattcttcctttaacattcctattcttaacaacattctgttgggtggtacaagcctggtaagcatgtaaatagcattctattggatggtacaagcctggtaagcaggtacatagcaatatgtagatcttcacaggcattagaacactctaacaacattttgaaactcacgaggaatatccatgaaaattgtaacattcataaattggattaaaatatgtcaacatgtataagtcagacccgcatttcagttgtccagccatctaacgtctatcatttagacattaaataatagtacaaaatataaaataagtgatatttgtattatttaactgtttaaaaacaagaaggaatcacaattttagctagccataatcagaagcaaataatgggggcttgagaattgaattttcaaaggttctaaatggagatagacaaaatgtgtcagacatgtctttttaatcactctgtgtgaattactatacaaaggaaaattattttttttactaagaggaattctttagatcagtttaatgttatggtttggatcagtgttttctgaggatgtagaattggaagatttgatgtaattagcctatgaagttgagtagatgtattctatgtgcagttattactgattccatttcaagcagactatggacataagtctctttttaaaatgagtcccagaaaaattgtatttgattttaaaactctctcttgaaataattttatataaaaaagaattattgatagaatgctatcactttcctttcccggcctgaattctttgacagcatatactgtggtggaaattgatcaataatgaattcagacactgaatttgtggtaagaaaacaccatacattataataaatagtaacatgggctggtgtttttggaaaatgaaggcgaaattactgtagctgagaaggtcaagaagaatttgataggcagttaacatgaaaacttcttcataatagtactaaaatattaccagtactgtgagggggtttttaaaaattgggaatttgtttctgctgctttctgtaacagtcatgtcattctgctaatgtgagaaaataattaccactttctagggtattttagattttttcatgccaacttaaaaaagttgataatcttgactaccgctccggaacaagaatgatttatttttaattactttatgagtcagaaaataatattttggtagaacaaaactattctatcatttaaactcaaatcttatgtcattaataagcaacagtgacctactggcttccccccgttcatccagcatttggactgggggagctggatagagttggcttcagagaatgcctaacaacatcccctagaaaatattgttttccctggcctggcaccaaagcctgaaatttcaacattagaggcttcttctcctgttaaaacttcatccttccagtagaccttacagccacttatatccttttgagcatgggcttctgaggccttttcttgagagaggggtttgtgattatggggaagggcagagaaaggcagctagcatcccagagtagtggccaaaaagacaggcaggtgtggaatacagaaacgtcacctgatttggatgtttgcatgtggccagctttgctaggggtagtccatttattttgttgcttgtgtaaagaatttgatttggaggctgctcaggtgaaggggtggtatcttttgtgtatctgtggggaaagttcacggtcccttttccagtttcacatttgagagagatggtggttcctgggctgctgttttgatggatacacacggcatttctcactttgggaaaactgattcttttattgagcttctcaggcttgaaccctgcccaggctcatctccacccactcatggagaccggttacctaaggctgcaaacctcagctgctggaaagaatctcaaggtctcagagctaacgcaacaaaattggcacagactcctgcttcatttttgtctgatgaaagccagcatgtttgtccaaatttatttaccattctggtttaattagaccacagaaacaaaaacaaaacaaaagaaaacccacggagttttatggaaacgtaaacacaccttcaggaaatcctcctgcctctcctggctttcaaagccagtgttgcacaatgggaaatgaagacaaatccaatgttaaaaaatgctgttgtgaaagatgtgttggtgaggtgagtgatggtggtggggtaaggatgcctcaaaaagaaaggtgtcttttaaacaggaaatgctgagccagactggaagccctctcgataacttgcaactttttctagaacatatttcactaaaactctgaattgtagtgacataacattatgttcctactttggctcaaaacttatttttaaatgaaagcaactaagcaacaccctaaaatcccactaattcaggctataatcaaatataaatttaataaacaatgttttctaatatacaaatcaggactttgaaaatgtaacatatctttcattcataaacactttgaaagctgtttaatataacatgttggtaatgcaataaacctaaacagccctggaatttattttttatcatgtgatcttatcatcgtttgggtaaataagagaacaaacaaaagctttagaatgacaagtcgtatttagtgttttccagttaagcgatctttttgtttgtttgtttgtttgagacagggtcttgctctgttgcccaggctggagtgcagggccatcatcatggcttattgtagccttgatctccctggcccaagtgatcttcccacctcagcctactaagcagctgggactacaggcgcatgccatcacacctgactaattttttatttttatttttgtagagatggtgttttgctatgttgtccaggctggtcttgaactcctgggttttggccttccaaagtgctgggatttcaggcatagtgactgcacctaaccttcagtgagatttcaaatgattatcactgctaacctgttctttccaaaatacagactttcccgcaacaagaacacttttctgcctgtgctctgtgagagccagtctcatccggagctgctttttgctaagtttcaggtctgtgaggagcaaggaaggacttgatggtgataaaggcaccaggtcatatgccaggacctgccgcaaggaggaggctattgttagcctgttctgctccaggtgagcagagtgtgggcagtgggtcaggatccccagtgtgtgctcagatatgggggacaaggggttaggtccatgaataagccttcccaggggtctcactctcgactcacagtgtgggcagaggccaacaggaagctgataactcctgaacgtctctcagggacaaaatgggcccgaaaaagaaacacacagagagaatcttcaagacaacgtgtgacaccttcaggctgatttaactcatgtatcagaaaggagaaggaatttgaaaggaaagtttgaaaaggcattttcctggtgctgtggaagtaatcgcatgtaactgaataacagtgagtgttttaatactgcccttttcaaatgacccttctaagcatgtaactttggaatgatggaatgatcgctttaggtcttttttacactgaggtccacttttaccgtctcccagtgggtgtaaaagtaaggttagaacatgttctgtatgtctttgaagctcgcagttactcgttacacagccagcagagcagagagggagacagagttatccatcttaggaatcactgaagcattgggaagttttcctagtgtgtcaattaaaatcttctcagagaactatgggttcttttaaaaattagtttctggtcactgtcataaaagatggagagactattacaatttctcgtaatttaagaggcctcatgttagtttgatctttcacgtgcaaagccatacatcttacattttggtacagttgtccattttgtgggtcaaggttagtctcaaatttagaagataagaagaatacttacggttcccccccaccttgaatattttcatgagtaaacacaggacgctgtggctgaaatgaaatgattttcaatgtaatcaatgtttaaactggtactaattaaaagataatttggataatggcatggtacttttcttgacatttaatatttcctgttgtaaaaaaccaagaggaagaaaaaaaccaaataaaagctttctgcaggattaataattaaaatatttaaagggagctttaaattaaagcaaaataagcaaggtcaaatgttttgaacatgtctacaatctagtctgctcaagctttaaggaaaagtcagggtttggtcccattgatttttcaaaggccaggaataaggcaagaacatagacggcaaaccactagaataggaaatatagacaccttcatacaaccttattctccagcgttttctcaaacaagcagaaaataaaccacatttagtttaacagcaaagtatccacactcattctttcaatctttccttcacagacaacattttcacatacagcacagaggaaaatatcaataggcagacatcccatgctacatttgaattaacattttctgttctcaatgtggagagaaaacatgcatttttaaaaagagaaaacagaactttggaatgcaacgaacaatatccgggtaacatgtaacattttaccttagaagagaaacattggtagaaatttccagtgcactgaactctcaaaagagtttcttttctttttaaactaagcatcaagaccagtatctgtaatagatacttataatattggaaatgacaagccttagcatcccatatacccacattaatattttcagtgaatgaaagttaacatgtttgttgaatatataaactcagtgtaatttatattgactacctaaactttaccttttaggggagaaatgcaaacaaatcattcataatccatttcaaaagcatttgcttctaaatgatagctacagggtaaaatcagaatttgcatggcaattatataagtgactgtttgatgactactgaaatagctattagatccatgtccttagactttgggaccagttcttagatttccatagttatgagtggattactgataggctgaaatctcttgctgccaattgtccatagaaaccccactgatccaagcttggatggataattctgaggttcctttcagtctacgagtcaatgattcacccacttcctaaattctttatccaccccctttctatcctacttgtctatctagcataagactaggtactcacagtactaaaactgtaagctctgactcggttaactggaaacctttattaacagtgttcttagaaatttcactcaacagtctgtggatagaatatttaaaactagagtgcgtaagaattactgcacacaattatgacttaagagtgaaatagtttactcctgtaaatcaatatgactactaatgatgtatctattattaaaattggaagatattcatattttaagaaaaattatgactaaccagttttccaaccatcttaaaggtcatttaattcaagatattattaaatcaatttaaatatataagatggtaattgtaagtcattgataagcctgtatcatattacctatttcaagttctcttccagtccaataaaactttatatatgtataaaactttcatgcagaagtaagatttgtatacatcaattgccattaatattattttgtaataactttccagtctttttttctcagtcttctttcttatttcaaatgtctgcagaataatgttctcccacgtgtgtctacatatcatagttttcttaaccattcctctcttttttttttagttttgaagttagaattggtctagtctttttttttttgctatcataaacagcaatgctatacacattttttatgcaaagagctattttcttcttttgaactattctttagaatatattcccaggagtaaaacttctggccaaagagtatgcattaaagccatatgattttgagaatgtacatgttagtcactgaaaaatactgtactcaaaagtaacttgaaaatgtctaatatgccagactgcatatcatataccaagatagctactactctttccccaaaacaatcatagcaccatttgcagtgcataataaagttatgaataagaaaatattatttattcttgtcttaagagaaaatgttgtgtaaaatatatttcattatgctctaaaattggcatccctgttttcacacatttaaaccattttaatattttaaaattgagtaaaagtttcaacttctacatcatggcatccaatgctttgtaaaactggttagtttcatttcattgctcttttgttaaaatgtgaataccactttaaaaatcaaattgttcattaatgtaaaacaatcaacttttaaagtccgtatatccctttttagttatcatcattataattctactagtttaattcctttaactcaacccacctcatcaatcatttaactgaactgtcccattgaccattatgaaaatttggtgattgctgcaaacctgcagcttcctggatcccacgtccatggctggagaacgtatgttcctgtgtggggcagccagcaccgtccttgctttttttttttttttttttttttgagatggagtctcactctgccaccaggctagaggtcagtggtgtgatcttggctcactgcaacctctgcctcccgggttcaagcgattctcctgcctcagcctcccgagtagctgggactacaggcacgcaccaccgtgcccagctaatttttgtatttttagtagagacagggtttcaccatgttagccaggatggtctcgatctcctgaccttgtgatcttcccgccttggcctcctaaagtgctgggattacaggcgtgagtcactgcgcccggcccccgtccttgcttttacctgtttcccaatttctcttttcccttccttcatatctttcaaaccctgcccctctttttacacacaaatcatcagttttctatactgttcacatcctgaggccagaatcaatcaagacttttcgtagcagagaagttgtgtgtgtcttataatggcgagttttagaacttttcaaagcttacctttaacaagaatcacctccatgttaatgtggataactaggagacagttttgaggaaagctgactaattacagtacttgaaatagtttattttaaaggcatttgactagtagggaatgagtagcaagaacagttatctaagacggctcatctgcgtctttctgttttgggcgttaagcaccatataaccttggggatgcctcagcttccctatctctgaaatcaatgagttggacaagatgagggttaatcgggtcccctcagggattccatgaaggatacacatttccacagatgtatttcctctgctgtgtaaaggtgtccgtcatcagttttacacagagagctgggacactgacattgattggttaattctcatgtgtctcggtcacgtaaaaaaaaataatggttacaattcaactccattttgcagaatggtaaaccaaaacccaaagatactggataatttcttaatacgacaaataggtaaaaaacaaacagaaaaagaaacaaaatggtaatttcgatgtgcacgctattgcatgaaagattactatgatggactacttggcctaccttggctaaaatcagcatcttaattttgacgctgaggtaggtgcaaatgtcctataaggtgatgtaaatagattatctggggagactgtctttcgccctttccccttggtgatgtaactcaaatggcaagtcgcttaagcagagatttgtaatgcagctgcactctgtcgccacctagtggtgagcaatggcagcaacaagctgagagttgtttctgctttatctgcccctttttatccaagttcccaaggctggaaaaattttaaaagcctattttaaaggccgcagagtgatgtggaatagacagtcatctgttttcctaaccatgttcttccctccccacgttttaaatttttgagaaagcatcccttgtaaagccaccagcatttttggtccgtgtccatttctattttgactatctgtgcaggcatttccatttcccctaacttcttagcagttttaagataaatatagaacaatatacacttgtgacattcagagaggcttacatgagctgaacctagaaagatggctttcaactgacacattacaatcactgtgctgggcattttgaacaagaattatattatgcttatatttccttgatgaatcttaagagtagaacaagagaaaaatccagtgaagcatgctgcggttttcatcgtatcctaaatatgtatttttttctgtagccctgactatgtaagtatttttctgtagctattttttaatgttgtcaaaaacggatacaaaagagacaagttttaaacacatgctaatttccaaagccagaaccaatcacaagttgctgttcataaggaagctggtttgaaacatcatggagtctgtaacatcagtaaaatatatactttccgatcttagtgagctacagtctgttgaaaagccgtctaatttatcaaagcttctgcagttatctctggaggattagctatatttagtatcaaataattcttaaagaaggattgactgttactttaaacactaatgcaaaaaaatctctgaaagcaatataagcagtgctaaagtgtttttatctttttttataaaatattagttgtcatatttgcccaccagaattcgatgaaattctcctaataataccacgtttatgtttctagaggcttatttttccttcttaaattatgaaggtaaaacacaactttgcataaatctaaaaaaatagaatatttatggttcacacaaacacacgtgtaatctgacatacaaatacataatgtaaaaatcaggcaaaaaataaaaaaaaaaccttaaggggaacacaagcataccatctcgtggacccacaggagggttatagatgggtccttttcactgcaaaagaagcttatgttttgctttggctctggaaggccattcgggggagtctaagagtctctacaaattggcatttctgtctctatggcaacacaaagctctgcctcagcaacaaaatgaggtcttcctatgcaatgcaaaaagcacaaagtggcatgaatgcagaataatatcgacttttctttagaaataaaaaatgaagacttctgtgaaatcaagcccttgagaacttcttgaaatgcagaagcacggccatgcgataggccagtcaaggttgaatccgggtccattaaaacagaaatgaggaaaggaatcctgacttatgtccagatgaaaatttccaaactccttggctgcattccttagaattgatagtaagtaccatttagagtccatgtattttaaagtactgtagatactatggaacgaagtagctaagggaaagtaatttgacctttaagttcaatcagagctggcaagaaataggaagtggatagaatccagacagcagtatggggacaaaaggcagactgagaggatgtagtgcacatcaccagagaaacagaagatgttagacaagaatcatggatttaaaaaaaatccaaattgaatgacacagaagcaaacatgaccggaagtgtgtgagttcggcactgtagatgcttggcaacagttttttctttgcaggagaaacggtgactagaaagcagtgatttagtgtagaaccatgagacagatgtagaccacaaaacacacgacactcttatttgtagagtagagaatctgaccatgtctttgtggagtttggaaacctcacacacacctaaaagggaagcacatcaccaggtggtcgcttcatcttcagggtgtctccagcctcactttaaggccagttcacagcaaagacaactaaggaagagccagccctgggggcgggggaggtggccaggatgcctgccacaaagtgggggcatgctgaccctaccctgtgggaaccgctgagccctctgacaggtgagccgcagaatctcctagacatcactgggctacgaggaggcttacccaggacacatatctcgctttttacgtcagcctggaaaatgtacaagaagttagttagctctcatcttcgtcacacagacttcaggaggagctttcctggctggctttttccatgcacacacagcatgccaaactcctgcacaacagcagggcagggagggtccacagcttctccagctgcttatacagtttccacaccacaggcaccagctgccatcttaacatggcacccacaggcacagcagaaaaaggttcacagaggaaagctggcatagggaagaggccaagaacatataagaaatgttatatctttttttgtcttttatttttttgagacggagtctggctctgtcgcccaggctggagtgcaatggcacagtctcggctcactgcaacctccatctcccgggttcgagcgattctcttgtctcagcctcccgagtagctgggatcacaggcacccgccaccaggcccagctaatttttgtatttttagtagagacaggatttcaccatgttggtcaggctggtcttgaactcctgacctcaagtgatctgcctgcctcgggctcccaaagtgctgggattacaggtgtcagccactgcgcccggccaagaaatgttatgtctttcatagaatgcttagcaattgggttcaagatgctctcaaacctgccctgctttttcatcttattgaagggatgcaaggtgagatagaggagaatttggcttaatgcctgtcaaatttcatggactgtatcagacatttgttggaggcaaaattttctaacacataagaagaaaataaggcctttttggggggaaacatggtgaaatttgatgaactactgaagtgccaacctgtgggctggactgttttggtgttttttttttattttcagagtaagatctttcatatgacagtgagtaagctgaccttcttttgtgtaggttttattttccttccaatagcggacaggatctggcagtgtactgcctggtatttgatctggcttaagagaacttccggaggaataaaacacgcttaaataaaagcatgtggttttctcaactctcatttagaaaagttttcctaattctcagtaatgattgacctcaaatccccagcctctcgggatgaaatgtgtttggcaccgttgcttaagtgtcgtggcagacgatgcttgatgctctccacatccattctcttcttggtcctcagtaatggggccaggctgttgggtaggcacatggccattctggataaagaccacatttcctgacttgtagctggatgtactcatgtcataagctgagaccgaggggatatatgcaattctgggacttggccttcaagggagaaggtgtaatctcccatcttttctccttcctgctggttcgtgtgagaagggaactactcgagctgccacctgggacccatagcggaagcttctctctgaggatggcgatgagcccacatcagatggaaactcctgggttctctgatgactgcggggccaccataccagtcccggacacccttcatttatgtgtaagagcaatatatttctacgttgtttaagctataattattttgagttttctgggactgtgcttatcccagtcttgactaatacaggggttcaatgcatatcagagctcttagagaaaaaaaataaccccatttagcttttagaatgatgtggatcataacagctggaaagagcacgtgaacatattaggaaaaatcagggcctgatttcatgttgaaaaccgtgcgccggggatccccttctgatgggactgctttagggtgacgagacttcctggtgggaccacaaccactgagttacttggaagaaacctaaaaaagagcctctcactctcctcacagagcttccgctgcaacttgagaccacatgcggcaagtctcttgcaaaatagtctctcggatggaaatggaggctcagcttatagaggagctgagatttatactattttttttgagatggagtctcgctctgttgccaggctggagtgcagtggcacggtctcggctcactgcaacctctgcctcccgggttcaagcaattctctgcctcacccttccgagtagctgggattacaggcacctgtcaccacgtccggctaatttttgtatttttggtagagacggggtttcaccatcttggccaggctggtcttgaactcctgaccttgtgatccacccaccttggcctctcaaagtgctgggattacaggcatgagccaccgtgcccagccaatttatactattttttgttatgaaaaaatcattattttaaaagcagatgctcagaagactgggggaaatattggattcagatttatacattaaacataatttatgtatctttcagtcatctgtaatctataaagtggtaggaacttttacgtttatggaagattctggattgcatttacttttatggagattgtcattgtcttagaaaacactttaaagaatgaaattgcactgacttaacatgagttaactaaacaatggttgatggggttgataaaaatgttattacaatgatttcatgcgtgctatactatgtcattaaaacattactaagagtttattttctctttgctttcagtgctgggttatttcttttctttacaatgagcatcagcattcttgaaatggaagaaataaaaaggcttcggactcagattggcagagtttgtaactgggtcagatgcagaattaaactataatggcctaaaattacgagttgattcaatttgtacttaaatttacaagcacaaataacttcagtgaatatattctttcaatgactacaaaatagatttataaggtttaaaaaaactcagtgggagattcaaaaattgagatttcctcctaaataggagataaaacagagaaaatcactttgatttgctggagttagtcagaagtatctcatgtggtcattaaaatattcttttaaaacatagttattgtgaatacctccattctctcatgtcattctgcaaacaacggaaacttaaagaatatacgagaagaattttgttcttgcagaagagtaaacctttttaaatcctggctttgtcctgatgctacgatggtgcgtcctccgtctttccaaattagagaactcagattctaaggctactttccctcttattgactaagcttaaaaaccgaagaacaagttaaaaaaaaagacaagaaataaataccttggccttaaaaataaaaccacagacagaagagaaaaaaagagaaattcttagccttaggcatcatataaagtggcattatttaaaacatttcctaattattttctgccagctaagaaaaaaaacctcaaagagcaaaagcaattaaagtgtttcattttttacaaagttcctttcacgcctaacaggagcacatagatagactatgtcagcgaatgggtttggtggtagtggttttgagattgtataaatggcacttcctaatacagaaccttagctgtattagagccctaaatttttacttatgtgcagaggctctcatttcacattcaaaagactgaatgtgagggtgagctattgtttgaagtctgtcaccttttttccaaaggaaaatgttttaggatcattctgaacatagaaggaaaacatttcagtgatggactaatttcatgctgtggttgtcattaaatctctttccaaggccagtcattaattttgttaaaataattttttaaaaatagtatctttaggttaaataccagcggaactgtcagcctgcaagtctcagagatggatgctttgtgaagtgctacaaaaggatgatccttcccacatcctcatgaatttacgtcacttttgtggaagaacaaggctcaagacagtcaatgccaaagatcatcctgtctccaggctctgctgaacctgccgatcggtgggaaatgacgggagacaatgagtccactgagaggtgatggagaatggcaggcactgagctaagataccttaaatgtgatgcttctcatgctgacggccaactgaaaacaatctcatcattacttcttattatgatatacattttaatttgtttttctcctcaatctgggtatagctgctatgcaaatatgtcttttaaatgtttggatagaggccacgcccatgatgttaaaagttagcaatcagtatttatgtaacttcgtaggtcttgtgagagggcgcaaatctgaatgcatacatcttactaattaagctcattgaagacatgcaataaaccacactcaagatgcagttacctttaattttggtggattgatctcctgttgataagaatatttagggaggagaggaggtgagcagggctgagaaagtgtagagtccaggtcagaaacagaggcgaagagagaatgaaatggaggggaggaaagcaggtggctgggaaagggtgtgggtgcttgctctcccgaagaaaatgacggaggcttaaatatcgaggaaagacgagaggtgattatgcttgtctcagaatgaggttacatgctctttacggaatttcctctcaacttccaacattttaaagttactaataaccttgggaagttatatttatgacaaattttttgctttgaaaccactaacttcctcttttgaatttgattcaaaatccccaatggtatgatcagtttaatttttcgcatgggggtggctggagataggaacacctatattctatcattttctcatatatttatatgatggctccttctaaaagtgaaggaaaaaagtatttaaaaccctgcaatgactgtaacttgcgtgtaaagtaggttgccaactatagtcagcgtgtcacaaagctggggaagccgtggccccgcgtgcagggtgtgagctggtgctgggatgagccggcctagggtactgtctgtgtcagcaaagccacacatctaatcacaccttcagattgattgaattgaaaggaatattagttactgaaataattgatgtagagacacgtttggctccttgcaatgaattatctatctgttattaaataaggtgtttgttttacacaaatgcaggcctggccgggttattttgaaatacaggaactatgaaagaatttgacttggatagtagcgtaataggaaccatcctttctgttatttcataatttctataattgccagtaattatacttgcttcttaattcacagggtacatttgtgggatcaagtttctttttatttttgaaatggagttttgctctttttgcccagaacggagtgcagtggcacaacttcagttcactgcaacctccgcctcccggtttgaagcagttctcctgcctcagcctcccgagtagctgggattacaggcacccaacaccatgtctgactaatttttgtatttttagtggagatgggggttttaccatgttggacaggttggtttcgaactcctgacctcagatgatccaccagccttgggctcccaaagtgctggattacaggcgtaagccaccgcagctggccttaagtttctctttttttttgagatggagtctcgctctgtcacccaggctggagtgcactggcacgatctcagctcattacaacctcctcctcccgggttcaagtgattctcctgcctcagcctcccgagtagctgggattgtaggcacccaccaccacgcctggctagtttttgtatttttggtagtgacggggtttcaccatgttggccaggctgatctcaaattcctgacctcaggtgatctgcctgcctcggcctctggaagtgctggcgttgcaggctcgttttttgttttaagagagaggtttgcaagctaaagtttctggatattttctgcctttgttgattaaaaccactgttcaagattcttcataacatgaagatacagtacccagttcttaagtagtcaatgtgaagtcaacacaaagagaacgacctctttagaaaatcgaaaggggacagaagtgctgtttttcttttctgttgtctttgtttattattagcattattatttttgcaaagtgccgttatgtcaaaggtatggtgtacagtttctcatcctggaataggacaaatttctgggcatcaacttcctcttctctaaagtggggatgataatgtcacacacctcactgggttttgacgattaaagatgtggagtttttagaatagtgtctgatactcagtaagagctccactattagctatcattgttaatattggaagattacaaagactatatcaattacaaagacttttacaatataagtttatggtcctgaagaaaaatgggataatggaattatatcacatatttacatcatttaattaaatatggtgtgttttcatatacccactccacccccatcttatatagtatttgtgttttttgtttaaaaaaatctgttagtcaaaataggtatttattaatatgattaactctaatagctaatcatggtaaggccggttagttcttccataatcagacaaaattaaaatacctcattactgggttttgctgcattgctgtcctccttgggggtcctaggatctgtgggggtggctatggggtgttttaggcagttgggtttctcctcctcctcctcctcttcaatgtgcaggtgtggggtgccctctgacccatcgtggccacaccaccaggcgtctccttcctgaggttctggcggccctctctggatgcctgacacaatcccctcatagatgccctcatcttcctctccaatgaccggaaggggtacaggcaaggaacccacgctggtgcacgcagaggccacaaaattatcccctaggacttctggtgcctttttagggtctgagaagccccttctcatttttctcaactctgcaaagttgctttgagttgtcgttctgggatcctgaagaggctctgcatggtaaggctgggctgcagccgaggccacacccgcgtgagtggaaggtgattcggcaggtgcagtcgctggggacaatgggaggaggacagcaggttcctccttaatttccaggatggcgtcctctaggatggttggtttggcttggtcagctgacaaggttaaagcaccaagcttctccaattcacccaagaagttgtccaggaaacgaggtggtgttggggccaaagggtttgctggtagacatgaggctgtcagggacaaccagccctggccagttccctggagagctcctttatctgagccaggtgagactttgtgggtgggaggaggggctggttcactggaagccaacttggaaatgagcacggattatgaagttaagaaaaaataaactaagaaaataataataatgcatcaaaacatagcgatggagaaatgcagaaaagatgcggtggtgaatatgaaaataattttatgtttaacatagatttgaagacatttagaagatatctagatttgaaggtattttgctgaaatttaaatacataaaatcatttatgttaattagaaaagttacttcacaaatgaaactctactagttttggaaggggtcttaaatgtcaaacaagataaagatgatatagagattaccaggacagtaaaaccttgagagatttatttttatttatttttaattttttaaaaaattttttagagatggagtctcgctgtggcacccaggctggagtgcagtggtgtgatctcggctcactgcaacctctgcctcccaggttcaaacgattttcctgcttcatcctcccgagtagctgggactacaggcgcatgtcaccagtacagctaatttttatatttttagtagagacgggtttcaccatgttggccaggctggtcttgaactcctgacctcgtgacccacccacctcagcctcccaaagtgctggggttacaggtgtgagccaccgcgcctggcccttaagagatttaatgcttacttactttaaactatgttgaaaagatattacaggtttccagatactgacttagtagagtataaatgactccagagaaatgttaatgtagaatgaaaactaatagtgaagtcattttatttcctgaatgtgtgtagtgttctcttgtcctgcaggatagcccaatcttttaaacgctgacaattttctcacttatgtttgcaaggtgattacaacatatgaataaagtattttagatcattatatgttaacaaatttctaagtgaataagttctgaaaactatgtctcaaagacaggaacccatgatcagaatgaagctgagcttacataactacggcttcaaagttttaaaaaatccaaagtaaatatttacatagaaagctcatttgatgctaacgggagggaggacttctgcttcagctcccgttctctttcaaagcttgacatttatgtaaatcagaggaggtatgagttatgaagcttaatcttctgaagtaaaatatacttacttctacatacgtagtattactgatgtattttggatatagtaaatgaaacaatacatttgaaattttatgcaaaggtattaaaagtagttctgataaatatatacaccccatatgtacccataaaaattagaaattaaaaaatgtagttccagaagtgccacttactaacattggaatacgtttatctacccttaccggactagagaaaatgctacctgctatgtgcctaaaagccttgagaagggacctttcactttaggtctctccaggtagatgtctttgatttggaaagaaaaacatctccaaaaagattctggagatacactttccagctgattgtttaggataacactttacacagggaagcagccctcttgctcctggggacttagtgtgtgtgagtgggtgatgcatttcctacttaacttttgactcctgtgtcctatagtaggagtggggtattaattagatttatttagctttttttttttaagtcatcttatcgtgggatgacataaatatcacaaaactcatgtgagcatcttaatacaggattcaggacctgggctgcttagctgctgacacacagtgagactgcacgtgtggtttgcgcctaggtagacagccactcctgttaagtcctgtagatgctgagttttcaatgatataaaccactcaagtctcattcagcagtctacagaagttcccttactagctagagttctagtttataccccttgttacataacacagaagttttcatagttagatttggaaagtctgtgaaatatataataatttcagaccatcaggtttccactttcactttctgttatgccaggaatattatgtagatgagaaagaaagatcttgaattcccttgtcattactgccaccatcaccattgctatctgatgctgcgactacgctgtgccgtcaccaccacagtcaccgaaatacatgtcagcaggttaaactgcttagctttatgatggacttgcttataccgaaagccaaatgaagcatcctggtataactagatcacaaacctatacctataatacaaaacccatacaattattttgttttccaaaagcatcagaattggattctaatgcactaaaagcagaaatatcagaaataaaatcaacatacattttagtctcccctaagacaaagacagtatgtcaagaaatgtgatttaaatgtgtcaccagagtgatttataaattattaatgagttctctgtttgtaaatatcagttagaaaataggttctgtagcgtttagtatattttggatgttatcatttagaaatacattatatttatctttctaaaaatggttgtcacttccgggaagttttcttcattaagcctgtgacatcacagcatggattaccagttgggataaaaccattaagtatttcttcctaattatggacataagcttctcaacatattttttccccagcagtgagcaataaaaaactggttattagtgaaatttgtacatgcctctgtttaaaatctggtattactttaaaaacttgaaaatatattcaattacagttaaattgtattcacatcaaagatgaaaacattgggatcaaaaatattatattgccattaaatattatattaggacatatggaagaatttgttagatgtttaatgagcttttgtacatacatgcttttcttccttacaacattttatttgaaggtacagttgctttgaaatttctgtgatagttatttaaagatgactgaatggtggataagacaaatatatgcatgaagattcttatcttttctctttatcaatagaaaatactgaaggaaggatgctgatctgtaaatgctaaggtctggtaatgaagtaaatatacttaagaagattctggaaaactataaccaatcaagcaaacaaaattggatagtaccaaactcttccatatattatccatgaatacagggttgagggtaattatttgcaactgaaactcagtcttcaaagaggatcacaataaataaaatgccaagacttcagccttctaaaaaaaaatgcctctcttaagatggcagattcttagatcatttcctcatataaaatccttctcaggctcattttcaagaagtagtttaggtcactgggatgctatcttgaaacagttttttcatcggaacatgaagtgacttcacactttagtaacatctgatatgttgattttattttaccagctctcgatggtttagcttttcatgtcctagccttgatctcaattaaaataattaataaattaggcaacttaatacattttttgaatgttgagaagtacttaaaacattttggaagtcattggcaatttaaagttttattcctagaagttaatgagaaaaaagacccttacatgcctttcataaaaagaatataattcatcagaaaaataagaaaaaatttcacattgtgagtacagacaaatagcctttttacattcaccaattaaagaagcaaagcctcttttaaattacgtattgagaaagataatcatctttagcccgctcaagtgaaacagtagaactggcatataactgtcctaaaactgataaaacaaacttgaggacttataataaccgacaacattttcatttaaactaataaacatcttgacttatagactctaattaaaaatttttgctctagctcattttccatataaaaaacttgtatagatttgtcaacctaataacccggtgttcttgtgatatactattttgagatatacatagtattttgtgttgtgtatatttatatttcaaattataaatcacaattgtatatacatgtatgaatatatgattatatttatttatatgtaaagattatattatatacataaaatttacatatataaaaatgaagctttaggaaaaaattatttcagaaaacatttatgtacacaggagtacagatatatatcatacgagacttcatgatactctcgttttctctttctctttcgatattttaacttgaaaatgaaatgagcaaaattaatcattaaatctttatgccagcacctatttgagaaacactgacttatatttactgatgtggcactcacacatgtagaaacataatatgtaaatctctttctctgcaatagatatgatattctaatctaatatcctaaagtcacacaccgattatcttacttggagcttccaatattacattaacatgatagagtatgttcttaccttatttgagctcaagctgtgaatcctatcactagaatagctgtggggtattggagggtcagggtagtcctcagcaccttttgtgttcttcttgacgacctccacataggaaacagggaagatgccttgtctgttggttcctgggattttaccttcataccagttttgatcaactcttttaagaagaataactctatctccctgttatgaatatgagaaaaatgcattagaaacagagatagaataacatgaaaatataattgtcaatgttttctatgaaaaaataggtttccatttgggcaggttttataccttcagtttttgtttaatcaggggagggcaagtaaggtactagtgcttactagaaaaatacacatgatcaacatatatgtaattgaaatgtccattcaggccatcagaatcttccctaaggatgcctgattaatgtgaacgggtttatacttgtttatgctggtattgtgtgaaattatttgtctaagttatttcaaaaagcagaatagtgtaaaaggtaatgtctcaatgacaataggattattttatctctggcaggttcagtgcattggccttctgtaggaagagcttcagaaagtgcaccatagcttgctgtgagggtctgtctgaaatgggttacagaaaacacctctagaagggagaacatcgaatggtacaccgttttctttttttatttctattttttttttttttttgagagggaatctcactctgtcacccgggctggagtgcagtggtgtgatcatggctcactgcaacccgcacctcctgggtttaagaattctcttgcctcagcctaccaagtagctgggattacaggcgcccgccaccaggcccggctaattttttgtattttagcagagataggggtttcaccatgttggtcaggctgatctccaactcctgacctcaagtgatctgaccgcctcggcctcccaaagtgctgggattgcaggcatgagccactgtgcccggccccttttcttctttaatctacatgcgctaagtagtgacagagtgaactaaagggatgggggaaagagagcgccctagaatatcaatagctgtgacaagactggcattcccctggtcttcaccctgacaatggaaacccagcatccatctgagtagttggtgaccattccatacttgtcattaaagatttgaatagaacccttggctttcacaatgatagaactttctagaatcacttccacctgccatgaccgagccagtgctgcagaactcagtttaaactttaactcaaaactacacgtagcctagaagtaggcaggcaagttgatgctaccgggcaaaaactgcagctgcattcagcaggtgatacagaagctcgggcagcggcacctgatggtgtgatggagctgaaacagtcattaatctcagcccaacagggcacccttcttcaggtgctacccaagaagaacttcgaccttgagtagcacttggaagttctctttgtgttgaaacgctggatggttgattttgtgtgcttcaccaccgctgagcagaacatactcaagaaaagtcagtctcaggctggatgcaatcgctcacgcctgtaatcccagcactttgggaggccaaggcgggcggatcatgaggtcaggagttcgagaccagcctggccaacatagtgaaaccccatctctactaaaaatacaaaaattagccgggtgtggtggcgggcacctgtagtcccagctaatcgggaggctgaggtgggagaatcgcttgaacctgggaggcagaggttgcagtgagctgagagcacacattgcactccagcctgggtgacagagtgacactccatctcaaaaaaaaaaaaaaaaaaaaaaagtcagtctccccaaatctgaaaattgcaccgattttctagtataccaagaacaggtagttgctaggctgttgtgtgagctgtaagaggcattggtgaagcctttctgtagaacatggaacaggagacagagttcatgtaatgctctgtggttctcatgctaggtggggcagcccagaggataggaaagaaggaatcggctgatgatgcagaattaagactgatgggagagaatgagacaaggttctgccaggaccagaacaaaccaggactgtggtattgctcttcatcgcacctggctaaggatttcactagtaggtgtgggaggtcctagagccactctaaatattactacctcgcctgtgttgtgtgcagaggcagttacctcaaacaaatatatgtcatatttagaaagcaataagaataattcatttatcattctcaattatgtaaactagcaggttaaaagaggtttttgattgtttttttgtgtttttttttttttttttttttttgagatggaatctcgctcacctgccttggcctcccaaagtgctgggattacaggcgtgagccaccatgcccggcctcgaggcttttgatattattaagaagagatactaggattggatgggctgctagagaaatttgggtcaattatgaggcccaaagaaggatgatccagggaagagcactgcagagatggctcttaaagcggctcccccaagaggaaggatcttctttacctaggaccattcctagattccaagatagaggaagataaggattggaatatcttgtttttaaaagactgaaaaataaggcagcaaaacaacatattttgaagtgtatcaaactgctttttccttttgtgctcccgaatgtataagtccttgattttcagccccatgcccggcttcccagactaagccacagagggagaagcctggtatcccacggggaactcctctaaaaggacacagggaccagcagggaaccgtgactctgggctgccttaaagagtcctttgtagaaaatagggtaaacataaaaatgtctaaagaaaaagataacctattttagttttgaaaatatacagccttttcaaacccactgaagaacaaacaaacaaaaacaaacaaacaaaaaaccagctgggctacctttctcagtgacagctccacatttgtgtctgcgttgaagttgtatttggctatagcttctccgatttctccgggctgggctggcggaggtggtcttgcaggctgtgctttctcaggaggtgtgagtttctatgaaggaaatagtcatttattctcaaatctgcggtgacctttgaaaccaccgccatccaagagagaaagggagaggacctacctctacgtatgagatcgggaagatgcccactctcccgtggtgttctccctcataccaattttgatcaattttcctgaggatgtagacagtatctcctttcttaaatgacaactccctggaagagacacgttgacatggtctttttgtgatgtacagcaataattctcaagatcaacaccctcgctagatctgcatttgtttggcaaatatacttacaatattaaaaaatccaattgatattgagtccgattagataagaatgatccttgcaaattcttagaatgcacttaaaacattataactttagaaatgatttcaaacagagtaagtataaacattccattggatataaatcacagacagattaataagaagtttaaaggaggggacagactcttgctactttaccattagttcagagaagaggcattttgaagcttggaaaaatgatggaatagttctgcactgattttttttttttttgtcctgaagctagttggctagttagttactagccccccagccccttttgatgtactgaagcttacatgaaggaaaacaaatatcatgtagcctcagaatagaagtgccaacaccagaacaaattttatttgtggatctttgaagttggttgacaggtattttaatagaatatcttgataaggaatttattttgtgtaacagaaaagatcttacacttttaattttcagtggggcaagaagaatgtgttttaagtgcaaagacatatgccaatgcttgcctttctatcttttatttacaaaaaataaaaatatttttaagacactatatttttcaattttggctgtttctaagaaaattgtaggtatatttgatttgggtatttataattttaagttataatgacattatgcattttgaataattcacacctaaacttatcaccttcactacatcaatttttcctggcttaatcacccaggtgattaggttggttcattattttgcctccgcaattattcttggatggagggcgattaatttgtatcttctcccaagagcctcattttgcaatacatctgccctcccactctggaatcttctgcattgttttgttcagaattttcattttttaatctttttttaaaaaattttggttcagaattttcagttggatcatttattagtataggccgtttgatggagagagatttatacctgatggagaacacttctcattgattaaaagaattaatcgaaaaaatggtggtatattaaaagaatgatcacacatttagaagtgctaaaatcttcacaattgaaaatgtgttaaattttcagtaaccctaaaaacaaagaagattcatggagctttacattcaaatacagtgcttccttcttttgtgcaaatgcctaatgtaaaaaacagaaaacaaagcaaagcaagatatttaatgttcacaacacaacagtttcatttgtactaggtatgttttgtttctggaaatgagactagctttttaaaatataatatgaacatatgaatcagaggcaaccaatttttcaaagctatgaaaaagactcttttgtatttgtataggttgcatttaaaattttgaagtccttaagacacaggaaagtcttactcttaagttttcaaaactgtgtccctctcatctcagacctagaattttaaagtcccatttgcttttttcccctcacttttatttttatttgtttttgagatggagtcttgctctgtcacccaggctggagtgcagtggtgtgatcttggctcactgcaaccttcacctcccaggttcaagtgattctcccacctcagcctcctgagtagctgggattacaggcacccaccaccacccctggctaatttttgtattttcagtagagacggggtttcaccatgttggccaggctggtctcgaacttctgacctcgagtgatccatctgccttggcctcccaaagtgctgggattacaggcatgagccaccgtgcccagctgctttttaaaattaagacttctcagaagacctcgtgagccttgggtggacacccttcctacttcacatcccctgccattcctcaggtttttatatatttaagaaagctatggattgatttttacaaagaagaaatgaaacgtgtgctccgtaacattattttataaaactgatatgcattgtacaaattgtcacaccatatccacagaacagtagttaggaccggagtacagtagaaacaaagcatcttatttctctaatttgaaaaaaaaagatgtaagcttttcttcaggccagatttaagccatgttcaacatcttaatttctaaacaggatttttcttatctagttcatttcctatctcagcagcattaccaaattctgagtgatttatttatatatgtcttctgccagagacagtttctagagctattaactcatattatatgcatttttatgagtaaattattttggttattatatatatatatattcagtgtaaacaacatataataatttaatgacaatttacaatgaattcaatatctgtcttgaattctactggagaacaaagtttcttaaaggtctgtgcacataggccacaaaaaatctgggcaacaccctcttatatataagtctgcttatgtgcttccgcaaccacatgcctatctgctgagcaaagaataaaggcaaaagaaatattgcaattcaggatggtgaaaacaccgacaccaaaagaccaaaggagaaaactttgctcagaatctctgagctttgcaggctgaggatggagacttcaatacaggaatctttgtactaagttctagtcatcaaccccacaaactatgcttggaatatttggataaataaatgttatcaaattcccccagctagtgttaattactccccaatactttatttatttacttattcattcttttttttgagacagggtcctgctctgttgcccaggctagagtgcagtggcgcaacctcagcttatggcagcgtctacctcccggtgaagcgatccttttgcctcagcctcctgagtagctgggactatacaggtgtatgcccccatgcctagctaatttttgtattttttgtagagacatggttttgccatgttgcccaggctggttttgaactcctgggctcaagccatctgcctgccttggcctcccaaagtgctgggattacaggcatgagccactgtgcctggcccccaatacttcattaattcattattgacacaaaattctaaaaacaaatattcctaaattctttttgtttttcctatcctttagaattcattgtgttctacctaacatgtttaatgtaatttaaaactcagtaattctcaactaaacttaaaataaaaggtaattctgaaggaaccatttaattagagtagattgctgcattgggaattagacctcatttgtaacagatcctactgcaatgcttatctcttaaagcattactaacatttaaaaccaccttaaatcatatgatgagtatttatcttacttacttagatgtctgagccttaaaatcataaacagcttttgcaggcaatttctgaaaaggaagataaacaattagcactaatttaaaatttgaattttctacaagaaagtagtttaatgtgccttaaagaaaaaggaaacctcagggaatcatcaaacatatgtaatgttaatcctgtaagcaatttataaataagtccattcattcttcatttagatatttaagctataataggaatataatagaaggcttattcaccatcatatttaatcttaggaactaaggtagattaatgttataatgagagaataaaatgcctgcagaggtttgcatcctaggcatcattttggctgttacaaaggctcttcctaggataaatgtggagggtcaatggctctatgttctatggagattgacacagctccctctgaatcataataaaaggaccagatgtcataaaagaagtaatcattcccttcattagacacttattaacatattagcaaaaaatattagctcaattatcactgggaggctggttagtgggcaaaagtataggtgtgatcatcttgcattccctagagggctcaggaatccttcaacactctgtccaccagccactcgtcttttagttgtgatgtgatgtgacacgtgcccatcctcaaactctgggggccacagatctccctgaggtaccctgtaccctatagctagctaggccagctcttccttcctcaccaaccaacaatcccttcactccattcttttcccccatgactctggtgaactttaggaatcctggaccatttctaacttctttggggatcccacaggctctggactacatcagacgcctataagatcctctggagcggctaccagtccaagtccagcttttagtttccatccagccgtcatggctccaaggcagtttgagcaagaactctagccccggctcagggccctggacagagttcagttggtgggtggttcccaggggcagtatcccgagaactgggctggttaaaagctctttttagggatcctctccaataaaaggaagccagcaaaaatgatttctgtaggctctgtattgatttacaacacagttgacatcaggctttctcctggaccagcgggccaagaaattgtagaggaaacctattgcctccacgaggtgccctaactcaggacacttttaggtcataatggttaagttcatgggcatcaggtcaagactcggagaagcctcatggccaaaactgggccaccactagggaagacccacagctagggtcagggtgtggactgcttctagggtcagagttgctatgctcaggccccaaggaaaattgtttctagtttctcagtattttcacatttcctgtccgagttcgttactggtttgggataatttttggctggtaagtgctgtatcaagtgtgttgctgtgaaagactccaatgctattaaattaactacctctttttctggagttcctcttctttcccttggtgcacttctccccatgtcagtcaaagtggatgagtaacttctaggggactcacggtctattggaaagaacagggccagtcatggtgagtatccacttaattacaagccaacctgttccgccattttccctggtggccactacttttttccccaaatttggagagacaccgttatcgaacacatgggcataaaactcatagttcattacaaagttgtgaaataagacacaaaacaagagcatttcaaaaggaaaaatatctgaggttgcagaattataattgtctatataaatatgattactacattgctgattaattatattgccacacccagtaagacaatttatagttagagggatttttcatataaattttttccaaagctttctgtttctatgcctttgcttcttatttataattactattataagatttacagaggatggagaatttgaaaatagcaacaatttgtagaaaaagaaacattttgtggagtaatttaagactgtagtaatgaaaaagaaagagataaaaccaaagaaagtatgaggatgacaggagggtggtgatgaacattctccttctgccttactctcccctcttcgctcttcctctgtttttaaatacttattgaatctcaagatgccatgctgtttatctacgaccttcctttgtgcccagatgataaacaccttatcagaaagcaaagaaacaaagagatattgtttcttcttactccaagcaaaaaagggataaacagaaagcatcatgtcagttgccaaattgcttatgaaatattgaattatttttgttcatcttaaagcaaagcataaataatcacattacaaaattttgattgcatgtagttcttaatagtatcttataccttttgcacttacgtgacttacatatggagatgtaactagacattaaatgtattccagtagtctatgttatagaattttatcagtacaactgggtcaatatttgtcaattctttcttttatcccttaaatatatctagttatccagactaacaagaagcattaaaaataaaatttattttatccatctatgaaagaatttaaagtgctgattcataataagaaaacattgttttaggattttgactactttgatgatgtaaattctaagttaatatacttttatgatcatagggcctcataatgatcataaattttaaattactttttctaacccagggaatataagctatttttcacttgggtgaaacacaattggaaagtaaatattttactaaaaaacaaaatacttttaaatgcatttcaaagcccttccaagttacgtttcaaaaatgtactcctatctgcacataaaattgagagatggttatattaggatattaaaagcctggagaaggtagctaatttattaaaaaatgagattctgacacatttcaattagtgaaaattttgaattgtagaaattgattttttaaattctaatttattattttgaagcatgttgcttcagcctaagggtaggcaaagataaacgtaagtgtatagtgtagcaaaagtgaaagcaaacataaagactaagtagatttgtgcaagttaattaacaatcgagccatatttgacactagtatgaactgtgaattatgtctttttttttgtctgagattatattttatactataaattctgaattattaggggtttgaatctcttttctgttatctactctctgtgtgaccttggacgaatttcctttcctctctgggcccaacttccaaaattgaaaatggcttttgaaataacacccatttcataggcctatgccagttttattagataatgtatgtaaagcactctgtagtgtctggtgcatagaagtttctctgttgaccaactttcagcccggaatgttcattccagcctcttaaaatttacgtagtgaacagatgtgctgtaagaattaatgaaaataattggtcacaaatattaaaacaccctgggctgtaagttatataaatctcaaaaatagtcctctgcctttcaattgctatttattcttgtgttgccacttcaaagttatctatgaaaatagagtttagagtcactgttagcctgaatagtgtaattcaaatttcaatacaggactgttttagcagaaagagaaagtgaatgaattaagtaatggaaaagagaaaatgaatacactaaatggtggaaatgggacttttatatatatagcttaaagatacattcacaaaaattttatcaccattgtgtccttgaaatggagaaagctattaaacaaaccctaatttctttgtgtccatcaattactaatcacatatttcagttttgcttcttgaatgttttgatatagtatcttctatatagaatgtgacaaattatttattaactgaatgaatataaagttttaacgttaatataaacatttttaaaaggctatttgtggaactataggttttgattcatgtcacaacgtaatttattgtctcaatgtgagtagtggttgtttcaaccctaatgctgagctacaaaatggccttccctctcgttttcgaaagagtaaatttttgtgaattgatgatcactttaagccacacatcaagtccaaatatcacatgggcaaatgagaaatattcagtaagacatatttgcacaacaagtttttgcttcacaacacataacgacgccaaatggtctcccagctcgggagtgatgagatgttggaatggaaaatgaaagagctggagggtgggtctctgaaccacaaggaaaaagaaagaaaagctcatccaccttggagtgcaccgccacggtcttggtggtggcagctgctgttggctgtgtccacgtcttggaaagaggcactgcggggcattctcccgcagtcattctggtagggtggacaatgaatagcaccatcgggaggcagtgggtggagaggctggtgcagggggctcctcctcagcgctctcagggatgagttcctctcgggaacatctggcagcagctcactgatgaggcggtgcaggatgctgttgtccggcaagctcccccttttcttttcagctttaatttggtcacagatgtctttaagggcagagtccagagcctcaaacacagatgctttacattttgccttttcagtctgtttcttaggagccgaattttttttcctccggaaaggcacaggactgactagaaaagcaagtttagaaaggccagggtccatttcttgccttctgggctcctcggtgttttcgtgtctggctctttcgtgttttaacattgtggtaaatcgagtgtaggaggccgggcacctgcctttgcaggagctgatgaggtggcggtggtggtggtggtggtgatggtggtggtggtggctggatccgtaaaagctttcggaggatgtgaaggaaaagtgatcaaagtcactttcactgcagaaggatgacccctctaggtgaatgtagtcactgtggtcggacacaaccccgtcctggtcgctgtcggaaaactccacgtgtgctcggggctgctcatcgctggtgacttcaatgtgaatgggcaccagggcgttagactggcagcctcgccggccccgagcgggggggccgctttgattttcttcctccagcaaatactcaatggaaaaccgcctcttgggacataggccattttgcggtggttctagggttacgggagacagcatgtcatcccctaaatttggcatggatttggacttctggatcagcttttcgaattcggagatgcgtgtgggcaccatgtcccggggcacctcctccgtggagcactggctccaggcgcgcagcaggtccttgtgctgctgctcgctctcgtactgcagaatcctggacttcacggagcagatcacctcggagttcatcaggtccttgcggttgatgcggtgcattttcttgtacatcttcaggaaccccggggcgttgcgggctgacctgtgtctgatccttgatctgccgttactgcgaacctccgggacgtagggggacccccacgccatggggcagctctccttggagtcctcctcacataacagggagcccatgctttccgacttgactttcgggtccgggaagctatcgcagtcgtcgtttaggagatcgtcacagctccgggatttgattttgggagagacggtttcttccgtgctgctccagatttctgcgttttgccgggccatttgccagccgttcttgaaactaatggctcttggtgagtcccgagggacatccaagtgctgtctgtaagtgctacagtaatctaactcactggaggggttgccgttgagccctgagtaactgcaaagggatggacatattttgctatcatccccaccttttaatccagagcagcgtggtagaagagagacatttggagaagttaaaaggttcacaaagagaggagagcatgtcagtaaagcatcagacagcatagcaaggagaaagcagttagtgtgttttaatctaggtgctgattgttcacacatggagcttcaactctagagaagaaggtctaattctaaagcgagctaatactttttcagtgaatgtagctttgcagagagagttgacaaaactgtgtataagaagcaaccgacgtaagcaaatacacctactcctactgcataattcatacacctttctgacaatattgtttgccaaaacacaatagtgctgcttcagctgatagcatgatctggtagtgaaggtttaacaattagtgtcaaaagtgttatacccttacgcaatttaatagggccggaatttgagcctcatttgattcgtaatgatacataggtgaagaagggtttatacatttacatcgaattaatactctcatgactatatcaaataattttttgtgggttttagattttaaaagctataaggcaaagtattctccaaaattgcaaaatcaaaatgctgtgaactattgctgctaacatttttctagaaaaaaatagctaaagctctttaaacaaacgaatttacctcttaaattgctctacctttaaccttttattaggtacaaaattctcataggaaaactgaatataatgcaaaactttcatcagaggtgcatataccatgctttttttctcggaagagttctttgaaaaatcatttgcaatttgataatagagatctacatttggcctcaattttgaatagctatggaaatgttcttttgctttgctgagtcaactaataaatgaggagccaaattatatctaataggacattttcttcctagaaataaaatctaatggaggaaaatatctctattcaatacttataccttacaatgttctctaaattctttaaaagtagataagcacattaggtagatctgtactgtctgggaaaggaagttgatttaacattccctgtgatgaaacaaatatctacatttatcagaacccttttaacttttggctagtatccaagaataataggtcaatggcatttcatgacctacttgttaccttaagatattcatttgaataagtgagttgaatctgataaggcatctctgctcctcagaggaaagatgtgatggatggggctcacacgccctgaaccatcagctgatatcacagctttacaaggccttaaaagggctaggcatccacctactcagagtccaatcatcacgaccagaataccttttgcacacaaatcagctaccacttttaactaccatgtggcaatggttttagtgactatagttgataggtgtagctgaattggtctggttttatagaaacttacattagagctcaatttctttacacatttcaaaatctctttctcttctctttcaatcccaagatattagaggagattgtggggtcccacatttggtagagccctagctccctgtaggggctggttcaatcctcactctccatctcagaaatattcctgtcctcaaggaataccactaaatggtcttccagaaaccagaaggagtgacttctttcaacagtgagctccctacacttgcagagaggagacgggccatccagaaaaaaaggcttggtgattcctcagtgatatcattatggtttgggaccaattagtcctgactgtgagctgctgtgaattgaccactgtgttacatggcaggaggtggatgctccactgttcatgtgaaggtggcccaaaatatacagcaaatggctaaagaaattaataggtcggatttttttaaaatctagaattgaataattttttaaaaccctccaaaccaatgtatattttagccaacaatttgctctgttgctgcttgtaatttttatcctataaatttgactaatttgctagttgtagaaacattagaaaattttgactatatgtcaatgtttacaaaatacatcttttagtagcctgatgatacattatttgatactttcaatttgtttagaaagggatctatttgggggaaaaaagcattagcagatgctagtcagagttctttaagcaacctaagtggctcgccagcttgagtcagtctgggtgggaagaaggctattgttctaaaactatattttattccagacactgtaggtgagagctggcacatgccactatcactgggccagctttcacacagtgctctaggctaaaacgtaaactagtaaattgttgtgttttcatttactatgctcaccttttgctcttgatggggaagaaggagaagagctagtgaaagactttgtaagagtggtgcttgatcctgggaggtccactcggcctgggctagtcctgctcgcactttgatctcccaagccccgtggtggacccactgcaggctcgctcttcctccgcttcctgaagtcactggccatgcttgcagaactgaaagaaggaatcagatctgtttgattggcactggaggaggttcgggtgtgcaccagaaaaaccggtggaacgtgctagtgacaatggcgtaactcctaaacctctatccccaaaactgcattgctaggaactcatcccttgatgttcaacatgatttctctagaaggatcttttaaaaaatgaatagaccttattatttattttgagatggcttctggctctgtcacccaggctggaagcgcagtggtgcaatcacagctcactgcagccccaaactcctgggctcaagggatactcccgcctcaacctcctgagtagctgggaccacaggtgggtgccacctcacctggctaatttttttaaatttgttatttatgtagagacagagtctcactatgttgcccaggctggtctcaaacccctgagctcaagtaatcctcaagcctcagtctcctgaagtgttgggattacaggcgtgaaccactgtgcccggacaactaaatttttttagggcagttttaggcttacagaaataatgactggaaagtgtagagagtttccttatagtccctttcctcttgcacagtttcccttatcatttacatattcttttggtgggtacattgtcacaattgatgaatctttcctgatgcgtcgtcaccccaagtccatagtttacatttgagttcatgttttgtcttaaacattttaggggttttgagaaatgtataatgatgtgtgtccatcattaatgtgtcaatcatataaaatagtcttcccgccataaaaagcttctgtcctccagcttttcatccctcccttcctcccgctcatcctggcacccactgatctttccacacggcctccacagtttcgccttttcaccatgcccagttgatatcatgcagaatgtggcctctcaggttggcttcctgcactcggtgatacacttttaaggctcctccatgtgttttttgtcacttgatagctcatttctttgtattgctgagtcacattctattattacatggatgcgccacagtttatgtatccattcacctattgaaggacatcttggttgcttccaacttctagcaattataaataatgctcctaagaaaaccacctgctggtttttgtgtgaacctaagtttttaaacatctttgaacgtcaaaattctcctatagtgtaatatgttgattgagaattcagtgctataatttgtatcttgtatcttttctctataaagcggagttctaacaacatgaatatatccagaggggcataccaaatacaggaaataactgaaaaaaaaaaaagacatcaagagaggaaaatctctctcacctcaagggttgcctgcagcttgtcctatcatctctatcatcttagctttagaagatgttatattggaattccaacattttttatttaaataatgaatgaaggctgagtatgatggctcacgtctgtaatcaagtactttgggaggccaaggctggaggatggctcaaggtcaggagtttgagaccagcctggacaacctagtgagactctgtctctacagaaaataaaaaagttagccagttgtgtcatgtgcctgtagtcccagctattcaggaggctgaggtgggaggatagcttgagcacaggagtttgaggctgcagtgagccatgattgcaccactgcactccagcttgggcaacagagcaagaccctgtctcatcagtcagtcaatcaatcagtaccagtaatctggtcagcaaattaactattaaagattccttcccctcagttgcataaaatactgtcaatagtctagaacagcagggagtttctgtcatggttttgagtttgagtacagtatcatttaagaccaatgttaatgaatgaagccacatatggcacagcacactgtgcatgaaatcactggattcttagacaagacttgtgtagacaacagtgataatagcaacagcagcaaccccagctcctatggagcccagcagaatgctatgtgctttctttatgtttttgtcttatttagcccacacagcaaaccgatgaggtatatgctgttatctcagttttacaaatggtaaagtgaatacatgtgtctgggatgtacggaagcaagcggagaggcagacctcagaactggtttgtcctcttctgaagaggatgcatctcctagacctgtttttgctgggactgtcctgtcatgtgagggtctgtgtgtctttacggcaatctgtagattagattaaaactctaaaattcaaatattttaggtgcatagatagaggcagaagataaaaaggaggggttccagagttcctttctcagggatgttattgcagttggatggcactcagaaacccaatttatgattgacccaattcacaaagaaatctacatagaagggtaaattaatgctactagataaatatttgttattgatgttacaatatggctgggagtttgtattattcaatattactattgaactatgtctgaatatgtctgaattttgtgatttgtttttttttttttttttagactgagtcttgctgtgttgccaggctggagtgcagtggtgcaatctcgactcactgcaacctccaccctcccaggctcaagcgattcttctgcctcagcctcctgaatagctgtgactagaggggcatgccaccatgtctagctaatttttgtagttttagtagtgatggggtttcaccatgatggccaggatggtctcaatctcttgacctcatgatcttcccccctcagcctcccaactgctgggattacaggcatgagccaccgtgcctggccatgaattttgtaatattttttaaaaagtgtgatatttaaagctaatggaacttacttcaggcgaactctgagggaagttaggcctagcggtgacaagctatcttgcctcaatttcttttttttctctctccttgccaactgtgtaaacttggtaagttactaagcctaggtgtcactttcctcagagataaagtggggacaatagtatttaaccatagtgttttcttaggattgaatatgttttgtacttatgcctcatttattggtagtattaataacagtatttctgatttgtgtggtcaaagtatgattaacaaatacgtgtataacactttttaatctataatttttttcaaatatattattataagggccatttaacaacattgaaaattagttacttataattcccatctaaagaaaagaaaactgggtataggggactaagggaagagaaggatttctcagtctgtgaaggaatttataattagttcactaattttttagaaattcttgaaatgatcatataaaatgatgctgaaacaaaataaaacaacttcatgaggcatggtacttcaaataaaaatgagtgatacatgatactcattactacttcactgaataattttattgttgaaaaagaaaccactggtatagaatattctgctacaacataataagattcttacctcatgggtctttccaggcttctgtctatagaggactgatacaaggaggcctgttaagataggataatagtaccatgaaaaattttaccgtggcaaaattttgttcacttgtcaacattaaattaggtatcctaaaaagaatattataaaaattgaggttgaaagtaccattcattatgactataaaaatgtcttcccaaagagagatcatgcgacctgatttctacttgggacctatctgctttcccttctgatataatgcattgcagttctctgtgtagctcaaattatccacaacccaagcattgcatggggggaaattaataatattttctcagggacactgaaataagagctaaagttatcctacagcctgaactgcagaatcttacctgttgactgtaaatagaaatttcctacagaaaggaatggtttgatgttttaaaaaatttgtagtcatcattcaatccttataaaacatcacattttaaagtttttgttattgttgttaccaagtattgtcttcagaatgtaacacataagcagaacttaagacaccattcatctgtcaacatagacatgacgtttaaataaaacccacagagtttgacttgaagaaactaaataaagtacctggtacttcaatcaggtaaatagttatacttttacaattaggtgagttcagggctagtttaaaataaatgagctaatgaagcaaaatataacttttttaaagtgcgcttttaaatttttccttcattctgaataatacactgaaatagatagtaagcaaaaatgataatatgaattttttattttccatggcatctgctgggataattgctaaaatatctaaaaggcaagagaggacactgagctatcaagtgtttgaggtgacactgtggtatgatgtccagaaagcacagggagatggctgggtgcagtggctcatgcctgtaatcccagcactttgggaggccaacgcgggtggatcacctgtggtcaggagttcaagatcagcctgaccaacgtggtgaaaccctgtctctactaaatatgaaaaacgagccaggcatggtgacacattcctgttatcccagccacgcaggaggctgaggcaggagaattgcttgaatctgggaggcagaggttgcagcgagtcgagatggcgccactgcactccagcctgggccatgagagtgaaaccccatctcaaaaaaacaaaaacaaaaaacaacaaaaaaacaaaacaaaacaaaacaaaacaaaagtataaagaaagtatagggagatgtataccaagtatagatagttttgcctttggtcatatttgatgatcaattcatcacagataaaatttggtttgatgaagaactggaattctagtttaaaaacatttgtctgtatgaaagcttaaaaatgtcagccagaaaggcaaggtttgacaaatgttgtcttaagttgccatcatctagaaacattttatcagagtattaaacatctacttagtggaaatcaaatctcactttacaaactatttctataactcagttttctattaattggtaaattagcaccaattaatcaattaaaacaatacaattttgcaattctgtatgtatatcagtcttacaaggtcccttttgcataacttacgcttctattaactaatattttaatttaattctatcttactaaatgaaaatggaatcttgtctagaaacaaaagcatctctgcatgagaatattcccatcctccttttagacagaaaaagtggattgtaatatttttagttcctagaaaatatttagatttctaggttctcaacaaatataaaatcaggagaaaagtttggtttgctagtctgatatgtgtacatggttattttaatttgctgagctctgaatcagacactgggaaggtagaaaaatagatactaaatatgaaagaaagcaaacaagtaaaataaaatcagatcgttatattacaattaagaaatattaattctactcgtttgcagaagagcgacactgaagagcctgagagcatcggcgtctgtgcagatcacggctttcgtgggacaccctcacacacagctgatcaccaaaaagtgtgaagttcacaacactcttagaacaaccctacagtgatcagaaaatttgaattgtcaacttataatgagcctaaacaatattgtaatgtgaaataaaacatagtgtaagaactgattgtgttttagggttaggctaagaaactactatttctccttgtactggtttctacattcaaaataaatgaaaaccagttttgcggtttcatgtacactcagagaaagttcagtattaaattgtaagataagagtaaaaaatctagattgatgactgagagaaaaacttgtacaataattgtaagaagtgtactcatcccaaaatgaaaattatctccagaaaagaggttacaaattttaccagttatgatctactatttacatattaccattattttaacacacttagaaggtcaatttagtgaagtacagatactgaatcactctttctgttaagtagctatgagattaaattttgcttaaatatccgtaactgttcttcattaatgccagttttccagttatggattaaaatctatgttattcatggtatataccaggcagttgataaacggtagctaaggtaatgtctaatcaattacatttgtttttaccagaaatgtttaataacaaaaggttattaaagacaaaatccagaaccttaagagaatatattttcttacattctgaaaaactataatgtgaaattaataacatagttaacatatgctattagaatcatacagcaccccctctcaatcccagagataactggcaaatagatcaactactggcaaagtgctttttatgtgttgtttttttttttttgccactaccatcacataatagaatgcatagagttaagtttctactatttttatgcccaagaattattgtgtaatattaattaacagaactcttttcacaggaattcaatagttaacaagaaataatattaagtaagtaatttgtttttaaaagatttatcctctaaatatatatcttggaagtgctgaaaagtgtgatataaaggaaatagcacagaaatgaaggttaagagagatatatttttttttctgccactatcttaccatgtgattttggacttatttcttaaaattattgcactctacttttttttttaactgaaaaatgagtgaattggacatgatgcactctaaattccatttcagttatctatgaaccaactaccttaaaaacaccctagaaatatctgagaaaaatatctgaccacattgaatttcaaaataaattcttgggttgttcatatgttgaaataagactctttctgcagatattaaggtaacataacatacagaatataaccccttgttttatttgattttcttcagattacatgcctgcctgcctggctataaaatgtaagcctttagaaataactgaattcaataacccagaatgttcctgattactctattttaccttttatttaatatataaatattttgatcacttctcagttttaacacacactctgatgtttaccacagggtaaataatttgaaattgcaagttgagacgctagaaatttgcatattttcttgagactctatacctgcaattccagtggtcaccactatgtgtcagtagtacctcctacaacacaacggttctactggttgtgtttcccagttgcacatatttaagacttttaatgaaaataagatatttattgtgttatagtattcacttaagaccacagagcaactaatgtgcaaaaaacagtttatttacttcgttcccatgctagttgcttctaagagttccttgcaaggaggcttttatatagctgatggctagcaaaacagtgccatttctgcttgtgtcttctaatgagtcatttatccactttctaaagtaattttctgcttttctttgcagagagcaggttaacaagcttttgactctgaatcatttctgcctgtatcattctctctttcaaataaaactctgattcaaataaaaatatacattggctgccataaatttttcacctagttgattattataggctcttaagtagagattgcaaacgcatttcattttatatgccaatgataatttgttatagtggctgcctggattacagtgttgaaaaggagtagtcatgtctgtcatgggtatgaaactgggaagttgtgatacacaatttccaggtatttgccagccctattcttgactgataatacaatccgtaagttgtatttaggaaaatgaaagaacaaaaataaattttagaaatatatgggacataggcatctgattatccacactccaagcattataatagaatggttctaagaagccttcttgtagtattttactctgtctcataaaaagaggtggttaatatatgcactaagactaatacttttgatttttaattttcacgctgctgaataccagaactacatagaatagtataactagcagttgtggttggaatgattcttcacccagagtccagagatagccaacaactctggtataattaatgtccaggcaatgatactggatgcaacataatgatgcaaagatagatattttttcaaaaatagcttagacattacagagaattgtaaaacacagatgtgcagaatcacagtcacagcctctaagggagatatctgaaaaagagagaataacgtgtttttacctcattgaaaacaccagaagaatgatcttgaacatagtccagaggctttttaggaggctgggtgtagacgcaccacagaagcagaagtgtagggatggaatggaggagagtcaatggcagcaaggaatgaacatgtggaaaaggtgacaacagttagaaattgagtgttgacagcaccagctacacaaacagaatgacatgaatggagcaaaatgggggcagctgggaggaagtgtgcaacgtctgcaaatattctcaagcactgggaaaattggctagtgttcaattagtatatttataaattcattttgtcaaatttcattagcactcctagtctctggccacagaggaatgcaaggtaaattaaagaaacattaaaggagcaagtggatagcatgctggtgagtttccatgtgtgactgaaaatgattatggaaaatgctgataacttaggctcagtacagaatagtccctataagctttctttttgaattattttattttattttattttatttttttgagacagggtttcactctgtcacccaggctggagtgtagtgacaccgtctcagctcactgcaatctctgccaccagggttcaagtgattctcccacctcagccccctgagtagctgggattacaggcgtacgccaccatgcccagctaatttttgtatttttagtagagaaggggtttcaccatgttggccaggctggtctcgaacccctgacctcaagtgttccgtctgcctcagcctcccaaaatgctgggattacaggtgtgagtcaccacgcctggccgtccctataaactttctaaccaacagcaacaatacatataaaataaagctagagaatgtttttccttgaaataaaatacatttacattcacactaagatacaaatgagaaaaaatgagagaaaacattcctcctatgagataataaccctaagaaaaatcctttggtttatattcgtttacagtcacttttgattcagttcaataagctaccttgagtctaaccaagtctcctttgcagtttaatggacaaaagagactaccatcaccaatcagtaaaccatatatggtccatatgcaagtatataaatcagcatatggtatagaaatggttatatcctgatttctaaaaaaactatcagtgtaattggtaggttatttaagagtctaaaacgcataaaaacgtgtgtaactgacacacatcaaatgcactgctgttggtggatacagttcctaatcagggaagttgttaactgaacctccagttgactattttttttttttttttttgagatggagtctcactctgtcgcccaggctggagtgcagtggcgtgatcccagctcactgcaatctccgcctcccaggttcaagcgattctcctgcctcggtctcccaagtagctgggactacaggcacccgccaccatgcccaactaatgtttgtatttttagcagagacggggtttcaccatgttggccagaatggtctcaatctgttgatttcgtgatccgcctgcctcggcctcccaaagtgctgggattacaggtgtgagccaccgtgctcggcctcaagttgactctttatcccaaacaggctaagcaataaggcccaacctctgggcttcctctggcgggagtctggggattagagaagctgtgatggctttcactagcaagtctggaaattaagatccacaggacttcctgatttttttctttccttatatccctaatggtaaactaggtacagtcatgtgttgcataatgacgtttccgtcaacgatgcacctatatatgatggtggtcctatgggattataagactgtatttttaccatgccttttctatgtttagatatgtttaggtacacaaatacctaccattgcattacagttgcctacagtatggagtgcaggaacctgctgtacaggtttgtagcccaggagcaacgggccatagcacacagcctaggcgtgtagcaggctctagcatctgggtttgtgtaagtactctgcgatgtttgcacaatggcaagtccacctgatgacacatttctcagaacccgtccacatccttaagcaacacgtgactgtattttgtagtgggattactctggcagtatattatagtgagaactgcccagagattttcatttttctttaacaggctctgcgtttaacttcttactctgccatttactattttgtgcacattacttaacccctccagtccccattttcttcttcttggcgggacatcaggaggcctcgaggagataatgaagacagaagcccgcactctccaggtgcctgatgtttgctcagcaaacaggactcaatgtcaaggtgctcttctgcttgaactagaccaaatagactgtaaacaaatacaaatcttctatacagctgtaataattgtctgaatattccatcacagaaactacctcaagattttgaacttgtaatgaattagatgtaaagaaatcttaatgaatgacctacaaaccacataggaaatgtctgagcacatttgaccatttggtacagaaatgaatctggactacgctgtaccaagtgtgtgtatacattatgcattcggcctttgttctctgaatgacacccacgtctactgataattgtattttagaaatcaaacagtatactcctagttttcttatattaatagtctagcctcacttaccgggcgtccaaactccagttctgaaaagaatttataccagggctcattttctaaatctatgtcatctggatttatgcgatcagtctagagcagatgtgaaggaaaagggaaggaaaaggcacactgagcaaagtgagggaaacgctgtgtggcatgaaaaactcacgcgcgcattgacacgcaaacatgcatcaactctcaccccacgaacctcagcaggagagaacggaggaagtaaagtaaaacgagtagcatgaggatgtgaaggcgagctccatggcagggggtccctagctgtttcctgcgtccatcgtttctgattggcataagttgtgggcaactcttgcttgagttgatccacttacgcttgaggcatgaactatggaccactctctgcggcagcgagactgggtctggctggcacgcctgatgtttggaataggctcaacccagtcaccaaatagctcttttgggcgagtcacttcatcgtccctgccctcattggtggctagcagtcccagcatgggagcccgcagtctgcagacaattcactcgggtgcaggcaggtggtaagcctgggatggggaagggtgcgggaggggtgggaagacaggcgagctggggggagggggacagggcattggggggctctcaggggcctgtggatgagaagattctggggcctggatgggtgcgagcgggacccgggggagtgggagtcgccaggctctgagcaagcaagggctgcacctgcacctctgccgggcatgaagaaaggtaaggaaggaaggagctcacccgggtgggagacagagccggggcgcgcgagcttggtgtgggggcgccactccggggcggaggggaggggctaccagtgacttctccgagtcgggagctagaaagaggcttccggccaggttcccttggaacaggtgtcggagttgttgggagagggggctgcaagaaagaggggtgcagaaactggttcattagatggaggctctgggcggaaccgcgaggacaccctggcagcgcgctgtgcctgcgttaggccgggaggggagaggcctccggacggcgaagtgtccctagggacccagacgcctcgggagcgatccgggccgctgcgaagccctgcccaccaggagtggatccccaggattcacctcccggctgcctgctctgagctgagaaggggatctggttcttcacaataccgtggatggcggggaaggggagggagcctggggtaaaatcccatcttggtttcctcgatgttctaatttagagaaaaagccagttttataattgacctgcttccctgcagaggtttctgaatgttgtttttaagatgaaaaaactagcagtgttaatataaacagttggagaaaatacatacaattattctagtaatagaaaacagatgtagagtgtttaccttacccagcagtgtccttaatattttcaaataatacatggctgactagattgatttaggctgctgattttgtagtaaatctaagagcttaaagtactatatacaagttattacttctttgataattactatatgacactaattaaatgtggtacaattgaagagtacagtatcttaagtcagaaaaaaaattctaagaaaaattatatggttccctaaaagccattcactctggctaggagaggagctgtgactcccaagacatattctaggaggactattaagtgctcactgcttcagaacaattcaatatcatttgcttacaattcttaaagaaactcagggacttaaactgaatagcgacatcttggttgtgaaaaaaatgctatgtaaccttcgcagtgctgggagcttgaaatgttccatattccaacaaaagccatgattttgacattgttctactgttttattgactcgttgcatttacaagttttgctaatgatacacagtctacacttactaataaattatactcacagtgtttttagtgatgtgactttgtttcaatattttataataaaagattataggagtaattacagacaatgatagaaaagtttgaggcatcgtgacaaaatagtgcaaaagcctaagttatccaaaagatgtagtgatcataattataaagactgtgtagtgtccctgggaaatgcttacaatgagataccaagcagtcaaaacggaatctaaccacgcacctgtacagtagttacaaaggtattacaaagcttgtctctgcatgaacacagtaaagaagtcacacatacacaaacgactacaatggtgttctggtattgcgactgtttgttttttctttcttttaaatattattttgctttattgttgtaatgttatttttgtaataaataaattcagagagaacatcctactattagacataggaaaatgcctagaaatcttgagatatttttccttctttatgccagtattatatttggtttacacctcagaagtaatagtgaaattggtagagacaaaatattctagtaaccaatttgctattttctgttgaatttaaaaatttaattcaatttatatttgattcaatagttgcaatagtattaattgagattttaatgtccataaaatactatttttctccaattattatttagatcattatagatgcataattgttcgtgaaatggctttgctggagctggtttttagggtaactgacaggagagagaatttccagtaatttctcttctgtttagagagacatactatttcttctacaggaaaactaacctctgactcttttaaacttcatagtttctaatgttacacactgaatgatatcattaattattataacttctgttttcaagaatagtattttgttttgccaaggggagatagaaacttctcttagaggaaacgaatctgtttaagaaacattatgaacagcagagggcagccaacttactaaatgaataagacttgttagctatgtagcttcactttgactcccacattaagaaaatatgtaacaaatggatataccaagtcctgatttatagtaatgcatctctatgatagaatatggaaaaggaagcagaatatctaccatcttgcatcataccttagaatggcagttttccatgaattatgcttttgtttatttaaatagtcaatttatagttacaatgggcaactatctagaatgcatgccaatagaaattagcagagaaaacacccaaaacaatgatagctggtaattatcgataactttggaatgcaatgaaaggcacatgtttgagcagagttgtgttaaaggaagtgttagtggcagaactagaattttctctttgctgtggttgccgtattgaatcttttaagtcatgcaataattaaatgtcctatggtgacctggaggcactgctaaggaacacagaagcctcgcaacagtcagtgacacacatacagatggtcagtcaacagatggatatacacacaaatcactaatctcagtaatttaacactttccatgtggaacatggacattcctttgagtacagcactaatattaacactcagaaactcatttaggaggtatgattatggtttactctaattgctcataaaaggcaaaagagcaaagatactgatatgcatctttctagccttggtgtgatttttttgttgttgtttcttttcattaaaaaaaaaaaaaaacccaccagcaaacctccgtttaaaactaactttgttagtcatcagtgcaagaggacgtgttcaagaaaagctacaactataaatcacaagtgatccttacttaaaagctaccaagggtgaacaactttaaaaattttagtgttttctataatttaaaagcatttaattgcttttgtggttatcgagattccactaagtattctcagtgaggcatgtgctttctatacgttgttctaaacaaaaagaagtgccagggctattttgtttttcaaattacgctcattccattttaagttttaatgacattgactaccgtgttttatatttattgtggtttcacaataaatgctatatacattattagttgggataattcttaatggtcatcagatgaaactccttaaatttttatagttaagtattgactgacaatctttattgataaagaagcttaagttcattaagggtttaagttgcatttcaactctgctacagtgttttcaatgactattttcttctgcttttatcattatgttcaagtttagttattgtaggttagggtaacattttcatatattttttttttactttatcaagcatacagaggtcctaaacaaatgctttattaatttttttttttaaatttaacattactcacctacaaacatatccaatgcaatgggatataaaggttttagtaatataatcccagcagagtttttatgattgtctcatggaaaaattaaattgtggaaatacggttctgatttgtggttcgagtcagttcaaggcaaattcctggtgactgctaagtacttttccagatcaaacattaggcccaattaattaacatttctaaatttacagtcacatgagtatttatgagcttcaaaaaagtgcgctcacttttactttccctgttaaagaacataaacgcatatgccactgattcctaaggaagatctctttgccagggtcttgggaagatttttgttcaaacagtactacccccctgccttctctgtatcccagggaatcgtggaattatgagtcactactaatagcagtgtgtcaaacccctccaagaatgttttgagacccactgggccttttgcactagaaatatataggcttcatggataaacaacagaacaaggattcagtccctcaccaactttttccactgactgcaagggtgaaacctgtgttccttcattcacttagaaattccacgaatgcatattcactgaacacctgctacaggccaggcatcgtcccaggtgttgggatacaactggtggaccagtcacagccctcgccttcaagaagctcaagatctcatgaggaacacagtgtgccatgggcacacagcagggagagcctccaacctaatgcagaggagtcaggcacattccctgggggaggtgggactgtgctgggacctggaggatgggatagaattctccatgtgaaggaagaggtggtggggagagcttttcctggtggggaggtgcagcctttacagaggcccagcaatgcgggaattgaaagttctctgtgcagctggaacctagcgaggcagggagggtgggaggagagatgaggctggagaggtcagctggagcccagtcacaggtcttctataaattatgctcagggtttcagattttgctcgaaggacagtgaagagccagagaaaattttgagctggaggttttataaagattttctaaagattgccttcgctgtggtgtggagactagactggagaggtagggaaatgaatcaggtggctgtcactgtagcccaggcacggacaattgtgggccagaagagaggagcagcagtggcacttctcctggcaggcgacactgagtccactgcaggagaggggaaaacccaagatgaccctttggaaaagtgggcagatggagaggccatgtagagattcaaaagagcaacacagaattgcccaggtgttgtgtatatttttcaaaaattgaaaatgaaaagagcaaaggaatgcttccaaggcatcttggagtcaaaagacatgagaatgcatgaataagaccttgatacccctcagcgctggccatcgctgcgacgccactctcattcagcacgcctgctcttcaacctctagcctgtattttcaacacttcagaatcttatgtaaactatatcagtacgcggccagtctctacatcaccacggcccacttggctctttttgttttctaatttatagaggcaattgaaacgaagtcaggactaatttttttaaaaagatgatgagctggtcctacactggaaaggctggccaacatgtcccatatggccagctcaaaccattctgcttaaggctggtcctctccaaaattgtttaggagggttaacatttttggttctttctatttctccataagatagccattctcacttccttccaagtttctaagttccttctacttatcttctcctgtggctgcagagacctatccacactcgaatctctgtcacactcatggctccagagtttcctgtcttacaaccagtcacatctactggtcctgtgtggtaactacttagggcctaagtttctgataaagtaaatcaagtatactttattgtaaattagccaataaataaattaatttatactgcaaaatcatcaaataagggaatcaaataactgctacttcaatgtgtttcctgctcagccacacctggagtggctgtacagcagcgaccaagtgcaccaggcatcagtatgcctgggctcaactcctagttctggctcccaccatgtgtccctggggcaaggcgagctaatgtgtgtttcagtctcttcatctgtaacatggaaatgccatgtgtctgcttaatagggctgctggaaactttacatgagataaggcataaattactaattacagcgcctggcatatagtgagtgctcaataaagatttacaatgattgctattgctattattattgctattgtaaaacgaggagtctttaaagtcttttttaacccaaagacaagagtaatgtgacaatttcaataacaatgatagggtcaatgtataaaccctaaagggagcaaagggagggttttttaggtgtgcgtctgttttaaccatataagaggctgtttactttgcacaaactcagatctagtcttgcatagatattaaatgatagacttgaagttcctcaaggtagagagtgtgtcctgttccccgctgtgcacctcacataaagcctggcatgtagctggtgctcagtcagttttactgaatgactaaataatagaaacatcgtggtgggagagcgtctaaaaccaatcctgtttcctgacaccacggctaccaaagcattccaataccattaccatgttcgttatcctaagagtctcataaattactagaaagatcattaaaattttgttatttaatttaaatctgagatatattatttcactgttttcaattttctgcaatgatgacattgtgtttcactcaattctcattctggaaatttcagagtagcatgatactcaatcacagaaactagtaaatgggttacaagtttgcaatggtgcctgcaaatcagtgattttttttttctttcagtttttcttttgtagtcctgttactctaaaagatatgagttatttaaagaaagggtaagaaggcttagacaaatatcatgtatgaattatctgatgataaggttttgaacatgcttctccagaacacaaccgcaaacacagggtttcaaagactcaatcaaggacactcatgttgggtgtggcaaggctagagtttccaattaaaccacagggctggccttggattatatatgagtgtgatttcttggagactcttgaaggagctccacaaagaaaactctctttttcctgttcactgacacctaaaattcttttaaagcaaaaatgagagtaaattgcaattgattgcaaatgttttcctagaagtaggcttggaaggagatgcagaggaactgtggagtttcaaagaaaatcctgaggacactgatttctgaggggaagcaaaggacatgcaagggagtattggggaatcaaaaccaaagaaggccaagggaagacctatgtgtgaacctgcgcttcgaggaggcaagtggttcttcttaagtgtatagatatttttgtttgcatataattaaataattggaaaaaatcctgcaaagtgaaatataatcttgatccattagaatgacaatcaatcaggaagcttgaggcttggtaacctgaggagggatttaataagaagcaattaaaacaacttgttatgaaaagggcatttggaaaattctcccttcatccaaagaaatattaaaaagccaatatggaaaacaagggatggaactgcctgggtccatgtatattggggagattaattaatgatttttctcattagcaagctatgatagcaattaagtattgcacttatgaacttttttaaaagttaaactctgattaatgattaggcacagttagagttacatgcaaatgaatcttgcatataaatatatatatgtgtgtgcatacacatgtgtatatatgtgtatgtatatacacctgcatgtgtgtgtgtatatatatatatataaatacacacacatacacacacacatacacttgtatttggtcagtaaagacaatatattagaacatgtatctttcaattctgagatgagatgtacaaatcattatacaaaataaacatgatttctaagtgattacctttgtgacaaaaattgctaatgggtctgaaattcaggtttattggggagccctgggagcccagcgagctggcatattctgtttaatgacaagtgcttactggtctttcatgctgaagaattgatgacttgccaggttcatattcaaaaatactccttggctcagaccgaaattttcttgtgtccacttttctgtctggaggatcccagtcatgcctagaaataaacaataaatcacacattaaaataatcctttttgcttaaagcaattgtgtaaaaccagttatctgttttcaacattacttttagcatagttttaaaaaaaatctctcaggataaaaagttaacctgtgaaaaataccacattcccccgccactggctccaaaagtcacatgaggggtttgtagacgcgcagagagtgagtccctgggttcctaatggcagctgtgtatatttgtgcttaaaataggtggcagtatgctctgctgaactatgagcatttaacccaccactttgtgacctttgggatccttgatccaaagtgacaaggagtaatgcacacaccatgtttgatcttatttcttgaagtgggatcatcgcttgggaagagcacagaagtgtcatgtgggttggcgtgcaccagagcaggcagtgtggaacaggaggtcgtcttttggtgtgagccttgaaaaaccagagtcaaacatctcattcatgggaaccagcacttttcccccaaggaatatcttccaagaggctgtcagaagacttacgaaggaaagcttcaaaaaagggtttcacaaaattaagcttttctaggctactgagctaaagaagaaggcttctttttttttttttttttcgagacagagtcttcctctgttgcccaggctggagtgcagtggtgtgatcacagctcgctgccatctcactcaaactcctgggctcaagccatcctctctcctcagcctcccaggggccatgatttttaggaggaaggattttctgactgtagataggggtaattctgcttccatggaatggaatgaaattcttgctccatggcccgttggaaatagaaatactctaagagacagaattagggacaagccctagctttctactaaattcatgactgatatggagcaagaccccttaaactttctcagtcttcatttttttccatttgtgtaaaacacagacagcaataatgtgttgttcttccttgcagaggagttttgagcattacatgagataatacatatgaaagccatatggaattttttaggaggttatcatatgttttaatgagatatttaattttaacaaaacatatcagatgggtaatacctttaaatcaaaacgttaattttggttattttttgatgacaaagataacaatttgtgtctagaaaactgtttctcaattttaaggcctcacataattcatcctgaggagattggtattaaaatgagacccctttcacacacgatgtgtgtgttttggtgggatgctgtgccctatatgatcatcaattactctattataaaatttttatttgttttttttttttagtgaagatgggatttcgccatgttggccaggccagtcttgaacctctggcctcaggcaatccacacaccatggcttcccaaaatgctgggactggctgggtgcagtgactcacgcctgtaatcctagcactttgggaagccaaggtgggtggatcacgaggtcaggagttaagaccatcctggccaaggtggtgaaacaccatacaaaaattagccgggcgtggtggctggtgcctgtaatcccagctacttggtaattgcttgaacccgggagtcggaggttgcagtgagacaagatcacaccattgcactccagcctgggtaacagagtgagactccatttaaaaaaaaaaaaagtgctgggactacaggcatgagccaccacgcctggcctgatcatcaattactcttaatggtacaatagggtgttgaatacaatttttctggaatgggtatgataacacttaataaccagtattaataagaaataatttttatattcttatttattaattgctaggatagcataggccttgggtttaatcagagctgagcttggaccctggcttggacataacgagctgcatgagctgagtaagttcctaccattttctaaactgcagtttcttcctctttaaaatagaaagtatctcactgggttgttctcggaatcaaatgatatgacacagaaaaagcacttagcctagtgcttggcttgtaatgagcgctcaatgaaggttacctataagtagaagtattagtcataatcccagtaaaaataacacaataaaaaagtgtttataaatttttattttcatgtagatagtttgtataaaaatatttcagtggagaaaggaaaactcgtattagcttgaaaaactggtagaaacaagtcacagacacttattaactaatgcctcattatgatttttgaataactttccctgctttcaaaaatgtctcttattaatagacctggggaaacagaaaatgaactgcatagcctgtaacctggtatgccaaaggaagtacatgtccattatttctatttacttgtctcttatatgtatgtattgatcaaaaagcagaaaatgtgtccatattacttcaagtctaatttagggcactccagtatcatgaaagaagacagggaaaacatttgctacaatcccagcagaggaggtcaatatggtatatgtatagactagcaagattacacatccgctctctctgtggcaggtgcactgattcttctactgaatgccatgtagacttatttttatcctaagcgaaacataggccaccctggggggaaatgccttacttttctgttgaagaccgatctcttggtcgaagcggcgggactggaggtggaacatgtgggggaggcactggggaggacgcatccttaaaggcattggggctgttgtcggagtggcttttggaaagaggtctgtaggtttgggtctttgcagcagggtgtgactgagcactgtagggtgggttgtacagacctatcatgacaaaaaacaaaagcagacaaaaaacagaagcaaatcacctcttaaaaatgaattaaattatttgtccccctcaaaatagccaatgattgcatagaaattattatcaataagcatattcataatgcatacattagaaggtagtttcttaatttattaatattaatgtactaatttccattaatttattaattacaaatttattctgtacctaagccctgattacagtaaatctttgtcaattatttcagaactagtaataattcagactggtactaggaatagacttataagcactcagcaaattttctcttcaattgtatacactaagaaaatagttcagttttcagagcaagattaaaaacggaactgtttccaaatatcttctaatactttaaaaaccctgatttacatatgaaaattgacatgctaattgtagtcaaacaaaatattgcacacagttgtgtttataaagtgctgtgcaaggtacaaggaaacatgagtcctcaatatgcttagagtgcacctgggaaaatcagacacaaatagaattatgatggaaaataattggtaaaagataataaagaccaaatgaagaaaacacatagtaagaattaaaggatgctagtaggtggtagattgctcagagaaggtattatggaacccacgagtccagagtcagccctgaatgagtttcggtgagcagggcaagaggggagcagggatggtatagaaaaaaaggcagaaaagtgcaaggtgtgaagccatggcttgcacggttagtagagagcaaagagactagctgcagttgactcgtccactgatcaaatgatcagcttgtagggctgtacaaagtaatatatcactgctgttccattcactaatcactaatgtgacacaaacctcaatattaaaacagttataaaaattctaaattttcctgcacccaatcattggagctaattctatttgtacccgttcgcttctcctgaaagtccatgcacatttccacagcaaatgaaaagagacaacatctacacttacagttttgcttggattcaacagtcggacttcaacttttgagctaaataaaggaggtgagtttggtgggcgtgggagcagggatgaaattaagggaaacatctttgtgggcctgaagctatcagtggggcgagccaagacttaaacccagagggcttgctgagtttgttctactgattttccctctatcaatttgtctttggagataggagcacaatcccaaatagttaaagggcctgaatgtggtctccaggggtgcagaacaggaggatcatgcgaccccaggctgcccagaggaccccaagtgaggttgcagctgctgaaggggaggggagcagtgccagcctccgagcctggtctaaagaaagaagaaaaaaaatagttgtgcacctgtcctgagcctgtgactgggcagggagaggagccctgggcagaatcccgaggcaacactcaggagaaagtgatgaagggaaaaacatttgtcaggggtccctccttccagcctgcagacccctgcacgagataccaaggctcgccaatccaagtggcagtgcctggaactgaagccattctattgtgaccactggcaattctgagtcagaaaagtggccccgccaagggggatttttaaactctttcaatgaatggttgcattttggagcaaaaggcagggacaaggtcacagaatactttgtttgacttgtttttggtgaagtgtatctgaaagatcttacacaattgtaatcattctctctgctgataaaagatctttatcttattttgtaccctgggttacagtgtgtcctttcagcctatccttcacactttggttaaacattcctgaagctgagaataaaccaacagtgggaatgaatgagataaaccagtattagttctcatttccatgagaaaagtcaatccttttgttatgcacgctctgagaaaagaaaagaaatcctcctcctaatatatgaactgaaaacatgtgctcaaacagaaggggaaaaaaggtgaccgtgtcgttcttccaaacattgctgagcataaaatagtcattgcgagcaaggaaacccatcctacctgcattgtatgtataaggagtattatacatgtctgtgtcatcatctagaaaatgaaacataaatattatggtaatatagattgtcaccaaaggacaacgagacagcagaacttcagacaaacaacagaaatttgttagaaaagcaacgtatttttcctagttcataatgccattttctttctttttttctttttttttaagagacagggttttaccctgtcgtccagtctggagtgcagtggtgatcattgcttactgcagcctccaaacctccaacccctgggctcaaatcattctcccacattagccttctgagtagctgggattacaggtgtgtgccaccacaggcctctgcaaactgcccttttttatctgtaacatattcgtcttgctgccctcttcgtagcatgcaaagtcaggcccttgtcctcgcttccccagaaacctctctgctctggatcgcaaatttcctttactaagtgctttagtggtctcctgtctacagagcaggctcaggcagacccgcgcaggctcactctcctgatgagagcagacaggggtggacagaggaacaatgtgtttttcacccaggcaacacaccaatttagactgtggacaggggaggatggagggctgaggccagagtgcctggttgtcctccatggggaggcttcttggcagctcaggtgggaggcagaggcacagggatctgtcaccggaggggtgacagaaggagaacaggaggcatgctgaaaagaaaggggacacggagtttgctggggtcttgacattgtgtgtgaatcaaaccgatgcaaaagacgaatgtagtcccttcaacccacaaggacctcatcagaaagcagagcagcagacatacccggcttgtgcaccatgtgaatttgcttaaacatcgtcttgtaccagtccttgggccggtcgactgtctgtaatgaagagagcgtccaatggttacaaactggcttccaatcaacatcgcttctcagtgttttcatttctctattttatgttcttaataacagagtcccattctgtgataaaatgttctgactctttgctatggcttcatgacagtttcagcaatttacttagttatgtgtgcagtttgtaaacatatggccttgtgtttgaatttaggctgagttggaacattagatgctatggttttattttttcaagttatagctgtaccctgcactagagagttgatatttgcacaaatatataaagttcacttaatgtaagttattgttgtactaatttgtttaactccttttggtagataatgatcattatccttagatgctttttattgaatgttctgtaagacagtgttttcagaattaactggggaatatttttgactcaaattgtattctgatcagtgtggctctagagaaataaatttgctatttactagtctaagctactaaaatactgaatgtagtaggcatcccagagtcctacggaaaatttaagaatgtagatattgcttcaaaaatgctaatatgataacagagtgtatacaacatttgctcggctaaaattgtaggttccttgagagtagaagtccttacggatccaggcgtcggacatgaggggagcagtaggctgtagtggaaagatgaaattaatgtagagtcttgaactaagattcaaatcttggttccttaaattgctgcttaatacaccctagcaatacgaatctgggcaagtcatgtcaccttcttgagcctcagttttctcctctctaaagtgacataattatatctaaatcataggattgttatggaaatcgaatgagacaatgtatacacaagacctagaacaatgcctagaatataacaactactcaataaataataacactagggaactgcaaatatttgtagaatgaaataatgaatgaacgtagcctattggatagagctctgcctttctggatacctgtaaaagtagacacatgcttttataatcgtactcacagattttgcttggcaagatcttaccccaactctctgagagctacctgggcaacaggcttgatgattctgcttatagtaactaaacacaccagacgttccaagacagatctcgatttaaaaacttctgttaggactgatacgaaagcattcttatacttactagactgagctttgggttagattttattgcctgatctttttttccccagaaatgtggtcactgcatttttcctctggacattaagggttttgtgctatatctaaatttattttgacctctgagaatatattattctgaaaaatcaccccaaatacaggttaacatgaagggccacttgacttcgttatgagtcagctcttcattctcggctctttctccatggaagagttgaggttattgattgactattcagtcaaaggacgggacatggtggaagggattgcagtggtgaagcaaaggtctattatttgctggttcaaagttgctaaacatgtatctttcaagaaagtttatttttataaaggactgatttctctttcattaaacctcatttcttttactgtaccaaagcaacagaaaatacaacatagtgttgtgcaaaaatgttttcctggacgtgctgatggcaacaaggaagcctactaagtaagtcctatcactgtatatggcaatacatgttgacagacaggtttttttttcttcacttgctggagggcctatatcaggtaggatctcacagtgatgccatctgctagctttatatggtgagcacaaagatgccagaaaatgccctgctggcaaagggaaatatgaagctggaaaaataaaatacgaaaactctatgtccctttctaaaagaagtactctaagcatttaaagttccttttgtaaatgccatcatggagatcgctatgcctaaggctgagaataagaaaatagtctactcaaatttcaggaagtttacttttgtacgtaaaatcattttgcatgaaaaatagctactagcaattcactatgccgttttttctacaaccttgactaaatagacctgaatttttacattcctacagttttcaaaacatcagaactctacactgatttaacacgcagagatttcaaaaaagataaaaaaggacatattttctacatagcagtatacagtgactctgttctatttttttctccttttcagttttgaaaatactcaaacaagtgttatattggaagtagaagaaaagaatcttgtatttcacttaactagctggccttaatgacacaatctcatgggagctgagccctggcgatttttgttgttttgaagaacagcactgaaaggttcacatagatgtcccaggtcacatgagagagggcaatctggagagctgattccctgcattaaaatagctcaaaagtactgtttgttgactcttggctttctagagtttctggatgactttacaaaattctgtttcctcggcataggctggctgtctaaaacgatactgcagcatggtacattgtgacagtaccgcctttggcaaatacactgaatctgatcatcattactttctacacatgagaaagaaaaacaaccttggagagtcttggcctgctgtggctcagagacagcctgacttgacatttataaccacagctatacatggggatgtactctggagggctgtatagtcagtgtaagaggagagtcctcatagacctggaccttctttgtcaagttttaaaggtccaagtaagacaacaattgtgcataaaaattacagttccttataaggaacttctgcattggttatattgtgttttctattttatagaagggaaactggcattaaatgtttagtgtgtttgcttatgcatacccaaacgtgcttttgatttggcagttgataaacattttaaaaattttaagatgatttaattttcatcaaccatctctagcatctcagtttttccttttgaaactaaccaggcaaagtctggttagttaaggaaattatgtcttataaaggaagaaaacatggaccaggcttgcatgtccattatatatcatttattgacctaaaaacatacccagatatctttgataaaatcctctcagacagaatctataactacatagaatcagggctttcttaattttgtctatactatgcctcaagtgccagttacacaaaaccaatgacaccatttctgtctgactgtctatccctatataattagaagaaagtttcaaatttaaccattttgagtcagaaatcttagaagggaaatgaacaagaaaacatcatcaccagaaacatgtaatcatcataaaatgaagaatattggtcataatccctgaacttttctttggcacataaatatggcaatcgtcagtttcaagacagattgttagaatgtcatatcacattcaacgtttcctcaatctaaagagtctaaaaccccagtaactgctgtacagatttactttttggctttcaattgtaatatagatgctgagaataatccattttaaactcttctgtctgtatataaaacacataatccccatataagaatgtaaagtcaaggagagaagaaaatccccacactttatcgttagttctttttgactgtttccaatcttaccacggctttttttttttttttcctgctctctttcccattctttgcctctatcccttattgtcttggctgcccaggtctgcattccaggggagcagctcttggccacaccccagctttacatgggtcttgctgcaaagtatatgcagctgcagtccctccccgcatggcccccaacttcacctgcaaaggtgttgttgctttcatcctgtccccggcttccttctcccggctggcacaagccttctcttccagtggacttggtcagccagctgctgcctgcccaggctctcagaagctgcctctgctactgctgcgttttgccggaaggggctgcccagatacactgagcaatgctttggcagagttttaaaacttaaaaaaaaatccaaacactttcacttatcatcccaggagagctctcagcaggcacggctgaagagggacattaaaatgtgtatttttcttcagacagcttttcctttccatgacattaactctcttcactccaatcatctcacctcccaactcccaaatcacagcttccaatctcccggtgttaacacacatctatttcaaaaaacgaacacatcactgctttattcgcaatgcatgtgggaattcaatgcagccaaagaatttccattgtcttgttccttctcttttctctctattgccctaagcctccttggtaaaaggtaaaagaaaaacaaacaaacaaacaaactaaaccacacaacacagttttaccatttaacaaaatcgcaatgttcatgatgtttcattcaaatggaaaaacagattgtgtaattctctcccatcaacagctttctttctctgccacacacagcataacattcatgagaagtcggatggcacggagggcaatcctccttatataagaccctaggaatgcacaaagccgtggacaatccgtcctttgtggagtctgtgcacagccccagacagacgcacacgctggcatttcctaccgttctaattgctgtggggattccggattcatccacgggcccgatccctgggtaatgcggggctttgatgactgtcactctcttctcttcctctgaggatcggtacagggggatagagctgctggtggtgccatccagagactgcgcatgctggggatatgtgtctgtggaatctgcacagaaaatttggtaacatggaacgtattcgttgcacagggaatcataaattcatgtgtcttgttgtatatttatgccaactgtaacacagagaccatattgccatcactgtcccttttaactcatttactttccatctgagctggtggaaactgtgtaggtgtgcggggaacagacctataccaacaagggcctcaccattttatgaagaaggctgagggaagaatggcatttgttaaatgactgtgtggaggcctctgagttaggaagtgctctaaatgcattatctcttcttatccttccagtaatctttgagggagggcaggatagggggagcaagaaccagtgttatagataaggggcaggagctgagacaagttcagtaatttccctcaggtcatcatttacatcaatattattcttgtgatactgctactactattatttataggttttgaaatgtatttccagacaaagacatgactgttgagtcagtaacagtgatttcataaaaatgaagcaaaaccaaaaatcacttaaaaaaatcttcacatccaagcctttggacatgaaagcttctgaataaataaatgctgtaaaattattagtacgatttcctatgtgcatttttaccttaaaatatcaaaaactatgactttttactctttgatgacaaaaactgccctaaggatataatttagatgaggcttatcgagttcttcatgttttttagtaacttctagaatactttcagaagcaacagagtacagacatgcagtatatagtccatttacttctaatacacaggaattttaaaaaaatcatcattattaccgttcctctggtatgattaataatatgcctttatatttttctgcaattaatttgaaaatgttggtgacaaagaatgacactttgtatatactctttatatcatggtttgtcaggactgccactcagaaagtcctttaaggtggaaatgaaaaaaattctcatgtttcagggtgggactcattgatatcattatgtgtatatgatatatatcatgtataaatgtatttttcatgaaaaatttgtataaaataagtaagctttttttttttttttttgagatggagtctcgctctgtcacccagctggagtgcagtggtgtggtctcaacctcagcctcctgggttcaagcgattctcctgcctcagcctccagagtagctgggactacaggtgcgtgccaccatgcctgtacaaaaaatttttgtacaaaatacaaacaattttttgtatttttagtagagacggggtttcaccatgctagctaggatggtcctgatctcctgacctcatgatccgcccgcctcggcctcccaaagtgctgggattacaggcgtgagccaccgtggccggccataaggaagctttttaagaaattttaactcatcaatataagggtaattaaaattcagatctctctgaggtaaaatccattgtaacatttgtaactgctattactatgattatgactattttcaatttagtttgcatcagaaagtcatttttaatacattttttgatgaagaatggataaggctagttataaaactgctttatgtgcagtttatgtgctggatggtgacataaaatgtccctgaataaacgaacagcatcatagcctttcaacactgaatcagtgctggggaaggaggtgtgctggctgctgtcaaagaagacatggtggttgaagtcccgggttgtagtttctttccccctgctactggccccttgaatgtgaaaataacattcaagctagtccttatttttacttctttattttttttgagacggagtcttgctcagtcacccaggctggagtgcagtggcgcgatctcggctcactgcaagctccacctcctgggttcacgccgttctcctgcctcagcctcccgagtagctgggactacaggtgcccgccatcacgcccagctaatttttttttttgtatttttagtagagacggggtttcaccatgttggccagactggcctcgatctcctgacctcgtgatccacccgcctcggccttccaaagtgctgggattacaggcgtgagccaccgcgcccggctaagctagtccttattaagacacggtgagatatttgacactaattgactttctatttaattccaaaaaggacttgagtgggcctccatgatactagtatttttattagcgacgaatgttttttgaacaccagcatgtgcaaagtcctactctaagcaaggagaatcaactctgccttcacatctgatccattacattctatgaacccataccttatgcaatataagttaaccctttattttattattctcatatatggtccactagctgtcatcttagcaatcttttgtcctaaactaagtgtaaaattcatctagggcaaggtagatgtacatattcctccgaaaccttatcacagcactggccagctggaatttgttcagtgtttacattgggaatttcttcccatgcagaatattttatatgtaaaatctacttatcaatatattctaaaatcaaagcctatctacattcaagtatttttgttgttgttgttgggtggggatagggacaaaactgcattcactaagacaggcaatgagacagagtcaggctttgttaataattatttgggaaaaagctgtggctagaataatttgtcgagttttactttatatgtgtgtaaatgcatagttccattttaaacaatctagatataatggacttccattataacaccacactatgggctgattgttaaagggcaaaatttcggcataaaccagttttactttcttaactctaaaaggacatcattgtaggattcacagatgatcctcaggcatagcatcagcgaaggcacagatatatttagactttaataagtcccgcggctacctttaaagttttatagttatagagctttggttgacctcagaagctgagttccaccatgcacatgctggatggtgacataaaacatccctgaataaacgaacagcatcatagcctctcaatactgaatcagtgctggggaaggaggtgcactgtctgtgtcaaagaagacatggtggttcaagtcctgggttttagtttctttccccctgttgctggcccctgtggccagaggaccaggcctctccttttctgggaggtgcaggatggtgctgctgtcctgagaattcccctctgctccctgctgtcctagaagcttcctagtgagtcgacatcatggaaacttgtacagcctgaattcctatgatagttcaatttcgtattttttttgatattttaggtttttaagttacatttttacaaactaagaaatatttatgggccgggcacggtggctcatgcctgtaatcccagcacttagggaggtcgaggcaggtggatcacctgaggtcaggagttcgagaccaacctggccaacatggtgaaaccccctgtctgtactaaaaatacaaaattagctgggtgcggtggcgggcacctgtaatcccagctactcaggaggctgaggcaggagcatcactggaacccaggaggcagaggttgcagtgagccgagatcgccccattgcactccagcctgggcgacagagtgagactccatcttgaaaaaaaaaaaaaaagtatttatcacattattttctgaactatctgaacatacttgaccatgtaagagcatttctatcactgtacagcaaagcttctttcacaggaggccacaaaaagtccatgagccccaggaaattatctgcttacaattttttatgaacgtccgtatgtccatttgttttctggaggagagctctatctttcactgaattcctagtcctcagagggttgagaacgattgctctatacaatgacagaaccttcatttaagggaacacttaagtttctcttgtgtggcttcctgctaccatatccctgactgcaggtcttccagccttggtttgaatggtggttttctccttgtgtgagccagtagatgactgcgtccctgctatgtgggacagcctgtcctcctgttacactgttttaactgtcaaacgattctcccttatatagaccccaggaaatagtccatggtggaagctcttccaagtccgaacaagctgccctagtggaaaacctgcattcatgtcctccagtggcacaaacccccttgccctaagtagccattttctttttctttctactccaccacctcagacatctaagtgcccacaccaggctcagacacaggtggagacatggtcttggaatagcatggtgcccatttcctcccatgttgggtcctctgccccagtttctccctggggatagggtcatgagtgctgagcgctcccgcctcaccttgatgccgcatatctttctcctgtggttgtacttgccgcattgaggttgccatggaaatcacggtgagtaaattacttaccgagggatgtgccgtgctgcatgacaatgctggagttgagtgaggctgggagagaatatgccgagggggaaaacggcctctgatagtaactcatgggactcacggcacctcctgagtttccattcactgttatctggctctgagaaaagcgcaaaggcatcgagttaaattagcacatagttccctgtaaacatcattccattaggtgataataaaagacttccaatcacatgagagtaatcagctgccaagctcttatttattttgaaaactgatgtcagagggcatgctacattctttgccttctctctattcccttatttctgaaaatcactctcttgtgtatctgagggtccagggagtggttaggaagaatgaaagtggctgactagtgggcatgccactctgccaacagaggtgccaaatggtatcagtaggagtcagtaccaagtaaatgtggaggacgactttgctctgacagtcgtaacatcagcaatcagaacacggtggtgctgttccgcatgcagcattgacgtggatgtcctttgacatgaggcaagggattggttctcagacttagtcagggatatcttctagtgaatgaatgtttccagagctggtgaataacataaggaacctagttgtttggatgtatatatcatgaagcaacctattctagaaggatcaaatacctggtaaaggatcagagagacatgttcaaccactggcttctccctacttcagcctcattgagcacttcatgaatctctgtttgatttcttaattattcattgtttcgattgttccgtatctgactattttatatccccaatggtatctcaagcttcttgttgaagatggtcatatatatgcttctttaatattttgtataacatgcagcctagtgctgatgacagagtagatgttcaataggtatctattctgatggaactgaatcggcttagttcacagatatcgagctcaggactattaagcatgcctgtctacccacagcacagtactgatcattacagggcgcacacaatgcatgcaaataagatcaaacattagtaagaacgtttagttaaaattatagctaaatacacacaacacacataggcacacagataaagaagcataatttgtgaaacttttctacttattttaaaacaaaacaaacttctattccacaggcttgaaacatagatatagtaactgtgtatttctatgatttcactttaaagcaaatgggttttcaaatgacctagaataagtctaatttcattactgtataaccataccacttatgtccccaaatcaataaacatttcattacaagccttgtgcttattgattaaataattctctaagctgttagaaaaattacactcatatcataaccagccacatcttgaggacctgctccctggagagagctggacgttcaaataactgtgaggcacaggcctgcccaaatcttcagagcttttatgtacctctgatggatgatttgagaacactttcacctccttgcccaagttaagtttggtggatctttgtcaatatcattgtaatactattataacatgttataattaatgttaaaagctgaagaatccttcttattaaaaaccatcaggttaactatattgctaaacctacaaacttgctctgaatcctattttgatggtttcaataatattgactaggggttaaaaaagtaaacactgagagtagatttattcttttttttttttttttttttttttgagatggagtctcgctctgtcgcccaggctggagtgcagtggcgcagtctcggctcactgcaagctccgcctcccgggttcatgtcattctcctgcctcagcctcccgagtagttgggactacaggcgcccaccaccacgcccggctaattttttgtatttttagtagagacggggtttcaccatgttagccaggatggtctcgatctcctgacctcgtgatccacccacctcggcctcccaaagtgctgggattacaggcgtgagccaccgcgcccggcctagatttattcttttattgtgttcaaccaatcaggattttatgactaaaatactatcattagcattttagaaaatactgtattgttatagtgaattcattattaggaaaaacatgtcatgaataatctatttgcaattttaaactgataattgcaattaatttcccttacaagtagctctgctcgtgcccacaagactgtatataagacagttagtctcctgtaaagtcttaaaaacagaaaattgaacaggttagttggtagattgataccctctcactgccttctttttttggttaaaggtcctggtaaagttttaaaagctaagaaccattgaagcacagtagggcatgggaggaacccacacctgctgtgctcctggtgcccgtagttgggctggtcctctgtggcagggagggactcgctatggggttaggcctggaaaatgaggctccttctgtagccagtctctgaatggagcatttgaatgcaaagtgttagacacagccattgggggaataccaaatcccattaccaaaaaaagcatcttttactttatgtaaattgtagtgtcttaaaaaacatatggcttattataacatttctctgcgcataaaatttgcagacttatcagcttgatagaacataaaacaatgtagcacaaataaaattttgtctatgacagtgcttattcggaacttcattataatatcaatttaaaaaaaaaatctgatttttttgcctgaagctatgtgtctcttaaatggaagccattacttagacattatatgcaatatagaatctgtgccataaaattttgaaacattttagccattcacagatcatttattagggattgcttatcacatagatatatttaaataatatatgtatggaaaagatgtatatattgctataaatgaaagacaaattattgataaacaaaataaaaaatgtattcataaatttctgtcctgaaatggctcaggaagaataatttttaaaaatcgtacagctaaatttctgaaaggtagataggattatcgacatcattcactcctggacaatagatgagttcaaaagttgtagctgttagagaaggaggaacaagaaaaattagcctcatgcagtcagtaatcatttatgtgagaaaaaggatatagaaaagagtcacacaggacacattaatgtgagtctgtgagaaaaactgctaacatgtattaatactgggttaaaattttttgaaaaattttagactttatgatcacaacatattgtgatgtatacttagctaataaggcaaatcactgtagaacttaccagctacagtaacacgggaaaccgtaagtaactattttagagtaactataagtaattctaaaatgaatgaagagaatgaagtgactttttcagccttaagcaagcttataggatgactaatgatttccctgacagatggcatagaattggtttgggaatcaacacctatgtaaataaaaatgtcagccgaaaaatgagatggcacaacaaatcagtcctttcaaggaaacggtggaggcaaagaaaggcagaataattacatgagtggccgcaggggtggttaaggtggtgccatctgtcacagcagacctctgaccccaggtgggggagggtgtctcagaacggccagtggtgtcagagtcaccaatctgcagctcctccagcatggctgtggaggactcactctccgagcgggaggagtgctcggccagggaggagtctgttgtcagagagcctgtgtcgtggctgtggatgaggctttctggagctgggagcaggtgtttgtataagcaatgggaaaggctctggggattatgcaggcgtgaagaccccacaccatcggggggcggaaggctgagtgatgctgagctggtgccactgcctggtgagaaagtggctcggttcaaaggtaccacggaaggagggcacggaggagaagcttctggtgtggtttgtctgtgtgtctgtgaagcatttacctccaacacactggcaggtaagttctgatttccaagctgagtatgaggaaaaaataataagagataaattatccaattaacaaaagtacctctttttgcgatgtggcagagaaggcaaagcatcggttttatttgcaagcactttaaggagttacattcagatgggttaggtgccaaccacacagtgcagaaaaagtgtgaaaacaggaagaaagtgaatccagtcggtgtgttttgaaacaaggccggttttcacacagcactgcaatgtaattctggttaggggcttgagagtgttggcataacgaaactgtttcctcaggagttttagtttttgtatttgtgacaatgataagatatcagactatcggtcagcagaattggtttgtccttcactagaaaaatctaatagcataattgcctcccccttgccaaaatgtccccaaaacataaatctgtttgtcttattttttcctggtttatgaatctaaacactgataatactaaacacaactaagcagaaaagataaatggaaaagatgttttatttcctttccactaattaaatctgttctttgatttcactacaaaatacgaaaagaattggactttaaaatatcctagcaatgcaaatagaggtaccatgtgtgaaaatgaaaaccagccactgataatagttagaatgtaccctagttagttagaactatggttggcactaaatcttaggtaaaggagaaagaaactgaaggaaaaataaaagatttaacagctccaaggctatatatagcccaagaggctaaacatagcgaagggatgctctgtaggaggaagagagaagatgaccatttgaaattttacaaccacctgtggtagcctggatgacgtttgaccacacgtgacaaataggatgataagtactcaattcaacgtaagtgaataaaactccgaagcaacttttcttacttattttttctacctttcagaacagacactttttggaggggatgtttgggagaggaaatggttttaagatagatggccagaggtattgtgagatattagtacaaagatgggaatgaatgaaggagaactgtttacacttagaaatactgcctagtaaatgtttaagttaaacaatttggtgttctttggcagccataattttcataatgactgatgtcatgcacgttgttagcataataaaaaggttgcaataatttttttctcagacttttacttgaatacttttaaaaaatccatcatataaaaaggtctctctgaatcatagatcccttagaaatctgataaatgtgactgatccttcttttggggaaatgcacaaattcatacatacagaaagttctgcataaacttcagggggacagagacactctaaagcataaccttaatctaatgggttaagaaaccccaaccttggataaaaagacagattttcttgtcctaatcttacttaatatgattttttttcttgtttaaacatagtcattttaaatgtgatatatatatatatatatacgtatatatataatatatattttactgttcatggttgtttaaatctctagaaataactgacagaaatcttagttacccagaacttaaaatgttttggtggggatgcatccttattattactgagtgtttacaataattgcaatcttattggaggtgaaactttaatattatgaaattatcataattctaacttaatgtattaaaatgttgctataagtctgaatgtaattcagtataaagcagtctttggatagcgtcaatgaaatttcccctaataattcagctttactaaggatgtttccatgtaatacgaatctctttttagttttatttatgctaaatgaaaactatgaaataatacaaatcatacaaaaggatttgagttatctgctcatgagacttttccctttcaaattaaaagaaaaaaatctaatgactttaacccccattggactgacttgtccatatcctatgacttgaaacatgtcaaaagctaaagcgtattctaaaatcaccattgtcacgggtaatatgatcattagtttgcatagcactgtgtctggggatggtccttacccattcaattgttcttccaaatagaatgtccacagaaaacaaaattattccacctttcgaatttctttcaccacctcctgacatgctcctggttttgagtcttttaatgcacgtgtgtgtatgggtgtgtatgtgcgtgtgtgtgtttgtgagtgtaaggcatgaaatgcctcgtggtgagtcacatcacacttaaatttctacagataaaactcaataattcaacagttatactggtcacccacaaaaaagctttgacaagaccccaatcttcacatgaatggaatataccctgtagacccaaggggaaagaaagaccatgttacacgtgtttctcctgaggaaaatcagaagagcagcaggaaaggtatgaaaggggaagaaggcagtattttcccaatctggactacctcaaaaatagggaaaactggctttaaacaagtgtatttttttcttacttcatgagtggcaagtagatgactgcaggtaatcatcctaattgttttaggtctccttcttttcaagaccatggaaggctaaggtgtttgaatagggatcaagggtcaccaactttttgtgagtataaattgttttttctttccccaacccttgagctagcaggaagagggtaatgagaaacaccagctagcagccaggggctgcctggtcttctgcaaaggacagggacggtgcttaaaccttaatatgcttcatataccaagagagagcacctgcttactcaaactagcactgagcttcttcgtccaaatgactccaacccagaatgctaaagagagcctgtggatgagagtgctcaccaatcaacactggagctcctgaggaatgaaggggcacagagattcaagggagggtgagcttcagcagtggaaaaagtgtattgagttggatgaaggcattgcaaactcaagtgcccatcatgggtcaggaaagtatccaggatgtgcaaatcaagcccgtgttggatgacagggaatgatgggaccgatggcagaatgcggaagtcatgttccccctcaaggcgggcgtcattgacccatatcctttgccttgaaacacgatgaaaattaaagcttactgtctctaagaccaccatagtcatgggtaatatgacctttagttcgctcataagctcagtgacaacacatctatagtcataagcccctaagctgtcacttgctgacacagcagatgtggaagctggaggtggaagagggtagctgtggagcggggatgtgaagaaggagtgcatggccaggcctcaggagaggaggggaaagtgctcgttggggtgcaaaacttaaagagtgacaaaaaactcagtaattgagataaattctgtttcaatgcaatctttgaaagaaaatcaacatcaatgcaaaaaagcaaaaataccccatactgaacaaaaatgtcgaaaatataaatgaagaccagcgcatgccaagccataggaaaagagagtctgggtctggcgtttttaatgcaagaaaactcatcaataatattttcaaaatctacatttttgcttatttcagttttagttgagagaatagacatgtttgacaatttccaattaactgatggccatcttaaataatttgtaattaatttaaggtgaagtaaacatgtaatagggcaagcgcagtggctcacacctgtaatcccagcactttgggaggctgaggcgggcagatcacctgaggtcaggagttctagaccagcctggacaacatggtgaaaccccgtctctactaaaaatacaaaaattagccaggcgtgatggcaggtgcctgtaatcccagctactctggaggctgaggcaggagaattgcttgaacctgggaggtggaggttgcagtgggccgagatcacaccactgcactccagcctgggtgacagagcaagactctgtctcaaatttaaaaaaaaaaggtttattttgctttaaataaaatatttaagcttaaaataatgtgtgagtgttaataacgtgcgtttcaacttttcaaaaaaattctaatgacttaaacattctaggaaaaagctcattcccaatatatgaaaacaggtataaggaagcacagaatttccttccacctcaggttccagttggcttgacatggccctgaggtcaaggatcctaacatctctctcttaacacctttagtcattgagcttctaggcctcatttctcaaggaacataaggaatatatattaaatgtcaagcaaagaaatctgacaggcttttgttctcttttttccaatgatagtaatttacttgaaaagaaaatatctaggaaggggtttttttttttttggagtcttgctctcgacctccaaaagtgctgggattacaggcatgagccactgtgcccggctggaaggggttttaaaaaaaccaatctttacctcccatccacacatcctttagggaaaatgtgccccctcttttcatggcctgtcctggtggtatgaggagacctgcctggcagctgtgtctgttgccggatcatcattttgctggccacagctgattaggaagggggagtaactggactatgctgggccagtggggccctgcctccctcctgggaatttgaattacgtgacactgaatgcccctcaggtagctgtcgggtacccaaatgcaaggagtcagagagtatcatggaaacccatgggcaacttgaagtaacgacagagcagaaactaagagacagacagggaactatgcagttcctacgactgagaaggatggagggtagctgcctggccattgccccgtttccctaaggcctggctgtattgcctgcattgtaatgatgtgagattgtctgacagcctcataataaaaattattttaaccatatactccccacccaagagctgggtgacaagtgatctaaaattgtcacacagattgggcacactgacagcatgtggcatctgaatcaggggagtaaatatttctactgtactctgtggtattcagatcgggaatatggttttgcatctgggaaagtgtcatattttaagaacattatcaaaatatgggatttaaaaatcagcttgtgtgagagcatagaggtagcagaggctagtggctgagctgtggatcttgagtcagacagacttgggcaacttgtttaatttccttggcctcagttccttcatgtgtaaaatataggcatggataaaacccatctcttaaagcctgtaaaaattaagtagggcaatgtaaagtgcttagcacagtgcctggtgtgctgtaatagctctcaaaaaaaggagaatcatgttttacaaaattaaaatgctgggaaggaacaggaatgctctgcacaaagccagtagcagggtagggaagagaaggatcacgtgaacactgtcagatagaggcggaagaacattctgtctcttttgctctgtggataaccatgcagaagttaaggaaggcagatcatgacgtggtattagaaattctttccaataattcgatctcagaaatggccaagcactggactgctgccttggaatgtaactgagctcttcattaagtgtattcagaaaaggctggatgcccatctattgggagatgttgaagaggacgttttatttgtaaactcatgttggactcccaagtattctctaatgttcaattatttaaatacatgcatatgcatgcgcatgcacagacatcaaatggagaaattgccaaagacctgatcaactaatagcattacgagcccacagaaaggaagccatactaatggaagacatcaatgattggggccggtcttgatagcaatgttccagaaagtgcgttctgcagttctgcacctattatcccacactgctgacatgtctgcattactctgtcctccttagtatctacatactgatcccatggagcaaaagaaatgagtttcctctcccttctacatgacagtcgggcaagttcccctgtgagtccccagcatatgtgcagtggcagctgtgaaggtgaggctttggcaaatgattgattatgttatttcataacggacaggacaagcttatcttcctgaagcaaggaacatagcacagatgccatagaaactgtttgggggtgtagctttttgctggctttccaaagtgtctggcttataccttcacttacttgacattgagaacaatgtgacatttttagcaacaggatatctgatcacacagtgccataaggataacatgcctcatttctggtctgtttgtaggaggtcaattaaagcacatgccgtttagaaaacactatgaaaaattgtcaaatatgaagagaatttctaacagtgacctgtagttttcttcttaaattaatgagcagacattaataataacaaaactatgtaaataaaacttctgaaacactgaaatgtacttttcacatcttggtgtacttttatcgcttggacctgctaattcctgggagcctaattctttataatggagcacatatttggctgactcacagggtatagcttacagtgcttggcattggctgagacttgccagaatgcggagtgcaagtgtttaaaatggaaaggtcaccattgtgaaaggtcattacatggaaaatgagacttaaaaatgaagcatatcacaatcatcaagatgtagaaacaaaccaaatgtccattgatggacaaatagataaagacaacgtggtgtatacgcatactaggatactattcagccttaaaaaagatggatgtcctgccacatgctgtaacatggagcaatctggaggaccttataccaagtgaaggcctgtctcagaaggacaaatatctgagcagagagtagactggtggttgccaggcgcttggggaagggggatatgagttgctattcggtgggcataaagttttagttatgcaagatgaataaatcctagagatctgctgcactgcatggtgcctacagttaacaatactgcattgcacacttacaaatttgttaagaaggcagatctcatgttaaatgttcttaccaaaattttaaacagagaataaaaactgcaacagcttcatgctaccttttttaaaaagccttagaaaagaggacacgctatcttggaacaaactgaaagtctgttgaaataaacttttacctaccagtaaaaaaaatgaagtattgttgaaaataatatatttctttttcccaatcagatgcataatttggaaaaatattatttaatgatgatgacagctactgtatgttgaagaattaccatgaagcaggcaccatgccaagatccttatatgccttactcaaacctcccagcagttctatgaatggttgctatcattgtccctgttttatagatgagaaaactgctgctcggggagggtgaataactagatgaatggttttatgttaataagatcttgaaacagctgactgcccaaccactttcttcccagtctctctcatacccactccaagaaagcctccttccccactatggaatcaatggtaagttttcagatttcatttcaaacctgtctcatcaacagcatttgtgcggtgaaccatccctttctttccacacattttcctcacatggcttttaggatgccacattttcccagatttcctcctcccttagaggacactgctttcagtctcctccactgcttcttcctcttaatgttgagattcactcaggctcaactcttggtcctccccttttctctgtccttcccctgctgatctcactctgtctcatggccacaaaacccatcgactagccaatggctgatacctccaaccaggacctttcccctgaagtacaggctcttacatccaaatgctcacttgaccacttaatgtgggtgtctaagaaatgcctcaaacttcctgtttcccaaatggaacctctgaagtttccaccaacctgttccacccacagctgtccagtctcagctgatggcgatgctatcttccagttggagtcaaccttgacttttctcttcctcacatcccacatgcaatctgccaggaagtcctgtttgcttgactttcaaaatacattctcacagtctgatttctcaccacctcctctgctgccccctgctttgagccccatcatttcttacctaaaggactgcagtagttacctaactggtttgcctgatctcctccttgccccactatggtacgtttttcactgagctgccagaatgattttgttaaaatataagggaaataataatggtggtagcctcaacatcctccagtgacctccatttttattgagagtaaatgtcaaaatccttgcaatggcttataaggcctcctgtcatctggtctttgttacctctgacttcacttcctatcactctcacctcacttacttcctctccctccctcaggcttccttctggtcctcccacagccccagcatgatcaacctcaaagcctttacataagacattccctctgcctagaatattcttcctccttcaaagctgttctcttttcagtgaggtctattgatattgagttaccatacttgacatgatatctggtctccacatctctactttgcatggcataactcaatttccataatcttctaatatatgtaatttactccagttcttattaatgcttgctcctcctgccacacacagacaaattttaagcaggaatggtttcaaatccaactctgttactagaacagacttgacataggttaggcacccaataaatatttcttgaataaatagcagtgacaggatctcaaatcttaacttttagatggtgccgataccctggggataatataatcaaactaaccgtctctgcgcagcctggataaaaccatgcaaaacgaaaggtatcagcttgttttcaaacatcacaaaaccattctgaagaagcaaaccaggttggatgagtccaatgactgatatgtgttcctatgacttctcctacacctgcttcctggcgtgcccatcctgggacactggcgagtctgctcactgacactggcacgggcctgtctgtacagtcacagacggattttgctccctccgaccttcctggactcctgaacccgatcaagatgcatctgcctcagctcccaccatcatggcaccgtgtctcgtcactgctgagtaacgacttcacaacgagaagtagcactctttcagagtggtggccctgcagccagcctgccagggtgtgtattctgtttctgccttttgccagctgcatgaccctgggggagcaacttacttctgtgcctcagtttccttagccataaaataaggacagtagtaatacctactccatgagattgtggcaattattaataaacataaacaagctgcaacagtgcctgcatagagtaaggccttaatatttgttagctcctattaatgttattattattattatcatctgatttcataggtgctttcagaagatattaccttaattagaagaaattgctctactgaacgaattttgcacatcttgattggctgatggagaagatattttagtagaggtatgataataccagcttgtcctttaatcatttctgtttaaggctcgtctgctttatgagtgggtggggggatcttggtgtcaattagttatcttttggagattttctgtacagtttaaaagtatatctcctcgaggatatgttttggatgatctttattaacacagatacaaaaaggagtattatacaaattatttacttaggcaccactgttttcaatattaacactagcgctgttgctgctactattatatcttttattaacagctgtcattgagtgcttgctctagcctagtctatggtaattccctagtcttaccataacctataaattaagggttaattagtattctcatttctttgttcggactcacagaaaagtttagatgaatgtctcatcacatagtaaatgatgcctggattaaaatctacagcttatccttaaagtttgtgcttttagcactacattgttctatggagaagtcaaaaagagaagcacatttctcctgttaacagactaatacatgtaaacagaaggatgctatgagagaattctacacacatggaaagttttacttcctgaaagtctggataataaaagttggctaatacactttctgaaatgataaattaagttttagtgaaaatgaatattgagttgcaaagaaatagacattgcttaaaattaagataactattccctgccaaagcaaattataattgacaattatctgaagaggttttacacatgtaaataaagtaaatctaagtgcaaaaagatctaatatgaaaaatatttctttgaaacctaaacatgctttaagtcctgaagtagtctgcaatgtcttaaatgataactgacccctcaatgatttcccataaacatctagaagaaaaaaaaaaatttagaacatgatttctggatgaaagatctgtatatgcatatttacatttaaaaatacctagacatttgctgatgaatttagtagggttttaaattggaaaatggtttctttctcctttcccttcctgcttggaaactaagaaagcattaggtcatataagaagcccaaaccaaaggagttagggtctctacgatacgcatgtattaatacgaagagactgagaagcttaaggtaccactctgcagtctgaggactgagaggccgctgcaactgcagatttttgtctctcttgctgaagaggtatctttgcagtctctggagaaagctcaggtagctgtttgtggctttcaagatcctgtcctgaaaggggagctatctgaatggaaagagatgctgtgtgtgtctcaggcactggattaggggtcagtgagcggggccttttgagaaatgacggtacttcgacagatttggagaactgtggagtactaatggggctgctacttcctagatcctggttatgggttagtttcaaggtagaaatcctccgagtttgagaatcttgcctgtagtcctcttgtagaactggggtgttgatgttagcgaatggtgcaggatccgtgctggaagctgctggtagtggattagtgattttttgtgtatatgacatggttgtgttagattcttcagaatatacaattgtctgtctcgaatcttcattggaatacatagttccctgaagaggttttttgttagcaaagtactctgtactggagggaatttgtgtgttagttactaactggtctaaaatgacaccctttgtgtgactggttatcaaagagctatgaaagctctcttttctttctggtggagggggtgcctggattgacaatgggatccagagaaagaaataaagttgaaagaaaaacagagaaagtccaagttagtcatgaaagaaaccagtgtcaaccttgcctttacagaagtaaagcaatgccacaccttctgattatgctatccattttgttagctagattgagtgatcattttcattccatttagaatgcacttatgtttattatcaatgtttgcccttggggaaaaaagtgttgccagagaatacattataacatttgctccatctacattcagggaaattatgttaaaagtgaacatatgttctcttggcatattttattagactttgacatatatatatatagtttatttaatagcattgttttataacaattttcatgcttgtggcacaattttactaatatctccaacacagagcccttttagttaatataatagttgcatactcatagttattgaatacataatgtattgctgacctcatcagtttaaatccaaagcatcagctgtcagcttttaaagaattagaatatatcctagagattatgttaaaaaccgacatactttgataagcttaatcagaaacaaaaccaaaccaaacccttgtttgttaaaatttgttctccatgttgtaaatacaaacctggcaagcaaactaaatacaaaagcaaaaacatattaaaaataaaacgtattgaaatacgcacattaggaaagaggctgtaagcagtggtctaataatcatgccttaaaataatgcagtagccaagagtgtgcagggttacctgagttggtgatcttttatcttgtaggtttggtcgaacgcttctaaaaccttttgctgcaagagaggaatatgtagcatctccgttcagtgtctcctgattgccatcattgtaagatctccaagctttcattaagggaaaacaattggatacaaaaatatctacgttcacttaaacattttttataaaatttatttttatttccaaaatcatttttatttccaaaattgtagtgttcttactagaggtttaatttaatatgcataacagtacatgaaatttaaatttaacatgaagtcagcgatgtggctatgaatatgttttctaaaagtcacaaataatataataattattcagaatattttttctgtacctgagtctggtgactgagaatcacgccctgaaagaaaaaaaaatgttgaaattaagactaaggtgaaataaatgaacaacccagtaaaaataacatggcaaagaactatatgcattgtttttgcaaacattatttcagttttaaaatctgggtatgtcaaacatgccaaagggaggcttgtacatttatttttacttcaattagaatgtcattcattaaatatctataatatataaatatctatatagtaaacactcatttttcccctcaataatgttgcaacatgcaattttaatcttattatggcaaagatgaatatatgaatttctaaatatcaaattaaaggatcaaaagagatctggtttataaacagcactaactcaaactgccagatccttagcttccaatgccctgctgttgataagcatatttaactcctgtgttacagaactgtattctgtagttcgcatttttttttaccttaagaaactgtagacctgtctaccatatcatgtgacattttcaaattattctcgagactgagtttttttcctattgcaatataaaagtcattttatactcaaatatgaaaaaactgttacaacatgttccactgtctttcagctagtaagctgtggaaaataaatttcaggactaataaattgcttttggtaaggcagttggcaagttatcagtgatatatttgttatcaattttattgaagttatatattccaaaatcttctatatgcacatttgaggtaatcagtttgcacgtttaactcatgtgtattttaagtcatcagcttgtgttgcctggtttattaaagcacatggtcaactttacttagattcattaagctttaactttggaggtgatcctaggggttggatcattagcccaacctgctgtccagtcctggattccttctacgtgttccccaggaccattattagattcccatttcaattcataaaacaggaattttacatgctggaaaagtctttgtttttcttttagtgcttcagcacagttattttcaagtttaaacacatgaacttagaatgataaaaatgggctgagaaatgcgagcatctgatttttagataaaatatttgatatgggttctttccaaatcaaaggaaggaacacaaatgtgagtcagcacagagtacattagaatgattccagctcaggtgagctagagaagactaatgaattcccattctttatgatcattgataacttggtatggattttatctccaatgaatttaaaattggagtaataaaatgggtaccatagagaaaaattactttgaagaattatgcatgaaatgtttattggaccctacttctagaatttgtacaattttttgatttttattttattttttaaagatggggtcttgctattttgtccaggctgtccttgaaatagtgggctcaagagatcctacagcctcagtctgttggttagctgggactacaggtatgtgccactgggcctggcccttcttctaggatttgatggaagcagaaatgattgaaattcttaatcagctatatgatgaagataaagaaaaatacagtttgacaaaaaatacagagcaatcatcagaatgctgctttagggcactcaggagagagatttaataaccatgaggctgccatccactgtggacaatgaacaaattttgggatttgggaaaggacaacgaaaagcaaattttggaatttgggaaaaagcaataaaatagcccaatgctactttatgaaaagagaagcagcattaataacaatgattatattctgatttttttcttgaggatagggagtttcttttatgcttggtttggtaaaactgagataaaaaagaaggctgtgtgttagcgctggggacgaggtaatgggacccagaggcttggaggtgcaagggtgcaggtgcggtgagaaagaagaaggtgtactgggcgggtctgaaggacactagaaataaactccctctaaatgatagtctgtagggggcaggctctgtttcttcacgctggtcaccgtgttgaagatgaggagccccaggagacggtaagtgtgagaatcagaggacagtcactccaggctcaactgtgggtttcttcctgggacactgggcccagggatttccaaatgaatctgtccctgtgccactggaaacattagacagtaagaggggtgggctgttctgaagggtcttgcatcgcacagtggacacgagtgtgcagaattaagagaaaggagaaaatggccattgagtcgaacttcaggatgaaccagtattttaataaagcttatgttgatgattaaagtctgccttgaagtggctggtctctcaaggagactaaagtacattcatttctctttctttaaaataaatccaattacagatacttggaacacccagtcctgatttgctcttttattatagtcttctatgtggacactttttagcatagccctgcttttattttatccctgcaggaaagactaggagagggaggacacctgttctttggagcaggtaatagaaagtatcatggatccacatcaagtaaagagaatataggttagaaaaaaaaaaaaaagtcgcccaggtaaatggcttggcagatgtgtggggaaaatggatttccccagatctgcagcattattggtgcacattcacttgtgaaaaaaacacaaagctaggactaggggccagagtccttaatttctagtgttctttagtagacagtcactgcttcactgaaaatccacgaatgactaaatggtgtaagttttcccctttcctggctgttttgcatgtgaatattttaacaaatagggtcttgaagaatgaagagctccacgtgctcttaccagcccttttccttgtgtcgaggcacaaactggtgagtctctgtctgagattttgtgcaagacattcccggttccatgtcaggggtggaactggatgccctccatggccctttccactgttatcattctaacatgacagctttcgtgtagctgtgtttgtgatacgtgtcacatcgtaatctctactctcaggttttatttaaatcccttttaactgatatgctctattgacactatcactatatttttcttgaaaattattattttgatgcctataactcatttctttagaagactcaagtgctttttaagaattattttaaaatgttgattaaattcaggtcaactaattgagtgcctactgtgtttctatgtacaattataacccttttcatttattttcttcatttattctcatttattctgacaaatccttgtgagtctgggaaacgattaagctttcagagaggtaagaaatgacaaacaatttttcattggaaagaaaggaaatgagatctagacagactaattttcttaagggcatgaaacatgcaggtggtatcgacaagaccctgtctcttggcggagtggtccccatactgcggcattcctttaggctgacaaggggttttggtgaaataaaatgttttcaattgtttctcaatagtcattgtcttggttttggcataggtttaaaatatccgtgtgtgctctgatggattgtccagtgggaatttacttcttataaaaggaaaagagaaagacagactgactcaggggacaaataggtggtgactcagattgactgtctgatcagagaagggagtgaaaatggcttgggaccttttctggaggttttacataaaggctgttgtattttaacaatatcgaaggcaataaatatttatcaattcccttttgattcacatatagacactgtatcatataagttcttatgaaagctacatagaatgcagttgtgcatattaatgctaacttctttattcaaaaatataatggaagcttctttgaaaaagggggccaggtgtagtggctcaggcctgtaatcccagcactttcggaggctgaggcgggcggatcacttgaggtcaggagtttgagaccagcctggccaacatggtgaaaccaggtctctactaaaaaaaatacaaaaattagccaggcatggtggcaggcacctgtaatcgcagctactcaggagcctaaggcaggagaatgcttgaacctgggaggcagaggttgcagtgagccaagatcgtgccacagcactgcagcctgggcacagagcaagacccacccgtctcaaaaaaaaaaaaaaagaaaagaaaagaaaaagaaaaagggatcttactttacgtctaattgacacaaaagagggctgtttttaaacaattatgtccaaaattcagtggacttcattctctagaaatcatatgcctagtgatagaaaacttaaaatagcccaaagctacattgttattactgaagattatttcatattcctaaagtgtgaaatgttttttttttcttttttgctgttgtaattccgaagcattaaatcttttctatgaagtcgagttatatgaaattgcatgtagttcagtttcgactctccacatgggcactgtggaagcagtgtggcgttccctggtacgtgcgtcaaggttcacgtctgagtaggttggactgagatcctatttggttgaaatgtcaatgacattcagggtattggcattccaattacacgatggccctgaactcttacggttattgtcttacttgccttcattcctgtttctcatggtatccaaggtaaatacatctgtagtttttctaacacctttttatgttcatacgtgcatgagccactacatacaaatagagatttgtatagagatttttttttaaccaaaatgaggtcatactataaaccttgcaatgcatcttgcattttcttttaacttaatatataactgaactcactagcctggcatttaaacttggacgttgaaatccatttgtggattagaggtggtgaacggaagtgggattctgcatatggaagttcatttttttttctcaagaaaaactcagtagtttagaattaagtggctgtaaagcgaagaacaccctgagtatttaatcaacttctagatgtatgtgtgtagaagactgtgatatgcataatgagaattaaaattatttaaagatgccccatccctttctcacttctgctgtaagacccattaatcttataaataaaaaacaagcagtccccaaactgcagctaaccaaccagccaaccaaccaaccaacccaccaaccaacccatcaccaacaggtgtgggtctatttcagggtctggaggcactgggcttgctggcctccctttgaccttctaacagctgcaccccctcccagtgcagactgtgccttaggtactgtgcctaacttcggtactgtggcttaggtagtcacaacagagatttattaaaaagagaccacctgagtggatgctgaaatctcgcacccccagtgacttcctatctgtgggtacatgtgaatcttaattggtcaagattttggtatgtttaaatatatatagtagaagggtatttgctgattggattaaaggaaagcaaaggtctctttcaaaactaatgttctatcattctgttcacaacctttgacaaagaatccagttaatgaagattcagtttcctacaaatcccttttttcatcctgtacccctgtacccctaccccaaaagtttttaggttaaaaaaaaaaaccccaaaacctctgagttatcttaatgaaatattatgctacttaagttcatgagataacaaaaacgtgaatagttattaacactcgcagttactcaacctatttttggcaagtgactgctgtttttaattacacatttaaaatgtttcctacaagatctcattttcctttgctttttacgtttagaacaaaaacagtcagaagagctagaagccattcaagtgcgacattgtgtgagttagtgatattatacctgcagccaataggtttggagaactttgcactctcttcacagatgttagcgtaacagacatggcggcacgtttgcgagcacacccaccgctatctggaagcaaaaaaatgatatagcagaggccaaggcaacgggaaaagcacgtgcaatatcatgcgttttaagagaaatgtgccagacatccatgagaaagatgaacagttagaattagtaatcatggaatgcacctgccaatttcacaccaccctcaaactaaaacaaacaaaacgaaacaaaacaaaagaagaccagggatctgtcttagaaataggtatcactgttttagtgaaagcatggaagacttaatacttaacattttatggttttctttgtgaaaactcaggcacagaactcaactttgtttataccatttaaattcaatttatactaaatctataagcactggatctggcttttagagtcaaggattagctccatgtcaggattaaaggctatggtacaacatacttttaagttaatatcatttaagttttaccatcttctagctgttataattcccaaagagagcttgaataattcttgcagtaaaaattattagtgacacaggtatgatacatttttttaggattcatagaggaacacatggcatcatggaaagtccactcttcctgtagttagtgttagttatgcaaataactagccttattaaaataaaagtattgatatatatggtatcgaaatgaccatgtttaaagaaaggagtatattgcttttactttttaaatttttatttttagggccggagtcttgctccatcacccaggctggagtgcagtggtaccatcacagctcattgccatctcaacctcctgcgctcaagcaatcctcctgcctcagtctcctgagtagctaggaccacaggcacacaccggctaacgttttaactttttgtagagatgtggtcttgctgtgttccccaggctggtctcaaactccctggctcaagggctctttccgcctcggcctcccattacaagcatgagccaccgcacctggcctcatttattgcttttatacttttaacaatatgtgtactatgattcatatctttaaacttatgcaagtcataatgtgaaataaaatcagtgtaagttcatcagccattttaatgtgctatgagaagtttagacttctaaatttggaagagaagtcttttaaaattggaaggccaatgttctatttatgaccagattcaaattccattcttacattcctctgtaatatggcatggcaataaatagttttgctcattctcctcattctgcttattgagtaaaaccaaattaaattaaatctttttgaaagttataaaaaaagacaatataaccaccgatataataatataatcattatatattgtcacatttccatttttcctttttctttattttcataaggaaagtatcaagtttgtttattggacatgacagaatttagattggtaaagatgctcggaagtataatttgaaggaatttttcataaaatttataaatagtaagattaatagaacttaaaagcagtggagtgattcttacttcacttttttaaagtatatgtttaaagtaacaatttcttaatgtagaaaatcattaaaccagaaaaccaacttgaaagaatattaaaagaaaatgaaccaaataaatcaaaggttataattaagaacccaaagaaagtgacacaaatgggagaaacaactgaagattccttcaggaaaggctccaaaaggattttagcgaactcagcaaactgaaagtgcttagagacaagtgcgtctgataagatggaggtgatgttattgcttccaggagctggaaactggttgaaatggttgtgtagtcaaaggtgttgaaagtaaaaactgacatcactctaagagtgattttatttcctagttctgttaattctgaacatctcacaagcacataggtgaaaagagaaaattccagaatgagaagatccagggtcacaggttaaatctctggtgttcaaactgtgggctgcgatgccctgggctgcactggtgcattcatgagggtgttggggggtagttcctgtttttaaggaaaacacagtgctaactgttggacactcaatgaactacttgcttggggcagtgcctggtttcaacataatagacgcgctatattccttttgatgacatcatattttggaaaaactgggattttgatacttgctatgataaaaagcaagtaccatctgaagaacattttatttatttatgtttagagacagggtcttgctctgttgcccaggctggagtgtagtgatgcatttggaccttactgggctcaaactgatcctcctacctcagcttccctcatagctgggattacaggcacatgccaccacgcccagctaatttttaaaatttttacagggatagggtctcactatgttgcccaggcttgtctccaacacctggggtcaagcgatcctcctggctcagcctcccaaaatgctggaattacaggcgtgagccaccgtgactgtctggcctgtaaatcattttagatcagtaaatgagagtggtcatgtacaatcgaattctaaggtctgagaaatttttcagtgtgcaacaggcacacacataatattagtaagtaattcttgttataaagaaagaaataaaactattttctttcaatttatgtgtactgttctgtcaaatggcttctaagttgttagaacaaagtatttataaagtaattattaagttattaagttgttagcacctaactacttaataaatagaagtgttacatatttttgacctaggagcacagtgaagaaattactgagacattaaaggtcactgtaaaacaagaaagtttgggaatccttgggttagacaatttatgtattttaggaagctctaagtcttagatgaaataaatggaggctctgtctttaataaagtttaataaagggctgaattctaaaacttgaggcatttgtaaaattgctggaacagaatgatctattatattgtgtttctacttccttttgtattgatactttctgatactccttgaagatatttttaagatcttaaaacaaggatgctacctttcatgtgtcagtttatcctaaagaatcctaacgctggtcttgccttttgtcctcattaatgacctgcagccttgctaggctactcttcccctgagctgcaagattcctggaagctgttcctactgctggaaacccctcatatgggtaaattatagatggataattatttgatgtctttccttctctcctttcttcaatagctaagatatgcctaagaaagtaatgtgttaaacattctaaaagtggacatataacatgttttgtatatattttctacattgtttagacactttagtatgaaaaattaaccacattccccatggctagtttattatgcactgattaaaagcaaatacttaacttaaaagaatgctttttagccgtggtgaccaacacatgaagatttaaataggaatatatatttttaatgattgatatattggatagatatatctatcaataaagagatatattcctgtttaaatgaatattgatatatatatcaataaaactggcctgtattatttatctatatagattatctgcattgtctatccatatattatctgcattatctatctgtctattgatagatagataaatagatagatagatagatagatagatagacaaaaaagtcagaagagctagaagctattttggggatgagaaaaataacttgtggggccactttattcatctatctatctatctatcatcatctgtctatctgtagatagataatgcaggccagttttattgactagctctttaggaacaaattcctacttcattttgtaaacacagtaacaatgctttcaaattcctaaggcaatatatgtgtgtatatatatacatatatatttaaaagtggtatgtttttataaaaacattataattattattttggaattttgagcaaaagttttcagtcacttttgatcaattttatgcatatgtttgaataccatattttccaatcattatacattaagtggaagttcatccaaataagcaaaataatcctatacaaattgcatcccatccagagtcaagcttactccttagaaatgagaagatgctttagaaggttacatttatgctgctaagcagtaacttgggtcaagtaccttagtgacttaaacaaatttacaaatttgtatgtgcttattttgctatgagggattgaattatatgaataggaaggttaattattgagtgtactgcccatcaacacagcatattcagtatatcatgtatgcatatccctgtcataatagtgttataataaataggaaaatcagcactcagtaaaatgaggaatactgggagttatgatccacttaagtctacagggaaatgtcttggaaggatcaggaaatatcacttcctcatgtggaacttctgctggagtgactttgtagctccaaaacatggctgatgctagtccagctgtgggctctacattctatttgctttcttctgtctcctttacctgctaatattttctacttcattccccatgtctacttctgacatctccaatcatcaagttgcctttgtgtggtgcatatgcagggttataacttctcttgattgctgagccttccttgtgtgttttgactgtctccagtatcctcatcttgcctgttgtccacatgtctgcaaggtgactgcatccccaggagcccgcccgcacagccttctctgaggccactacggcacatggcacatgacgcaaggctctgcactcgacctggggattaggtattggtcctcgccagtggctgggtaatcctccttgtagcacttgatgcaacaagagacctcaaaaaggcaaccagctggacatgagagaatatcttgggccatcctttctactctgccatggcgcgacggctcaaacaactttccagtgatcacttgtggataggaaatggtatcgtttaaacacaagttacaaaatttcaacgagaaagttgtttcttgaattactttgtattgtatatttcaaggtggggggaaggcaaaattataagccaaattatttctactgtggaaaaaagttcatatgtacaaagcatgtatcatgaacacttttacagttaaaatgtagacaatacagtttagagacacagttgttaagttatttggagatactactctcacatctacacatataatgcttataacactatgggaattgtgactataggttaattaagctgattttgtataaaactttggcactctatctgctgacttcttcaacataaagagtttatagaacaggtaagtttgaatattttcttctagagcaacttgcctttgaatttagcctatttttaagtgagagatttcaaaagtacacaaacaaacgacatactacctcttcctattgtttataggagttagttttaacatgtgattagagaaaaagggagtaggagcaagtaatagaagagaaaattctatgtttggtggctataagagtggggcacaaatacaaagaaagaaagtaatgaatctatgctatgtatctaatcagaaactcagaatcacatttaggatcagaagagtgctaaactaatgatttagggccaacatgatttttagagagcaaggctaaaagagtttaaaactaacagacagcatacctgtgttcattttcaccttggagagtttgttattaaagtcttcagttttcctgtaggaaaaaaatggtgcataattgttcactagcatgtggaagaaaatatcatgaaagtgtgtcgcatttttgtttttgatgtacctgtaagttaatatcacattatcattagtcttatttaaatcagtgtttaataaggtaggaagaatttataattctgttcatgttaaactttaattattggtcccatgctcataaaacagacatattctgtttttatgcttttgtttaatggtgagcattaatggatgaaaatggagacgttttgtgcttgtttttctttttttctttctttttttttttgagacagagtccgccactgtcgcccaggccacagtgtagtggtgcgatcttggctcactgcaatctctgcctcctgggttcaagcgattcccctgcctcagcctcccaagtagctgggattacaggcacatgccaccacacccagctaatttttttctatttttaatagagacggggtttcactatgttggtcaggctactcttgaactcctgacgtcgtgatccacctgattcggcctcccagagtgctgggattacaggcgtgagccaccgtgcccggcctgtttgtttcttttttagagagagggttgtgctctgttacccaggctggagtgcagttggtgtgattgtagttcactgtggccttaatttcccgggctcaagccatcctcccacctcagcctctcaaggtgctgggattacaggtgtgaactaccgtgcctggttgagttttccttttaaaaaattaaatttcttttacaaatatttatacaaatggtttttgttctctaagcctgaaatgattgcctgttaagtgtcctcttccagagttttaaaagtgaccctggcactttaaaatcattgccttacatgtgcaggtcagttgactaccggggaatatgtaatgaatgtaacgcatattttcaggacactgtcaagaaagatgagattcatctttctcttttttaaagacacaggaaatagatggtcactacaaaatccatctctgcattagtattgaatgctgatttttcccagtgaaatgttggatgcaaagcaattgagattaattcgctagaaacggttggcagaaaggggttgtctcagaaaaaagtttttttttttgagatgagtctcgctctgtcgcccaggctggagtgcagtggtgcgatctcggctcactgcaagctctgcctcccgggctcacgccattcttctgcctcagcctcccaagtagctgggactacaggcacccgccaccacgctcggataatttctttttgcatttttagtagagacagggtttcaccatgttagccaggatggctacgatctcctgaccttgtgatccgcccgcctcggcctcccaaagaaaaaggttttaaatattgtgtatcgttttatgacatgtgagatgacttagttctttctctggcatattctcttagcccatttatggagtttcttatttacccataccctgaaaccaaagaggaaagacacgctgataaggtagcaaatctcctaagtccaagagctccctgcaagagctgtctgaccccggccacttggcctttgctcctgagtgggcctgttgttgagtatccacaagaacccccccgcacagcacaacacactcacagcttccaggcgcatcagtactgcaacatccgaacattttcaagaattttatttattccttttggatgaatgaggataaatttgaaatgaaatcattggcatgatcacctgtcaagaaagacttttgataaataaagattttttagtctctaaaaagagcagcaaatgagcttcctggctttcttgcctttgtctgccaaggttctcaccctcttctcccttctgaccatttcctctgctcaactcacaactattattttctttcaatgtggctattggagttcacctcttttggaaagcctggctttgttcattactgatgaaaaattataataataaaatcaaaatgtgaatattagctaaatataatggtacttctctcccagtggggggaaaatgatgaaagaaaataacattaaaaatacacttaagtcctatgaaatataattataaagcaagattttatatatagatatatatgtatagtgtaatcctcgttttgctatatacacatgtatatgtgcacacatacacacacacacgtatatttgcctagattgaattactaataccttaggactcaataaatgctaaattaatgaacatttaaaataggtaaaatcacagtactgataatcacctcagtatatgtttttagagctctacgctgaaaacaatatagacgatatccttactatatggtgtttaatttttgtgtggtctgtgttcagtgtcatatcgttgtccgtctgccctgggcatcattgcagtgtagggagcagggcaggagccatgcttagcgtggccaggctagaactgagtttccacagggttatggggaacttcactggggcatttcataggccaacagactctgaaaaatgattgagggaaattttatgatggtgaattttatctcctatttttcagtgtatgcaactaaacaggcacatttctgttttacttttttgttttgttcttctccagaattacacagaaaaaatgtggcgtatttctaaaaactcagcttggtagccttaagaccgcctgtattgagggataccgatgaagtcagggaagagggcagcggccagcacaggagctttgggaaagctccttcaaacgtatttagtttaatctctcggtagctcttggtagcaaaactcctaatatgttaaccttaaatggacaaaataaatggaaaagaaaagcctcaggggatgtctgtgactgagactgaggcaacttctaaaacaagaagggataaacaacctccagaaaatgaggattatgaggacctttcccaaattcgacttcttcattccttttgaaaccaggcaacgctgtgcttacaactgcttaaggttttaaaacggaatgaggaagacagtattcgggctagaataatagtgattgacaaagaaaacatcaaatacagaaggttaactctcagaatacaaaatctgctgacagacaataataatgtttttgtaccaagttagagaactagttatcaacacctattgtttgaattcaaatgccgatatttacagaatatctaacactcaaaaagtaaaataggattaacgagaacaaagaaaggcgccacaaatccttgaggttttcatctttaaagtgatgtatcctgttacttataaatgtaatttgtgaggctttttaacttcccattgttttagatgtcaaaatgtgaaatgactaacttcctaatcaagcaagacattttccaagtcgttaaaagaagaatcccagtgattgagctctcaagaagaacctgaaaccgaaaggcttcttgggtgactaataaaaatgcacgattctatttcccttatttgtgctaagtccattaacaaatccacgactgagaactctctttagacagttcaaactaaagcgaatctaatctcttttgttctgctctgaaaaagtgtccttgattgtacttacataacaagcacagattattctggaaagcatcaaattcctagagtctttgcatgctgctagacaacagcatctcaagtattctcttaacttggaattgaaccagggacgagactatgagaactgaccataacatggagactaccttgagccttagcagacaatccacggagcaaagaagtctccgaacatgaaggtgtcagcatgattttcaataggtgctaggggattgtgtttacttttgtcaaagtttcatataaaaagcaacttcatatgtgtcctaatttgtgacaacaatggattggttttacttatggattagagtagcctccactgtcaaaatacatatggcaatagattgtgttgattgttcatggaagggctgtaaacagcatgacttcgggtctatagtcttttaattttgcttgaatttcttttttttctttttctttttccttttctttcttttcttttcttttttttgagacggagtctcactctgccgcccaggctagagggcagtggcatgatctcggctcactacaacctccacctcctgggttcaaaggattctcctgcctcagccttctgagtagctggaattacaggcgtgcaccatcacgcctggctaatttttgtatttttagtagagacggggttttaccatgttggtcaggctggtctcaaactcctgaccttgtgatcctcccgcctcagcctcccaaagtgctgggattacagatgtgagccaccacgcctggccaattctgcttgaatttctttggattatcagacatctcatttttctcggaatcagagcaggctgtgttctcaatacgtataagagaatagaatgggtaatttaacttttgaaagaggatcctaaggagtttgatcctgcatgggcatgaacatgcctttgtgcctgttgtctcataattctgcttgaattgttttgattatcaggcatcccattctgaagagcagcagagacaaaatcctttccccagttttggctaagaattctatgtaggtcattttatttttgtagacctgaatttaagcaccaagaccatgtatgaaactacaggactgaattttagctcagttaatgggaggagttgcccaaaagattttccacagacgaaccttaagccaatacattgctactgttattttgaaattaacatattcacagttcatatattattcaaaaaaggacatattgatgtttaagtagtaggaaaacattgcaggatgttagtttttttttttaaagagatgtattttaaacatgaacataaaaatacaatcatattaaggttatgcaccagattttaacttgaatttacttatttattttgaaatgggatcatttgtagcactctctttggataaactgccctaagtgatcaatgtattaatgcatctctctctatctctgactgtggtaaaataagaagtattcataaatgccaagtgatttcacttttctattatagtcaaatgacttaattcaggttgacatttatcttcacctatctttcctatatgtcaacatgctgctttgaaatagtcacatgaaaactccaagtagtttgttttgtgagtttagaaactctcttctgactagtttctctaaattggctcagagactcctctgcctgagtgggtggcacacaagtcaacagtagcggcatgactgtccatgctcataagaacaccaagtacctcccagaactcctgtgctaacagtgcctgaaaatgttccttattattcaggagccgaattacccgcggcatctatttatctatgctgaggccagaacacattcaacatcatttctaggaataaggagacattattaccacaaataataaagaaataaatgaacatgaggccgttgataattttttatgagaatacgcggagtgttagttttaattagaccaaatgtcctgatatttggaaaaatttcctgaaaaaagagcactatatgtcttccaaggaaactagcaattttccttttgagactttacaatgtaagctgttcaaaatacttatcaattttccctaaagactttactgattagaagttgatcacctggtaaatgattccttctgatgttattccaaggtctcaaagttggtgaatcactcatttcactatttgctttaaatggtcatgtgacttaacattggtccagcaccttactttcttttttttctttaggtggaatctcactctgttgcccaggctggagtgcaatgatgcgatcttgcccactgcaacctctgcctcccggggtcaagtgattctcctgcctcagcctcccgagtagctgggattacaggcatgcaccaccatgccgtatttttagtagagacagggtttcaccatgttggccaggctggtctcgaactcctgacctcaagtgatccacccgcctcggcctcccaaagtgctaggattacaggtgtgagtcactgtgcctagccaccctactttcatggagttccttagttttatattgtaatcttagggatcattacggaacaacatctaagtattttcaagtgcatcttttttctaagactaagtcatttgttcaacttgatagtacagtattaggagaattccattggcttataatgtgcaaatcaaaagccaaaaaaatttctaatgaaaataattcagattctgactgaggatctcataagtcaggcaccttatcaaagagacatgtgaggaattaattagaatatccctataacacatgtataggcaaactgaatagcgttggaagaatgggtcaagaaataggcaaagcttgactcaaatcccagttctgcccatttctatgcatccgaacaatttataccaatgtcattatcatcgactcccccgctagacagcaaagcatccccaatctggcaaactggcattattcccattcactaatatttcaaatattttgaagcagatctttacctttgattgagtcttaagaagataatctagactttcctgaaaatacatggggcattattgtattgctttagattgaagcaagccatatggtttattagactgatttctatggattttcccgtctcccaattgtcccacacccagcttagcaacatgttggaattgaaaaggaattctactttccaggcagctttctttcttccttaaaaagatcctttatttagctaagattttcccccccacacattgccatgaacaagagaaaacctaagaaaatagttgaatcaaacccttgccttctagcccagctatagacaatgctactggatctaagggaaagtgacactataaaggttttgacgattagcttttttaaaaaaatcattctctttccctttgacagctgatagccgaaagcgatggctgaatggaaagagatgtctataaaatgtcacataacaaattgtgtgacaaattgcagagtgataacatcctgatggcagcctactcctgcttaattcaataagggaaagtgcctctgatttcccaccttgtactgagaagcacacatttctattttgaggagaaaagccttgatctttttaaagaaccattttttaaaattttatgctttgctaagtttctcactgcttttaattttaaaatcttccgttttaatttttatatattgaaatataaaaatcatctgatatcaaaagaattatgtaatctagtctagttttgcatgtctcatacttagactttaagtagaagcaagcatcaaaggctctggtagggattgagatcaaccaactcatttttagggttagacatttgaggataagataaatggatgccccaagcagatactcaaaagtagttcatctctcctgactcctagcaaataataggcatcctcctttaaggaatcttaaaacgtcatttgaaatcaagatcttggccaggcgcagtggctcacgcctgtaatcccagcactttgggaggccgaggcaggagggtcacttgaggtcaggagttcgagaccagcctggccaacatgacgaaacccctgcctctactaaaattcaaaaattagccgggcatggtggcacatgcctgtagtcccagctacgtgggaggctgaggcaggagaatggcttgaagctgggaggtggaggttgcagtgagtcgaaggttgcagtgagccgagatcgcaccattgcactccagcctgggtgacagagcaagactccatctcaaaaaaatgaaacaaaacaaaacaaaacacaaaacagaaaaacaacataggaaatcaagctctttccctttaaaatattacagtaccctgcttaattaagtactgaatcatatgaggcaggggttagggaaaagaacaaaatatgagaagacggtgtggtagaaggcaaaactgtttgataaataaaataagaactgttaacatagaaccatatgtttcttcctctaagactaataggaaaacagtggttgattatgacaaggattccttttgcccaatcacagcacaagtccaaatggaaagtgttaatcaggtctactaaacccaaagcatattagacctccttggtctaagcctagaccaatagccattgattttttttttctgaaatccttagaattttcagttagtaagtatatctattttaaattattttcatggtaatgttacgtggtgaaagtattacagtgaaataagcctgcttattgttaattcactgttcttaaaaagccacacttttcttctgattgaatacacctgtttcctgagcacctgaaataacatttatatactttagcaatgtcaaggtttgtcagaatttttgacagaatatactgtcagaattattacaaattcatgtttatatgtgtctcagatatgcaatggtgaaatcccacttgctatgtggaatttaaattttggggcaggggaaaatttgctctaatttgatcttatagtcttaaaatttaagtaatacattacttacaaagtttatccagaatgaaatgtaccttttttttttttttttttttgagacagagtctcgctctgttggccagggtggagtgcagtggtgcaatctcggctcaccgcagcctccacctcccaggttcgagcaattctcctgcctcatcctgcagagtagctggggttaccggtgtgtgccatcatgccaggctaattgtagtatttttagtagaaatggggtttcaccatgttggccacactggtctcgaactcttgacctcaggtaatctgcccgccttggtctcccaaagtgctgggattatgggtgtgagcctccatgcctggccagaatgtatcttaaattgtacatcttaaggcagtttgattcattttagaaaatttgaacgagaaaataataagccaatggaggaaaaatatcatctgaagaaattttgaatgcattaaaagttggaaacttttgatatttgtgttgaacagtggatagtttattacattattctttgggatctaataaaagtagacaataaagacagatatcttccattttaatggaaatgtattattcagaaatgtattattaatatttatatactgctgctccattgttattcagacatttgaaaaaattctttacatttctctatgtactaaatgtacaagtgttaagcagaatcataggtgaataaaaggtactcaatttgaggagtaccctgttccgactgtgtctgcaacatttttattttagggaaaaacaaagtggtgtgtttattgattctgcagaaggcatacacacgagaggggaataggtaataagtagaaagatgatcttgacaggctgaattaaatttggctaaactaaatttcatgattaggttgaagagactggcttttcaaaaatttatatggaataagtctaagggctttaatgcaattgttgaaaaatataattaaatcaatgtctaaatgaacagtggtttcatgaatcaaggaagattgggctccagctgcctcacttttaaagtgtccacatgagtctgtgcgtgagtcaggctggcatgaacttgagtctctaggcaggctttggaggctgtgctgggtggggggagggtcacagaacgatatggtagagacactatggtgagtttccaggtgactaccagcagcaacaggaaaagttactgacatgtacttgaggtttatttttttctttcatctcgtggaactcatcccagtggcccttagggttaatgctcttaaatataccaaatttatgctttaaattgacaagaagatgtataaataacagttgcagctagaagcttcaatattccctcaagatgtacctgaatttaagaaacataatatctaaataagactgtttctcagtgctgggtttttaaccatctggttcacaattgtcatcagaaagaatgaaaacaagtccatcctagaaataaggggtttaagacttcagaactgtacaacaaaatgggatgtggtgtctattgcccttttgttcagcaaaatgccaactcagatgacctcacttctagttcttaccccccacatatgttcccagcattcttcatttttcatacctaatatagtccttcatgctctgccactatttaaagctaaaactttcactcaatccaccaaaaataggcaagaaaaacaacatacaaatacaaatttatattccacagttacacagtggagaacagtgaagcttatttgaacaaagtttttgttgtttcataatactctaacttatttgacgtactggctaaaggtagaaatgatcagaacactttttgagattgttagttggcatattttaacatatgtagtgaaatcctactcagtctgatctttattagccatttctcccccttttatctacagaaataaactctcaacactctttcttttatcttggacttttgccactcttggaaaagcagaaaaatttccttttgacttcccaactacacgaactctttcagggcagcctggttttagctccagggtagtctgccatgatgctcagggccatggatcaccttacagatccaacctgggcctcttgttcgcatcgactctaccctgggactcagcctgttctccttcaggtccacaggtagagaatgtctgtgtggacatcttcatggacagagatacccactgacttctgatctgatacctactgacttcatttccatttcttcttttataatggagcgtaaaagcactttgtcatctgtgctgcagcatttggtaaaggaaatccagaacccacgctgggaccacatgcatttacattgattctagttaattatgtttgagtggagtgatcgcttttctatagtacatagaaaatgttaacatgaactattattattgggatgttggctgtctgccattcctaacacagagcagagggtaagaaaatgtcactcatattgggagagggcaaacaataatggatgggccaaaaagttagcaaatttctttcttttttttttttttagacggagtcttgctctgttgccaggctggagtgcaagtggcgtgatctcagctcactgcaacctctgtctcccaggttcaagtgattcccctgcctcagcctcctgagtagctgggactacaggcacgtgccagcacgcccagctaattttttgtattttagtagagacggggtttcaccatgttggccaggatggtctagatctcctgacctcctgatccacccacctcggcctcccaaagtgctaggattacaggtgtgagccactgtgctgggccgcaaatttcttttttgtgggagaagccactttagaagtatatatctacataccttgtctaagtcaatgtgttgctataaaggaatacctgaggctgggtaatctatacagaaaagagggttatttggctctcggttctgcagcctgcacgggacgcatggcactgacatttgcttgggttttagagaggcctcatgatgcttccactcctggtggaggggagaaggttaaagggagccggcgtgcagagatcccatggcgagagcagaagcaagagagagcaggaaggtgccaggctcttttcaacaatcagctctcaagggagctcccccaggaatgaatagagcaagaactcactcactctccctctgccagggaggacactaatctattcatgaagtatctggtcccaagactcaaacacctcccattaagccccatctccaattggggatcgaatttcaacatgagatttggaggaatcaaatatccagaccatagcacacatcaatagcgaggaagtggcagagtcagagttcaacaacctatgttttaggggacttccaggtatgtgctcttaatgttacatgactttttttttttttattgtactaaagtgggagtcggtgttaagccttgtgtgggaaggtatgcttgggcaaatcacttcacttcgatgagcctgagttttaaagtttataacatgaaagacttgatttaaaatataaaagcacataagggacttttatggtttgaaattttgctaaatctaggaaaggtatattcaaccaacaaacatttgttgacctttaatgtgcaaaccactatgctactgtcatgattgtacatatcaagcagaaactaactggaagccaatatttaatgactcattcacatattaaaattcagaaaaaggagatggttaaagacccgtgcttctgatagcatcatgatgagatggggtacatattaacacatgtccaagccaccatcctgacaaccaagctgtctccctctttgttgtctgctttacttaactccagatataagatctagagaattgtttatatattacatgtctttctatattatctccagtgccctacccttgagcttctcaattttagaatttgatcgttcctaaaatagaatccattttataaatctgcaccagaagaaacagacagaacttcagtccatcaattttcattaatttttaaagcttttttcatgagtagtgtggtaggtacattggaggtaacaagaatcattgattctttttttattctgttagaatttacagtagaggagaacttcaaaacaggtatctcaatcatggaggcagcttggcattccaaatattacgtttttgcatagctcctattttaaagagtaaaagtctattggcttttgaaggaaaaaaaactaaaagatctaagcagactgtactcctagccaatattctcatcacatttttcttactggctgaatcagtcatgccataacttgctaaatgacaatagcatgggaagtacaatgacaatttgagttatttttcatgtggatggttgttgttctgtgctttgattactgttgagaaatgtcggcatcaggctcacaaacaattgccaaggtcctatgacccacaaaaacttcaatcagcctgttcccatgttcagatgttttggaatttggatgtttactttacataaattatgatttaatattatggctatttgtaaggctactatgtgataattgtatcattaacttcaaatgattaagaaaagcaatctgaattagggagaagtgagttataaagtgcttgtgaaaaaaggcaacgtattttccttcaaaaatacagattaactctaggtcaaggcaataacacctaaaataaatcctccagggtcctagtttaatgaatacataagaatgatttgtacttctaacatcaattcatatggaatgaatgcttctaaaaaggtttattttgtgtagtataagtatgctagcactttgcttaagaatctagcttttaatattatcaaaagtaaagacagcctagactctcactgaattacctcaatttctaaattggtatgtctaagttacgattcagacataattcatatttatttcccatttcatgttggagtcaggatattcgcttctccccaaacctcaccccatttttccagtattcctcacctcagagaatgctatcattcattcattattttttacaattttatttatttatttttttgaaacagagtctcactctgtcgcccaggctggagtgcagtggcgtgatctcggctcactgcaacctctgcctcccaggttcaagctcttctcctgcctcagcctcctgagcagctgggatcgcaggcatgcaccatcacacctggctaatttttgcacttttagtagagatggggtttcaccatgttggctaggctagtctcgagttcctgacctcaggtgatccacccccctcggcctcccaaagtgctgggattacaggcgtgagccaccgcacctggcccattcattcattattcaattcattaatcaaaaagtttgagagcccattctactccacaaattaccctggatgttccctctccctcaactctccatgttttgagaaataagacaagaaacattcagctctgggaagggcagcatgcttctatctcagtcccacagttcatttgcccaagagacttgggcatgaaagataagcatttctagtccttttgattttgcacaggtcagatataggttaggcacaggttaacacagagtgggcagatgggagtctctgaccagctcatgcggtgcaggagttatactgttgcttcactttcccataacagcaatggatccgaaatggatgatgatgttccagtgtcacacaggtaggggcagcatggcagataaacgtgagagaaaaagcagtgtgtgcatgcacatgtgcacatacacaaacacatgtgcccatgcacaggcacacgtacacatgctgttgtgttccccacccagttgtctcaaaggccacgagtttgtggattttatcttcctagttcagtacaggactacccagaagttggtcgatattaaagcctcaaaggaatcataatatcacttttgtccagattttattttccaatcctctctttgttttatcaaaaacattttaggagtacattttttcagatggattatgtaaacactggacctgttcgttaaaaaaatttcttagagatcaagaccatcctggccaacatggtgaaaccccgtctctactaaaaatacaaaaattagctgggtgtggtggtgcgcacctgtagtcccagctacttgggaggctgaggcaggagaatcgcttgaaccgagaaagtggaagttgcagtgagccaaggtcgcgccactgtactccagcctggcgacagagcaagactccatctcaaaaaatatatataaaatcaaaaataaaaaaaaattccttaaagtttaatattgatatgttctatatgcaaacatgaatgggggttttccgttttttcactgctatacactcagcctctaacaatatctggtacatattatttacccagtgaatatttatagaaagaagatgtcctcatttacagacatgatggaatgactcccatcgtgaagtggtttgtcagggagagttagacaaaggggcttgaggattcccctcatttgccattacagtccaccccttggctcttctagtctattgagggcctttcttctgagttgctattggacatcttgaatgtaatggtgtccctagacaccagtttacattgtcttccagcatatgtcacttgaggaatctctagatgatttagaggtgtcaggctaacaaatccacactcattcctgaaaatccctggaaaatggcaaagataattgagctgatattttggcaattggcaggatgattttgtttgagtctgaagtgtattttaagaagttatttaggtttcctgaataccaacagtatcatgaaaatattatgcttgccacgttgatttaatcaatcaattctaaatcaccaaattatatcatacattttaaacaaaagcatttttactattgaaccctaaacatgaatgtgacttgtgatttttgtttttccaagagaagactaatacaaatattcattttagaaaaattctcagtacatgggctgtttgtatatatcttaccacttcatatcccaaccaaaatcagatccacaaacagcaagcaaacaaacccttgactcttttctcttttagttagttgtaatataacataagtgatattgattgtagcaatggagaatgattattgttactttgggggttgtgtctcaagtatacacaaatggataaaccacaatccttggtgcatgacaaggtcatgtacatccccctccctcctttccttccttctgtcactaaacatctacacaccaaccatctaaagccaaagatagaccttcgtaaggacctgtgtctatccagatgacttctgctgttataacatccctcagctccatgcatttgagtagccatcattctgaattccatgcttatcattctcttcctttcctgttcatataatttcattgtatttatatgtcttctaaaagcacatttattttagttgttttaatctttataatgatataatgctgcatataattacattgctaagattcatctatattgttggttatccctgtagtgtgttcacttggtctcctatataatatttaattttgtcaaaataccacattttgtacatccacttcctgttcaggggcatttgggttgcttctagatttttgctatattggagagttctgtcataaacacgtatgtacatgtttcttaatgcttttcttgtgaattaactgcttggcagataatttaaatgatatagctcctacttaaaaagtattttctatgtgccaaaaactgatctaagaatatttacagatattacatgtatattaattacatatgtgttacatatatattacatattacacatatattaattgacctgaggcctcacaacaaccaaacaagctaaatactattgttatcttattttactgcaaagaaacgccaaaccacagggaaggtacaaggtcacacagctattaagtagtgagtgaagcttgggaatgcaggcagtttggcttcagagtttttgtactataatgtctttcttggatctaaggacataaaggattgcaacagtttataacacataacttagttattgaccagaatttgagtgtgagtctgtcataatcaggattaatcaggtacagtacaccctgtaatgagcaatattggaaatgctcatgtatactataattactctaagacaaatgtcataaacatctttgttttttttttttatcatgggtacaaggcacataaatttatttcaataggacagctgctgcttttgatgcttgttctcacaattccgtggtggtagttgtatttgtttgttctcatgttcctaataaagacatacccaagactgggtaatttataaaggaaagagatttaattgactcacagttccacatggctggggaggcctcacaatcatggcagaaggcaaagggcatcttacatgacagcaggcaagagagcttgtgcaggggaattcccatttataaaaccatcagatctcatgagacttattcactaccacaagaacagcacgagaaagacgcaccccatgagtcacttacctcccaccggatccctcccatgacacgtgggattatgggagctacaattcaagatgagatttgggtggggacacagccaaaccttatcagtatttctctgtgtttctcacaaacatccctgagcactttattgttatcacccaccataggatggtcaggcccatctttcttccccttgaaggagcccaggcttctcctaggcttcagtgttaagggcacagtgggttctgggtgaccctcataaaatcagatcatgaatttaaggcagagccgacttgggctctcactctccaggggagatgttcttagatgaacaaaaattctccttagtcagaaaagcagcatcctcatcaatgtatggaattgtggcaaacatattaagcatgtcattccttaagttaatatctgtcactacataataactcacgataaataaatgtggtcaagaaactatattgtcacaggtacatgtaatagataaagacagggagcacaaccagcgtttgtttaactttgcaaggatcaaaccatcatcagaaccaccctttgtgtcttcattaattttttgttcatgctgattctgaatgtttagtctcaagaggaattatgagccatcagattggatgagtcaccttttagttataatcacaggagcattcaaaaatgaaatcactttattcagctggatgaaccttataaaaagtaaatgacttcatatacatttggcataaggctaatgagctatttttagtttttcctggaattatcttagcccttctttccgccctccgtgatgcctgcctccattttaccccttcccagtgctttcttggtcatgctaatcaaaaaggaaagggggaagaaacatgtggttttgataaccttcaaatcattaaggcaagggggaaaaggcccacaaaaggtggctctgaaacgtggagcgcctttccaagatccaaataaagtgttttctagagagtttcatgttatttttatcatgacttttataatctactactatcttttaaaatctgcattagaatattatttctggatctccaatctttatatctatttctacgtgggtatgactgtatgtgtccctcaaaaaatttcaattcagttcttgtgaaccagagaactcttcaaccttttctctttttttgagacggagtctcgctctgttgcccaggctggagtgcagtggcgggatctctgctcactgcaacctccgcctctcgggttcaagcgattctccctgcctcaacctcccaggtagctgggattacaggcatgcaccaccacacccagctaacttttgtattttttagtagagatggggttttgccatattggccaggctggtcttgaactcccgccttggcctcccaaagtgctgggattataggcatgagccgctgtgctggccaaatcttttttttttttttttttttagtaaaaggaaactaaagttacaataaagaaataaagaaacttacattttgttgacactaaatggcaggtttcatacaaagactaatcttttttattagggtaggaataattattggtgactttctctgccaattttccaagtgttggtaatacatgttgttactttttaaatgtgtttttgttacttttaaaatgaaatgaaaaagacatataaattatagcatacatgtctacccctacatttaaaacaatatattcctatgataaggcagaaaaattaacctacccttccctaacacaaacttccctttaatgcctgtggccatctgtagatcctgtcctctgttagcaaactccactcatttgctttttgaagttgagttcaagatcctcccatctcctcacctgccccgtcacccacatctctgcattactgtaggctcactgcatgtgcccttcatctgacattgaatctaggctgtcttgcaacatttctgatattactgccatttaatttaactttttatatgcattgccttttttttttttaagactagtcaagtgcagtagtgagaaggaagaaagagtggaacaaggagttcagctgtaattgactaaggtgactcactctgtggaccagcctgcattgcctttctggctacattggtaagtatgttaaggagagggacaaagtcacttgaagtttttggcctcggtttcctcatctgtaaaatgaagggaaccaggcctccgaatgttgttaatccaacacctataactctttttcccaaggttgaagatccccagtaatatttcagcttgctttcactcgatgttaatccaacacctataactcttttccccaagactgaagatccccagtaatatttcagctttgctttcactcagtgttccctgactcagagatctcaaaccctaagggagaggcagagtgtccttcagtcttgacgcctgggagctgtggatgcctcattgttgctcgtcttgcgacataaaataacagcatgctagtggccaaaaggcatgaagtgttcaaacttattcaaagttcaaagtgttcaaaccttttatgtacatgattctttaaaacgagggaaaagggaattgctctgttctcaatcgactgtgtctgagttcttaggatttatattagatccacactcccccccaaattttgaagatggaatgaatgtgttttctcctatatttaccactcaagttttttctttcctacatgctgactgtttgtgttatggtcattagattctagtactgaaggggttttggtttttgcctttgttctctgtgtgagctatgcagtggcttttgtgctgaaggagggagctcccgtctcatcagtttcagaacttgagtgatggattcgtcgtggctgctgatggtaacggtgggcactggccagcctgttgctcatgcagcgtgggaggtgagcgggcacagtgcccgtggagaggtggtgctgcctgatgagcttagggaaacccggtaaacaccgatgtgctctcccagatgcaaactgagtcacatccctgtcaggaaactgcaaataaatcgtgtgcaaaacggaacaaggatcctattaattaatttgggataactttattttattttttattttttttagagacagggtctctctccattgcccaggctggagtgccgtggtgtgattatggctcactgcagccttgactgcctggattcaagggaccctcccacctcagcctcttgagtagctgggagtacagatatacaccatcacactcagcaaatcttttcattttttttttgtagagctggggtcttgccttgttgcctgggctggtcttgaactcctggcctcccatctcagcctctcccatctcatcctcccatctcagcctctcaaagtgctgggatgacaggcatgagccactatgcctggccctgacatgagactcttaaccaggccattttacaaccaatttcatgcattctacaattaaacaagatagtaattgtgtaacagatctagacaactttttcatacagatatttattttcccaagttcaactagggctagagcggtttgtagaaatgtataggtctaaccaatgcttcagttcacatggtctcttgctgtacagcaacagccaggtgagttctaagtgtcaaagtgcccacaaaaactgcagtgtaagtgaagctaatctttggtgtctaacatatttttactgtgtattcacttcccttcatctttttgcattattttctgtctcaaagcaatctgttctacatccttccccatccaaattcccaacatatgttggggtttaggcaataatatttgaggcaatcgtagaggaatgtccaaatgtgtttgaatgaggggctgtttaacctcatgtagagctatttgaagattcagaaatgtacttctgaagcccgggtctgtctttaaaaggccagacttggtatatcagcacctattcagcacacgcacaagctgcccaacaccacactcagctgaccgtgctccccgccacctatcctctccactgatggagtttcatttttctatcaagagcatcaccattttgcttgtccagccccaaaacactgacatcatatttgactcataactcctcctactatcctcatgttggagcagatcctactgatatgaacagaagccagagaaattctaggcagaaaagggtgattccccagcaaaaccccaccctcaagctgaaaagcctgaaaccatggcccaaagtgagaacttgtatccctctttacccgctaaaatgttgcctttcctaaactacctataaccatgccccaccccatcctgtgcccataaaaaccccagacttagctggtaggtgggactacagatgaatgtcagagagaagcagcttgactttggagggacagcttgacggcgtaacttcggagaagaatccagccagagacagctggattcaaggggaagactacctacctgcccatcccctgttcagctccccttcccactgagagccactttatcggcaataaaatcccccacatttatcatccttcaatttgtttgtgcaacctcatttttcctggatgccaggcaagagctcagaagccaccagtgcaaatataaaaggctgtcacactggcctttgccctcgctggcgggggtagctgcctcatgcgaaaaggcagagggcccactaagctgttaacacttaagccgcccgtggacagcagagctagaacagcactgcaacacgccctctggggctttgggagtcacaggcacccccacctggatgctcgaacggggactgcatggagttcgctcctgccagtgccaaagcggccagcgggttccagcgctcatgcacgccagcttccactctgcttgctggtgcactccctcctgtgaggagttgagaggggcaggctgagtaaatgaggcacccccctcgcaagtgccgtgaaggggtcaggggaatatcctgcatcgctactgtctctttaaaatctctccagaacctgcacacctctcatcaccaccttctgtttaccacctaacaccttagtctagctttccagtaaccttatggtttttctcccttcctccattgacatcacctgcgttccactgttcccaaagtatccagagtgatgctcaaacatctgagagacatcaggcattctcctattcaaagccctccagtcacctcccatctcccctcctttgctggccggcagcatcctctgtgtcctgggccctcactgcacctctagctcatggctaccactcttcctctttgtcctccagcctctaatgaggctggctacctcgttaagccttggacactccaagcccacactgtcctctccctggagccccaggtctctccttgagttcttcagatttatgctccagcacctctgtatcagagacctttcctaactgccccatataaaatgcagtcctccatgtttcctttgtcttttaaaagtttttctgcagaacacttcttatcacctctcatcttacgtgtttgctttttatctctttcccaccacaaggattagctcagaagagcagagactttcatcaggagaacgtgattcagaggcaggaaatttaatcatggggtggaacctataaggacgttcagtccacgtactggcatcgtgtggctctacacagggtagttaggggaagggatgagtattacaagttgctgaaaacaatatatacttttttcctttagcaaatgcaaagaggtagtcagcttcaccacttaggcaaatgcagaaatattgctgctgtggaaaagggtgcaagagaaagtcagagtgaaacaaatcggtgctttataatttagtgagtagaatctgtaatcattactataatttaatcattactatcatttagtttcccactgtcatgatattgcagcctggtacacattaatattgccatatgttcatactgcacaccattatttgcctttgtcgttttgtgtgaaactagacaaacatcacaatctgactttggactctgaccattagcattgatttcaaacagtgctgaggcaattctgtgaaatatggaatcaccaccactacacaggatcttaaacttcaattctagaaatgggatggaacagctacccacctatccttaagtataatgaaaaaattactttcctggtgataacataaccttcattatttaagtggatatatggttgattttctatcttacatttaatttccttgggttttgttaaaattatgaatgatgaggcattgctttatcaaaataatacatttgcattttaacagattttcttccattctttctaaaggagtatctcaaataatgggaggagtcagcaggctagagtgtaggatattttgcagcagtgtcttgctttcagcttcacgtcatcccattgctccctcagccagcctctgaccctacacttggtctataccaggtttatatactgagtttcatggatacacttaggtggcattaagtagaataatggcagatgtaatgtttatataacttcacttaaatttagtttaggcttttttttttcacctcatcaacacagaaaacctataacctaaaatttgtgcagaaatgtgtttcacaacagcaattaggtatacaggtgtattaatctgttctcgcactgctaataaagacatacctgagactgggtaatttataaaggaaagaggtttaatggactcacagctccacatggctggggaggcctcaccgtcatggcagaaggcaaaggaggagcaaagtcatgtcttccatggtggcagacaagagagcatgtgcaggggaactctcctttataaaaccgtcagatctcgtagatgtattcactaccacgagaacagcttgagggaaaccacccccatgatccaattatctccacctggccccacccttgacacatggggattattacaattcaaggtgagatttgggtggggccacagagccaaaccatatcaacaggcatgctacctaaacctctcaaatcatttaaaagtttcacttatcttcagaacacatgagtctataaagaaataagcaactgtgttttgggttataagttaaaggcttgtaaatcattaaaaagaagaccactttaccatggcatttttcacgacagattttttaaaaatatcaacattttctcattaatctccatgaatttgtttgcaaagaataaatttacttaatcattagctttattctgcttttggatagcatgactaaataagttgcctaaactgaaagagtgatgttaagactaaaagtagaagttatcagtatttatgctgatgtaacaggcataaaatgggattatgccaggcaataaggcgaaaaagagatgatgtaacaaaattccttctattttgatattaatttagtctccagcaatttatagcttttctctccaagaaacaccactcctgtaccccaaggagatagtaaagttgagaaaagccctatgaaaaggccaaaggaacagacacgaaataaaaaataaaataaatatttagtttaaaaaataaaaagaaataatttaacctagaataattaagactaaagaaacatgagactgaaaatttaaaatcagaaaaaaactggtaaagttaactctatttttccctaagccctaacttaccaggattaaaagacactccattatatttcaaaattgtttttgatagaaatagattaaaaagtactttatgtagcgagtagaacatttctggaactcaacaacttgaaatacaacagaccaaaaatgtagacagaatctaaatcctttagaaatatgcaggagtgacagctccatccatgttttcctccctcgactacaagtggcttaaagacagaggtcataaaaaaagagtgaaaactactaaatgctcaatagataaataataaatcttaagtgcttaataaatgttgctggaatgtgtaacagaatattctgaaaggaaggctattcttaacagtcatgcccactgtgccatgtcctacaatgtgactgctggagagagattagaagtaacatctttttctatggcaagccacacagtcagagacctaagagaaagtagtcctcttcctcttctaataaatagaaatagacagttcctatatcatcagaggatttcatagaaaaagtatttcataacgaaggcttatgatcctgattatgggctacttttaagaactgtggcatcacctgctgctcaactcccagacagagatgggcgtggtctcccgtaacacctgctgctggggcaggctggcgaggtagtcaagagtgtagatgctggagccaagccagctttgtgaaaagcccattctaccatatccagatggatcacttcagaaagtgacttatcctctctctgaacctgcccacatttcctcctctagaaacagggataacaacggtgccaacctcctggggtggctgaaggacccagtggatgcgtatacacgaagcacttagaagtgagtctggcaggtactgccaaaaatgtgactcctgctgctattaaacaggggatgttgccttggcaccgacaggtgtgactagcggttgaaatatttcagatacggggccccttcttgccttggtccctcattcaaatgaattcacgaatcaggttttctcttgtataaatgagttttttttaagggcgtctactaaatcttggtttgaaggatgaattcttctgggctcacatttgcttctttactccacagatggtggagtaaaatctgtgttcattgcaccttccgctggtgctttaggctccaggagcagcagctccctggattgagtgggagccagttctgcctgactggtctcaccagcacaccagactgcgcaggcgggtcagaggcccacggggaggaaacatcagtggagggaggatgctgtgagcggtccacccctgcatgacagatgtccctttacagaaaagaagtgggaaacagactttggcaaagggaaacggcagagtagcaagatgattttgattactagtgacatttaattgcaattagatttttaaccacaaccaagaagatgataaagcttttccatgtattttccataaaactgtccgagcttaggacactttagtgctcattcttcctgcaacactacccaccacaggttcactgtattggaagtatactgagaagagctcgtggctggcgtgggagcgccgctgtcttcaaacctggaagtgaagtgcacccacacccagccacagcagtgattccccgggagcgaccttcagggagttgctaggagatggccgctctgtgtttcctttgattatagggcataaccctgccactgtcaaaatgccagaagaaaagggcagtgattgctggacataatttttttctgttacttcctgtgagatattgttttgcacaaagggaggagactaagggagccatggatatctctgtagcagaaacatggcaactattatctgaggaaggccgacatcctccaatagcgatcctgtgtgcaacgcgtattatttgcttcttcaaattgagtcgtatctttcagtaatttcttaagacgctagacggtattacacataggcatggggggtggcttgtggtttaaaagcagggcttacacatataggtagaagccgcatgtggtcaaaggagataaagtaccacaaactgaggagtgtagttagctgggcgccctggattgaggtaaagtagaaaaagactgtgatacttctgagcccaagacatttcactctgccacactatctcctgtatatgcagttattagatagacaattctttttccgtgacagccaatatcaggtagggcttaaaagtcacaatctgggtttacaacacaactcttctgcttattagccgcatgacctggggtgagttactttctctctctgtgccttggtttctacaactataaaaccgaaatacgttacagtaagcacttgataggatcaccgtgagaatggaatgaaatcatatatgtatggccgggcgcagtggctcacgcctgcaaccccgacactttgggaggtggaccacttgaggtcaggagttccagaacagcctggccaacatggtgcaaccccatctctactacaaatacaaaaattagctgggtgtggtggcgggcgcctataatcccagctactcgggaggctgaggcaggagaatcgcttgagcctgggagacaggcgctgtaggaagccaagatcgcgccattgcacttcagcctgggtgtcagagtgtctgtctcaaagaaaaaaaaaaagaaaatatgtaatatacttagaaaaatagctggcgcagaacaaatgattacagaaatatgagctatcattttcattattattattagcatcataaacattatttcgttgtgctctgaatgcagctgaacagtactcaagagtttcaggatcagttgtataaaattacaaaaaattagaaggtcacccatcttgagaaaagacaagtttgtataaacaggacaaactactgaaagcaggagagttcaaggaagccaagagaagctgagaaagttttcttaaatctgctgtcttgttggttgctgatcaccacctcattctccatgataggtgcacagttggcgtacaggttacctagggctggatactgattgagcatatcctgtgcacaaggacacctatgtttattccacttagaagtctgaggttgttctgaatgtcaagcaacaaaacaatgcacttctttgggagagctggggcattccagattctggtcattaactgggtgagtgtctttaggcatcattccacctttgtggacttctgctccctcgtttgcaaagtgagagagtcagacactcaggttatgttcccttaatctccacctttaaaaaaaataatgttctgatctaccttcataagagcagttgtgtgccttaattttctttgcaggtttgctctatgcagacctgtcatgtggaaactcagagttataaattagaaacaggtaaatgatttatttttgccctgcaaatgagtcacactctctacaagtggattattaaattccattaaataacaagcttgcccaataattctaaaatagaatctggttttaaaaaaaaatcggtgtacctgttctctgttgtataaagaaaggtatgtgatagcatcgttaaagtatatgttttagaaactactctggcaaataattttcttagagagaggttaccgagaaaagagaaaagaaaaatttagtttttctggcttggagaagcagcaagtaaaagtcacagctctggaaccaaagcaagaaagctccttgaagaatgaggtaatcagacttgccggtaggtactctcaaaccagcgtgaactgtacactgcaattaattattaaatgtgctcaggctaggtcaggctatactaacagaattcagacacgtttttctctccagcatttggttatcagttttgtgacatatagagtaacagttataaggatcagtttctgcaactccatccctcaacctacttttttattgtaaatagactgaatgtggggaaaaggcaaagagaaaaagtgctatgcttcaagaacatttgtcttgatattttggtggcaagcatcatcaaactaactatatttggctctgactagcttagcatgagatgttagtttttagccgcaaatgagtagcacttgacaaggtgagaaatcttccttcaattgttgaaatcatccaagacgtgtttctaatctacattttgaaaacaaaagccctagcataatgcaataggaattcttcttgcctgtataactggattctgctctagggtcttgtgggatggttattacacatggcagagaaagctacgtgtcctcttgcacccagtccctcttcttaatttataacggaagtttcagctgaacacatggctttagccaggctaagattacatttttcagtttcccttgttttatcaccaaattttgaccagtgggtgtgagaggaaatgctgtgtgcatcttccaagaggctgtggccttaaaggcaagaggtgccctctttgcttttccctttcctgctggctggaacgcagaactgatgtcaggagctggggcagccctcttgaccaccaagggaagccatgtttagcgctgagaaagacagagcaataaatggaaggagcccaggttcccagaattgtgaagcctccgtactagccttgcaccaccaatctgtacttttacatgagtgagcaatacacatcttttatgtttaacctctgttaatttgaatctctgtaacggcagctgaggttttatcgcaataaatgtattcccacagtcagaatccagacaatttcaatagttccattttatatttatgtataatcataagaagaaagtccccaattttacattaaactctgtattccttctaactgtcttgggttgagtgacacggcggctattgaacgtatttctgtggcactgtaacccagtagatcacacccatgcaattgctttctcttccttaggcccaggtcacttcacctgcacctctttaaagactgtatttcctttctgtgtccctccctccctctctccctttcttccttccttccatgtatctaagagattggcctgggcctccggtacccaggtgctctgccttgtgactccatcttatgtgaaaactgtgccaggtgctagaaaacagtttgcaaattatattttggtttggagaccttgaggatgcatttactgaattttttgactggtatttacatgatcatctcaaagaatgaattgcagttttttcacagtggaggtactgataattcaccccttgaaatgaggccgtgtgggatgagcaaccttgaaccaggaccttaaaagcttagattccagccacggctccgacacaaagtgacagccgcgtgaccgtaggcccatcgctctgtctccctgggcctcaatcttctcacccttgcattgggaatgatactaaagttcctcatccacctgcctcatgggattgctcagaggatagtgtgagacaatctaccacaaagtacaactgtgagccacttcctaactcctgctttcccacctattcttttttttttttttttttttttgagacagaatctcactctgtcgccctggctgtgatctggctcactgcaacctctgcctctcgggttcaagtgattctcctgcctcagcctcctgagtagttgggattataggtgcctgccaccacgcccagataatttttgtatttttagtagaaacggggttttgccatgttggccaggctggtctcaaactcctgaccttgggtgatccgcctgccttggcctcccaaagtgctaggattacaggcgtgagccagcatacccggtccccacctactctttaactatgacagatgtgaacgtttgatctctttgcagacaagatcagcacggtgactgggtctttgccctaccttcctaagcaaatgacagaactggtagcagaactggagcccctgaagcttctgcaggcaaacttcctggagcagcccaagaaagtcagagcccctccttttcgtcacattcagttggaattttggaaaccaagcataatggagaaataacttttttggtatagccggaagatgaacccttgggcacagtttcaaagtcaaatattttactgtaaagtggaagaagaaaatacccagatctttctgcatagtcaagtggcttatgttttgcacgcattggaaagaagggaaaacaaaagctgtcttagaagacgaaatcaatcacatgaggagtggcactgctccagagagctgaggtcttcctcttaggaattacagactttggttccgtataattaggccctgtgttgctcaacttccaaataatttagagagaattatcatgtgagagtgcacatatatacatttttttccaaaacaaccttctcaatatgtagcaaaatgtagtcaaggaagaaaaaaaatgagaagttctttagatttcagccaaaacaatcacttaagctccaagtcactatataaacaccattaatacctgttaaaaggtcgtgaattctgtaagagatgtttggaacaaacagtgcttcagaactacccacaaaaataaacaaaaaagagatcatattatgtcactgggtccagacaggatgatgaaacggctatgatcacgtataagctttatctatctttccagagaacagtgtcagggacatatgggttactttccaaattttgtttaaaaaatatgaaaaacatctgtgaaattctggtaagacaaaaagagtttctaattctttggatcgcaaaatgattcttcagttctaattagctatgataaattatgttaattctaaattattatcattcatgtgggcatttaatttaaaaagtggcattatttggaaaacagtctctgcaatttattctaatgtagtttaacacgaagcagctacattgcctttttggatattttcagaagtgtgaaaactgtgaatatcacttcaggctttgcagaatggtactctacaatgaatctgtgtctggcatctgattggtgataaaaaaaattattgggaatagattattagttattctgagacagaattttgagaaacttgttgaaagagtcttgtttgaagagcccataaggaacctcctccttcacacccatactctggctaagaatgttgactcttttttcttaattaaaggctgaatcactgataatattgttgatattaagtgcctactaaccagcagcatgagcttttaacacttttaatgtcacccaaaagcctacccaaagtgcccaggaaaataaacagttttctaagattcagtataattttattttgttttgtagctaaaatgcgccagagctgtattcatgtcatcacagtgggaagaaggcaaacatctgagaaattaataaatcccacagccgatctgagctgtcacccaaccccaaagggcctcagtatctgcatctgtatatggggataactcagttctccagagtttgtaacaggcctagcacagtgcctgcacatgtaagagctcagaaagttatttgtaaattagtaaattaatttataaaattgtaataaatcaataaccattaaaaaaaaataaaataaaataaatcccacagccactaaaagcatatcgtatttggggcacaactctggccatagaggcaagcacctgacataacacagatggcttcttgctggtagcatggtggcaacttcgctgaaaacacagagacaaggactgtttcactctgtctcccttaagaactttgaaaacagttttatgtctttggagaaggagcaccaatttagcttgcatcatggatcatatagaacagggtatgttttaatgtgctaaaacctaagcaatgtatttaacagagcaatctatttccatgaggttcgtgagaaaataattcagaggctctaagggaagttgggagaagaaaggacagcccgtaccagtgcactcaaatagccagaaagagcagagatgctgattgctccaagcagtagtctgagtcttattctattcatttccttagagtaatttccagtatttgttaaggcatacagaatttgggggcttgaggtagggagtgtgtcttatccatgcttggaaatgtaacagcttttgaagttttgtaatgtttcttttttaaagcaggcatctttctagttccactatctctgtggagttgaggaaagaaagtaattcatagacacagggcagcacgctgacctttcttcagtgaacgtcaaggtcctgggctcataagggaataaggaagaggaacctcagtatattaatccatgggctccagccacgtggcagctacatattttcaatcactttgcttacttcaaacttttcttggtgtgccatgtacattaagaacagataactaagaagcaacccttctcagtgtttttggcatctactgatcagcacctgacattccaagttatttcctcctctactcggcatgccgatttctgtactgttgaacagcaggaagtgctttcaagggtctaataaattagcctttcgttgtttcaacttccaagtgaagttaacaataaaagaagcttagtatgaaaaagatccagggtttcttaacctacctcttgtttcttattttctttcagtattggcttttttttgatgatgtttgggtgtttggggagtggaaacaccataaatttgatcttaagctgtgctgggacaacttttgcatgtttttattgaatacttgggatattccactgcccagagagttaaaaaaaaaaaaagacaaaaggatgagcagctagttaatagtcttcatagccaccagttatcctttaatctagtattttctagagtgctgtgatatttgcagaattaacccacaaaacagtatcctatgggccaaccggtgatgagactgagtttgcctttgagaactccggtgggtgttctaacctaactttcctacctctcttcactgtcatttatattgttgcctgaggactcttcctaatacctagccaaagtatggggggcctctgctgtctgagaggtcaacttctaacaatttagtgtgacctcaaggccaccccatgacctgactccattctcctttttcactctcgtcttcggccacctctctcaatttgccagactatctgctctccctggaatccaccatggacgctcatgctgtttcccgaatctggatgtagaatttccctgacctttttatttacaaaattctacccatctttcaagattttccttttcctgagttgattattctttgtttctgtgttctcaaaacactttccttgagcaatgctaaatactagtttccttcacgtctgtttctctcaccgcagcatctgtgagattaaggatagtgtctttttcaccatttatctctcactgctcctagttcagcaccttgcatatctttcatgctcagtgtacttaaaaacaaaagaatcatacataagacggtgttgccagtttatcatttaatgaagaggcttttttcttttatcaattatggtaaatctttgactagttcaaaaagggatttaggcagatctatttttgagcatttctcctgttaatatttatattgaacttcagccttttggggtcaacagctagaaaccatcacagcctgctataatccattagttacaaaaggatggaaattatcctgcaaaaagcgccaggctgcagaggttcttgtttggaattattacactgctgttggatattctaactacccacttgtgttcaaaggagaagcggcatttgagaaagcttctaaatgtgggttctgccacctaccatgtagaactctatgccagtgggtcaaacatacttgccgtctaatttagcatcccaatatagattctagcagagcttctttgacatagctaatctctctgagtttcaatttcctcacctataaacttgggagtaacgactttgtgtggcaagaaccccaagtaattaatcaaaattctaactttgtgcttggacatagggattgatcataaatgtgggctattattgtcttgatctttgtttttgctgttgttcatatagtacttattaatatggcttctaatttcaggtttgtcatttctgtcgttttaattttattttatcaaataaattatcataataatcttttcattggctctcctgtccctagttctccccctaatattgatctctctccttttaattccaagctgcaattgcaaggctaatattttgaaaggaacactgacttcacattatctattaataaattctaaaccaagcccaacacaacatgatcctaacctaattttcaagaatttattttccttctcagtttttttttgttttttagtcaaactgaactttttgttgctcctttttttgtacatttcatgttttagccttcatttgagtttaattagcacattttaaccagatgcctacattgtgtcagatattttctgggtagtaggagtgtcaggataatccaaaagaatccctgccttccaggagcccatgactggtgtggcgaggcaggtgtgattttgattcatcttttgtgagatgttttattcgttgagattacctctaattactcttaaaattacacacagttttagaagtccatctcaaaatagtcccctatgaaaaccacataaatccctctcactcatttaaactaatatagttccttttctgtgccacttcatcttgtcttactttatgttatttatgttggtgttttcttgagggcagggatcatgctttattcacatctgtgtctttcatcgtaccttatgtataacaggcttgcaataaatatgggttaaatatcaaaggaatgtaatagtacaatttgactttaaatagaataataaccaaagttttcagggaccatttttcaaaagacccattcccccaagatacttaacctacaatgcttactttgtataagctctgttacttaagctaacaaacaatagttctggaaacctcatatacagaaacataaggatatttagatgtataatatattatatatataatatattttgttacaccactagacttggcttgaatgaaccagaatattgcttgcttatttccttgatgttcttttcttacacggtttgttctacaaatgtataaatattaatatattagaaagttatagaaacagatgaaggaaaaatagacacaaatatagtatggaagcctggacataaaccagggatttcagaaatagaagctatggagatgcatccgggaggagggtctgttttagcacatttgggcatgcatctttaaataggagacacatttctggaaggaacatagggtcctgtgggtaaagtattgggttgccttgttttatatttacttgaggctattacagagaatcaactacagtgtaaagggagagcaaaaccaagcgagtttggatttagggacattaagtacgctttgaacagatcagaagccctggacagacgccaccacaaaagcagcagcatctggaagtacacgtgctcatctctttgtattgcttggtgtgatttccatggctactaaacgagtcattcacttcaacctacattgatgtgatcaaaatagtttcatcagagcaaattctcatcccctctgaagagtggacagattcttaaggattgtccacgtttgtattaacgaccctattgcttatgccgtcacaattacagctaaccagataggtgcagtcaatggattttgtcaatgatttaccttcaaagtaacaatactcacatacaagtagaagttaaaaggatttcaataaatttggtaattgactttttaactatacgtttgtgtcaggcatttatacttagcaaatcttatttatttcaatgtatttgattgttctgaaatcagtgacaggttaataactttgttatcagattactaaattaagcttttatcagatcatgtttacattaaaaaagaaaagcctgaagacattattaacttcatttcaacaagcttctgtaaataaataggctttcattaggaaaccagccctatttatcaaggttattaaaccattttgtaacaaaaagcatgatttacaaaaatgtcccatgattaggcttattttattttgatacgaccaggtttgctacacattttaacataaatcaagataaacagcttgttcagaaaaaataaagcttcagaaaaatgcaccttaatcactgttttgagttactgattaatgtttgtccctgaatctgctccagacagattttatgttttctttgatgactttcactggaatatggttggcttttatgattaaacccatccttatggtataatccttgactaggagttagacattgaaaaacacttaaaactatacatggtcaatttcttataattgatttttttcagtaaactcatggagaataacttttgtggtgattattagaatgttcaaaaacatatttctattgtgaaaacccagtgcttgctttctgagtctgcgggtctatccagcctgcccaagaactcgattcagctaaggttctcccttccattatggagcctggaaggttttatgcaaaaccagtgactgtgctccccgagaaagtccactgagtagcgtgctggacagaacctgaccaggactccatgctttcaagctctggttctaccgtctgttacttaggcaaatgttttcacctgactgtagggttgattaaggcttttggcttgccccaaaaacccctgtatttctggatgggaatcagttggaagtattttgctagggtcctgtctttgccattccatctagctctagtaatcttgatggctcttatctcttatgctctggatgaaaactggtaatacttctttctccatttgttttgtgtaagcatggtggtcggtaagatgatttctggtgaagcagcaaaaccacaggctcttgtttctaaatctggttaactgaatgccttctgtgttcacctgtcatcacaaaaggatgcgcaggagcactcattattttaatcggagtcgttcctaattctaaagttaatcatggcgattctcagatcagggagaaaattaattaagatgcaatgctattttcttctctcccagggtgacatctcccaggtttctcattaaatcgcccatttagtgtttggtttcagtgctttggagccaggcagaccagatgcaaaccccagctgcatgtgccatttgctccctgaggggcagagatgatggccttgctgccagtggcatctccagccctggaactgtgctgggtgcacacgaggagccaaatgcatgttttctgaggggagtaagtggaagaatgaatgaagtcagcccttccatctcttcttccttagctgtcaaataggatgacaaaatacctatttgccagtggttgttgtgaggattaaatcatagatgtaatgcatttagcacagtgaatgggcacatgagaagaattctataaatggcggttgttcatcttcctacaggaagggcagatctctgagtcatagaaattgcttcttatttcccactttcctttatttccttatgtggtgaagtataagttccactggtattcaacaagtaaaactcttgttcagggtaatgtgctactaacttttaagtctgcatattttaaaatgagagaaaatctagttttttcattaactttctactcatctctttctgggcccgctcagcaaatccccggtttcagaggactgccctgtaaggaactatagacagggtttccatccgtatttccattttctgaataagtaacaaggggaactagactctcagggcctcctctgcctgcttcgtccttatggagctgatgtggggagaacactcctcactgtccagtctagtgatgaccacagttctgtagccacgtggatctgtgtactcgaggtcagttagttccagaaaatcatccagtctaacatttgctcagattccctaatttctactctgtgaaagacaaggaatagtacagctcttcagtttcctgggggagtgcttcattacttttcctctttttctttctacttagtctaatgactcagattccagatggttctgcctaagtttagaattatcatgatctactttgtagagagaaaagaaaacatttcttgtacagtacaacttatgtaattttttttcagggaagtgagaaaaatataacacgcagtgtagaagaacttttggctctaacattagatatcaatgtttcgtattctgtcattggggtgtattgtaatttacttatttactgtctaattccttctgtagctagtgaagtttacattttcttttttctttttttttgagatggagtcttgctctatcgcccagactggagtgcagtagagccatctcggctcactgcaagctccgcctcccgggttcacgccattctcctgcctcagcctcccgagtagctgggactacaggtgcctgccacggcacctggctaattttttgtatttttagtagagacggggtttcactgtgttagccaggatggtctcgatctgtgaagtttacattttcaaagaatgttttaatgatatggaaaaatattctccaaacaatgatgtgcaagtacaaggtacaaaccaggaaagtgtaattctaattttttttttttaaaggtcaatatactttcttttttttttttttttttggaaaagaaatattcctaataattcatttaatcatctggagagtgggttgaagttttgtaaaatttaatttcttcattatagactgtattattttaataaaagcttttctttggtgtcacccattgtgtgcagcactgagctggggccctggagctctcactattgtccatctggccgcaccactgtcagcactgctttcaatgaactgtaacagaatactgatgactcagcatttctgctgctgacaggaagtccttgagcgagtctctttgtagttcctccaagaaaggatgctcaggcactccttgggtgaacagctgcaggccatggagaggacaaccgggttgcagtagtaagtttgcactgggctatcccagagctagaacaagggaacaggtcagcccctagagtcccagaggtcacagacttgggcaggtccaggcgttaaatgcagctgtgcctttggagctggacatccaggtacctggctgcctgctgggaacaggtgagtatgtatcagccattgtgaagcctcaaaaggctgcagcctgacgtagctgcagatcaggctgtacccaaattgcattgttactgatgaaataattttttaaaaaaccaatggtatctatttgagcattttcctcatggacaccattcaacagaatgctgttctcggggaacaaatgactcatgcaaatgactattttctaggtttttctcatggtcaagcagccatgatctttttatagctttattttattttaactcagtcccaatggttaatttaaatcctttctttctttcatcaatgatacaaagagctcactttactacagtctcatcttgacagagtcaaatgcagaggctgtaaggctgcccacctgaggaggaggaactggaacttaggaaaacagctcagatgcttcatgcaaatgaggaagctcaattggcttctattgaaaatacctcacgcatcattttctcttgtctctacttgccaaaatatttataaaatatctttgccctgccatacctaactaagcctcttggaatttattttttcagtgagattctctgatgcaataaccaagcactggcttttagaaagtgttctctccccctccctccctccctgcctgtctctctccctccctccctgcctgtctctctccctccctccctgcctatctctctccccctccctctctccctgcctctctccctccctccctgcctatctctctccttccctctctccctccctccctgcctatctctctctctccctccctgcctatctctctccctccctgcctatctctctccctccctatctctctccctccctccctgcctctctccctccctccctgcctgtctctctccctccctccctgcctgtctctctccctccctccctatctctctccctccctccccgcctgtctctctctcttcctccctgcctatctctttccctccctccctgcctgtctctctctttctctctctctctctctctctctctctctctctctatatatatatatatatatatatatatatatatatatatatatgtctgtttctctgtctcactctagatatacaatcaaatcagtgtgcagatggaggacaaagagtatcacaaaattattattgtaacttgtggataataaatttcaaaatctgatgtctgtgctccaatatctgacctccttttttgcaaaatatgcacatgtgaaacctgatttactactgaggaagttaaccctttccttttgaaagtaatgcatcagtagaagatggaaagttcagtggagatgggtgatcttctcaattatgtgcatgagaataagtaaactcccaggcattccgtcactctccaaagtcagaacaatcaagaggacacatcaggctttagaaaaactcattcccttggaagataatctcaatagcatgtgtgaataggaagagcatcaaagtgtgaccgagagagtgtcagagaagagtcacctattacaagcatgatcatagtacttaggaaaaagtaagttccaggcttatgtggatattcatatagatattttccagggttttagaggttcatgatttctcagggagaccaaagtgcctatgtgactgtgaggggttattagtcctctgggttctggctttactcagaaatagcctggaccacatgggtcagtcctgccccacagacattaggccccctcctggggcccctgcagagtgggtcagttctgcagatgtgggaagggatgagtgttgggtttgggaaccaaaggctgtgtgttgagcttacagtagacaatttggagctgcttcttgcttagagatgacccaatatccaaaagtagctattgcgggcaagtggtgttccccaaaaaggtatgttgaagtccttcctcacccccagtacctgtgagagcgatcttatttggaaacaggatctttacagatgtaatccagttaattgaggtcatactggagaaaagtgagccctaaatccaatgactggtattcttacatggagagagagatttggagacagatccatagaaagaacattgcgagacaatgcaggcagagatgggtgatgctgccataagccaaggactgccagcaaccaccagaagtgggaagaagtgaggaaggattcgctgctggagccttcacaggcaacccggccctgctgacaccttgatctcagacttctacacccccacgtagagtgtgagacaatagatttctgttgtttcaagccacccaattggttgcactttgttgcagcgctctagaaactgatacagtggctcaaacagagcctctaggtgtctcttcttttgcaatccaaagactgcaccagtgctacttgaaggggtaagagagctaaataaatttgcttttggggagatagatttgggtaagtttctccatgctgagttagatgagtgatatgtggtggtggtaaaatccagataacccttgagtgtgatgatttcagaaagagagagccaggaggcctgggagccagcaggccagcgggggtccgcccactggccccgaaacagcgaacagtgacattggagcaagggcccatcccgtgcttctctggagccccactgggcagagccaggtggagaagcaggaaactgcacattggtgggctggaggggcttggaggggctgagacaaggtgtgtgcttggggataagggcgttcctggtccccggtgaagcatcagtgaccaagaggcatcctctagaagaggtagacactacatgggaagggagaagcagcatgaaggaaggcgctttaggacaaggggatcagttacagtttcttcgccatgtgccttagacctacagcttgctattccactctgaaataaggcagagtgaagaattcaaaaacaatcactctgggagaaaaaagcgagttctcttgatatccttgctttctcctggcctcatttcctctgatgttcccctgccctcttgcaaatcaatcagcctaaatcaagggtgtctgtgcaggttctcaagacagacatgctgctgggagtggcacgtacgtgaacgtcaaggagatgtcagggcatgcgcatattctttggtgcccaccgtcttattttcttaacttactgggaaatctttttgttagagtgcacgcattaagtttcttcctggcctcatcagccccaaacccaggcagtggcgggcggtttcccgtgaggacagcgtaccttctgaagaaatgcacccagatcagaatggtatacgagtctgtcctattctcgctctagaaaagaaatgtcacaataaataggtgggtggggtctgccccacactccccaaaacaaccaaaacagcggcgagatcaaactgaggacaacgttatcatcatatattcttttctttacacagtttgatacctacctacttctcagaacaaacaccgcggaaaggaaactgggtggatacttactgtttttagtttgttacatactacaattagtcaccattagctaattatatagaaaaggggaaattggggctgttttacccagagttggttttaggtgggggtgaagcaggcagggtgatattggcagcctcatggttggttttgctgattcagttcctctttccttgccccctatttcatacaaaattcctctgacaaagcttcctgtgtggccactggtcagcattttaatagaatggaagggtgcagcacagcaaaggccatagtgttaatatccctcgcatctgccgttcccacctcctccttgcttttccagtcctttccaactctgcataggatgatggggagaggagggagctaggaagggtgagaggcaagcaaagtcatttccagcattttaaagtcagctctcccaaaatgctctctctctccatagccttctccctactggggcttcaaagccttccctctacctgaaaccactcagggtgcaaggaagcctcttcaggtccccctcatccttgatcattacaccagctcttgaggatcctttctttctctaaatttggcaacaatcttctgttgcagactcttttcactattggaattccctttcagggactgctctctacaacttatatggctgcagcagcagcttatctgaccatttaaggctctacactgtgcagacagaaaaggatcacactcctctctcagacacattataagaaattttatacaaggcctgtgcattttcaaaacacaggattgacctaatgagcaggaatttgagaccaggtaggaaaagagggtcatgggatgtggggagctgcctgggggctggtgggaacttgccaggggtcctcatatcccttcatgagacagttgcctaatcagcctatttcaagggatggccctgatttcacggtgaaaagcaaggcatgtttctgcagatacgtcagtgctctaacagcaacatgtcctctgctaggaggacatcctaggagattcgcttccattgaatcagagtaaactatttttttttttttttgcttcttggcagaatattatttgcagatatctgcaaatttggtaggaaagcttttttttctaaatggaactatcctgaaaacaaagggaaaaaagggcaaacacacacacactcacacacacaaacaaacacacacactcacatgcgagccttcccccaaatccttccaagtcttcattctatttaagctgttcataaataatatctgatgataatctcattgaaaatgcatctgtttttatgttaatttttgttaatttgacatccctagacgatatcatgaaaatatttactgtgtgtacgtttgtgtgtgtgtatgtgtgtgtgtgggtgcaattttgtccccttagtccatgatgaattaaaataagtagtttacctatagataactaaaattctatacatgtcttcatgaagtttaccttatttaaccgttgcaattaacacatatcccagaaaaatctttaaattttatttttaatattatcctaatgttgctgagttcccagcaacacaattatttattgcagccaacatctaccatgcttactattacagcaagctcttttccaagttcttatatcaataacacacaaggcagggcctgtgatatttcccatttgtggatggagaagcagagccgtggacaggtgccaagtcacccaggtctcaggggtggggtggggtctccccacagacagcctggctcagacacactctccactgccgcagcgcgagggacccttgtcatcatcccacagagtttgccttgtcattgcttctgaagtgcttagagactgtcaatgaaggagcaatctcaataaactttgtggttttgtcatcctcagaaatgaccaatcttcatgaaggtggtgttgtgcaagcctgggcttctattaaaataaaaaagtgtgctttgcacctaaggcaatggtgggattaaagcaagtagcaaattgatgttctcatttaaaagtcttgcctggtctgtgagtgccctgggcctgcaaaggtaaaagaagcctgaccacaaagcaactgggcattctggaggttactgggcagacctgagactccagagaaagtaggaagagaaggcagattgtcagttaatgatggcggtgttcgtttctgtttgtatacttttaacagtctaaaaatggggcttcggacacaatacctttcctaaatgaaaccagtgcctgcttcgttacaggcacaaggtatgtactgtgggtgacatccagcccccttcagttttccagagtctttcctggggtcttgcttggctcagggccactggaacacaacccacccgatgacaccagggtgtgtcgagcctgtggtcaaggttcacacgtctgtgtgtgccacaaccactgcagaggggaaagacatcatccacacaacatcccaccctcagcagggacttggaaaatcaggaacccgatagtccatagttggggagactgaaaggttccccaaacaagcaaggctgctccattttacctaacaataccatacctactggcacggtttctccctgtgccccattgctaacatttctccttcgagttggcatgccaaggaaagcacagtgaaaaatgtctgagttccgggttgctcttagcaacatccatgaatctgagtttctaacctccttccctatagaacagtgcctgaaggaagaactggcaatgctcactggtgtcagaattgcccacgatttttcccttttcagcaattatttaagtgctccaaaagcattgcttccttactgttttcaaggcaagatagaaggagaggttaatcttgcttagaatttcctctgctttcaagttccaggttgggggtataaagaggtttgatagaaaagaaccgcagcagcccaggcctggctgcaggagaaagcaaagtggctggggacagggggtgtggagagcaggtggtctcccgtctcctccatcagggtcaggaatgtgtctgctcctttactggaaccatcgccctccctggatggctgtaccgtttagggaggcctgtgctgacaatacaggtgcaattcaaaagaaattccattaaaataaagtgggcagtggggagaaacggggaattctgtcatgaaacataaaacctaaaatactgtctggtcaaaacctagacagcctgtgagacccatgagagctcggagaccctgctttcggagcataggtggggacccgaggggtggggccgtgagcagggtctcaggccagccgtggagaaggcggctgcctctgcggggatgggcaccgcagcgtggtgggcagatatgaggaaggcaaggactttcccattgaccatgcaaaaccttcacgaagtcagggtctgtccaccgtctaaagatcgagacctcatgttgagttctgaggtaaaatgggaaaacagttttaacagtgcagtgaagcttcctgccaataagcaaacctttccaccctccgctcagctacagaaacacatttgggagctccagggaggaggcggaggggcacaggcgctccccagtgtgggccacgctcaggtgtcccttcacaatggcagccacactgcttcgtgaaacggacacactacgggatggaaaacagtgagagggaagccacggcatcaagaagcaataatcacagaatgtttttgtgctgtccacgccttcctcaacatctgcctccacttccaagtcaatcgagacagcctgtttatgtggagctttgagatgacacatacactttactgaccctagaacaataccctttccacatctaaagcaattttcgtgtaaatgactgtgccattaaccttccagggtcattcaaatattttctgagaaattggctgctttcgggattttcttagaatgccatgtgtttcatttttgtgcagaacagatgacaggcgaggcattccaacaggacttcagttgatttaactaattcctgtcaggggaagtgaagtgttgggattcataaagccgatcccagcccggagattttccttttcccaaaacagaaaaaacaagacatgctgtgtggttttgcaaccgggcaagtttcgaaatatttttaagctttctactttgccaagtatttcataaaaaaactattttctttttgtttcgtgccaaaaaatgtcacccctaaatattttttcccatatctggtcacatgtccaggattttttcttttctaagaataaataatttttctgggttataaaaattccacttgctctatcagattaaacatatctttatatagaaaaagcatccgaaacattccccaagtgggtctaagggaggagtcttaatacaattttgttaaattaattttgattaaatattaggccttgaattctttttgtgactctcacaaagttcaggcttattttgttacactttcaagtctccctttttttcactctccacatactgtttccttttattagaaagcattcaagaagaattgattggtgtgtttgaccaaaataatatgttggaagtgataccagtgcaaggggaccctctgggttccattctctatttgcatagttagctggagttagaaggttcagctgtcagggattcaagaactctagcatcaaaaaagtgtgaacttgcaaatgagctgtcaaggttcatagcaagtgaataatgcagctgagagctgacttgtctccaccctggtgttctattgatcttgctgctggataaagcataggcacataggaacactgaaaaatagcaatttgtatgggttggactggtattttcttttttaccagttaaaatgttaattacattcacaaagtcaaaaagctgaataaatagtcttacagttggaaatatagggcaaaacaaaacacaggcttgaaaaagcaataatagctatacacctaaaatgtgaaaaatattcatagagaaatgaattgtagggcattaactcttgcaaaaccaccaaaggcctggtggaattaatatgctacagatttgaaacttaacattgggcaacttaaaatgcatgtatttgttattgatatttaactaatccttgtaagtaaatctactataagcgaaaagcattctaaattgatgttattgctagtttgcagggaaattctgaaagtctatgtgtttgttggtgcatgaggggatgtgcgtattgaggtgtgtgttcaggatgagggcttctggtcctttagaaatggttccctctaagcttcttggtttccaaatcttcatcactctttttaaaatctaaaaatgcaggtttactttatatggagagcacattgctatgaggagatgtgacatttcagaaagagcacatggcactgattctgaaatgctaccaagttgcttcagaatatacccaaattctctcaaagattaatgatacactaagaaactgaaggacacagcaaattattttgcttgtcttcaacccactgtcaccctgccacaaattgaacctaataaaatttccatccctctcccatcttatgatatgacccttccccctcatgcatggggaaattgttatttacattgtgaaaatatcaagcatctccaaacacttacgttttgtggagccgggtctcccatggtaaaatgagagcccaacacggtgagtttgcttcctaggaatggcaaatcagcatcgcgatgccctcaaaccagaaataatacccttcatttgctgcaactggttgagtatcagtgctataaaaaatagatgatggaaaaccggagcccttgacagaaatacaagtctgctgtgtgtggcttgtgcaggaatggagcagagagaagcggtggtcttgtctacacatcatacttgggcttcgcccatgctgacaagtggaagcacatgcacagtggacacacgctgtcaggacattcatccctgctggcacgtaaacggcagggagctaaactgctagaattcaagtggcacagaaacttgagcctatggaatatcactgtggagtgggcaggccaagttctttacagtgctctttgcttttgcaaagaggtaatttccaactcaagaatgctctgtggctttggcgtcaagaaagctgaaagtcagtgaaatagagccttgaaggtcatccaatctgcgctgcagcaggaagtgaattttgggagccccaaatgcaaaataggcagctcagcccaacattaactcagcccaacactaactcagcccaacattaactcagcccaatattaactcagcccaacactaactcagcccaacactaactcagcccaacattaactcagcccaacattaactcagcccaacactaactcagcccagcaccagctcagcccaacgctaactcagcccagcaccaactcagcccagcaccaactcagcccagcactaactcaacccagcactaactcagcccagcaccaactcagatcagcaccaactcgaaccagcactaactcggaccagcactaactcggaccagcactaactcaaaccagcaccaactcaaaccagcacaaactcagcccagcaccaactcagatcagcacgaactcaaaccagcactaactcggaccagcaccaactcaaaccagcaccaactcaaaccagcaccaactcagcctagcatgcactgattctctggcatagactcagactccaaaaatatgtcgagaaagtctaaccaaaatttgcaaaattaggacctgtggtcagtaccttgactaaatatgactctgtctatgaacacaagtaggcataatgtaacataagacagtaaagaggggcatcgttagaaacctttagcattatgtcagaaagggcaagaggactcaagtagaagaaaggcagagagaataacagagggacatgcatgaaaagtacttttttcttcttcagtcctgcaattgcattaggaacagaggtcaggcccaagagctgccctctcctcacttttctttctttcttttcttttttttttgtttttttttttttttttgagggggagtctcgctctgtcgcccaggctgaagtgcagtggcatgatctcggctcactgcaacctccacctcccaggttcaagagattctcctgcctcagtcaccggagctaatttttgtatttttagtacagatggagtttcaccatgttgaccaggctggtctcaaactcttgacctcaaatgcccgccttggcctcccaaagtgctgggattacaggcgtgagccaccgcacccggcctgtcctcactttttatcacatactcctgctcttgtggccctgcttgaacacagcaacagggtctacataaaataaattaaaatacatttaaaaaaaaattacctgctttacttctggtccatagcattggacatacccagccagaaatcatacactgggctggtttttgggagccaactcaaatgcttgtcctttgaggtaagtattagggtgctcgtggcctcccgccccacgggtccttcactcactgaccctgacctgtgctcactttgtctcaccacctacatttcccaacagttcatgtttgatacagctgctggtcctgccaaggctggaggccctccccatccgctgatttgcctttctctgaaatcggcatcttggctcctctgcattatttctgattggacttgtctctctggcttgttttctctgctaattctgatgaagacgataatctctagctctcaggggccagccctggctacacagtttgggggtagtgttcaaacaacccttgagaatcttatttttcaaggctgttggctggcactttagggctaaagcaagtggtgaattaaaacacaaaacaaaacaaagcaaaaaccacaggcctaaataaacatatgcacccaggagcatgactgtgcagacagactgcctggctttgaatctcattgccaccattgattggccacttaaccttgcatatcacaagatgggaataataaggcacctgcttcatagattgttcttttagtcttctatccgtttgttcattccttcagtaaatatccatcgagcacctactactgcccagacatacggatccagaaatgtccagcacagattaagaggccacagcctcgtggattttccattccagggcatttttcttcaaggatccaataagatatccccctaaactatacatcatagagcctttgacacagtaaacactcacatgccattagctgttatcacggtaacaataaaaataaacttttagcaaaggttttaactaaatgaggtgagaatcataaataaagatatatttgctatagtgaaaaggagagaaaatgtaggaaagtcaggcaagaggaatatttgccaaaatcattcatgaatctgacacattagattctgggcgtgtcctaagccttgacctgtgctacttgatgtgggatttgcacacctgggacacacgagcttctgaagttcagactgtctgcactctatctgacacactccacagctgcacaacttgcagcatgagtcagcaccatcctaacctctaaagagccccgcgggcacagcgaatgcacctcccagccctttggacgtggtggcgaccagctggtttcctggagaggcatctcctttacacccatctgtgaaagaaatctagatctaagccttagatctcaaggttagaaagggggtaaggttgaggttccggagtgctactctattagacacattgtcctttttaaattatatttttacaataatttccatttattattttttcgtggcatcctagtgaggcaggctagtttgacaacatgctgcttaggggaaatttgctgttaataagtcttttgagctcactaaattttggtgcagcatgaaaacccagactgttttcaactctctctctggcatacccgcttgattcctgatagggctattaattttgcgcagatttcccaatttgctccccatttgctacctgggatggtgaagaacagacaaatagcccttcggaagcaaaagcagtcccaaaccaggctgagtttcgtgatggcttcttccacattgtccttcattgctgaggatgaaaacatagagctaaaaactgtgatacacaatgatttatcacctcctttccatgtacacacctagtagtttagaactctgttagcttcaaaatctattcagtcacattgcattcccctccccaactcccacaaattctacatgaaagagggttcaggtagcaaatgagtggaaggacagggcaaactaagactctgatggtgagcccctcctcctcctgattcagatgatttcttcctcctcttcctcctcctcctcctcttctggttctttcttctccttcttcttcttattcctcttcctcctccttcttcctcttcttctatcttctttcctcctcctcctccttctattttctttcctcctcctcctcctctttctcctcctccttcttcttctccttctccttcttctattttctttcctcctcctcctctttctcctcctccttcttctccttctccttcttcttcctcccctcctcctcctcctgtccccctcacctttcccctttccctcctctcccatttccactttcttccccttcttcctccttctcccccttcctttcctcctcctcttccacttccccctttctcttctccccctcctcctccttttcctcttcttcctcctccttcccttctctctttttttgttatttgatctccaattttcacttcctaaaatttcatatggttggatgctattataattattcaattacacaatgattacatgtgggctggtggttttgaaacaatgtaccccattgtatgcattattgcattcatgtggaacttgaactgtaggaggtccatgcaggcttttccagggtccccaagagtactttgtgggttttggatccaggtttctgtttcactaaatcagcatattactctagtctacagtgtactgttgggctagaaatagtccattgactattttagactctgcatcacgaaacgagatctatggttttggttgaatttcatagaagaatattgataaattatcattgttcagatcattaatcttctttagctcaaatcaaacaatgaagtgatgttatcttgcaaaccatgcaggcaggtggtggcactaatgagcctgccacatcggattaatctttgaatgttcagaatctcagaatgagaactttccacaaattcaaaactgtttgatgaactgacaatgtccaagtccaccaaatggtccaacattcagagatgaaattatgtcatgacataagaagcctaatggaatgaatggccactatgcattaaagaccagaatgtgaaaacctggctcctaccattcagacttccctgaaattgtgaaacatgattttccccttcaccctagggaagaccctctggcaaaggcacattcactaagggtgagccttcttttggattgggggctcagaagagagagtcatattgaagtcgcccaaactgttctttgccctggctgcccgctgactttgttaggcagctggtgctaaggagagggtaaagaaaacagaagacacttgtgggccggctcagggatggacagtacctggccgctctccctgtgtgatgcaggtggcttgttctgaggtaggtgggcatacaggcagtgagtacatctccattgcagcgggggaaggtggatgtgggactaatcagggatggagagggagggatgctgcaaagatgcccgagcaggtgctgtcagtggggactagggaagcagtgtctctatccgagagtgcatgccggtggtaggggagcaccaacctgaacatggccagtaagaacacaaactagacctcccagattctcccgcaagtaaggagagatcagggactgttccaatttttggcgttcatattttttagacagttgtcttaaaaaaaatgcctgcttcacttgcgttaagaattaactaatcatggtccagacttatgctcaggtagacaaggaggactgaagccacagtgggctccttccaacctcacatcacatcttcctcatagcacctgtgcacccgaggtgcagatcctgatttgatggcgacctattacaaatttccttagactgcaagcaatcacactatacttaatagctatatttagtagaatacttagattaatacttggagagaatttaaatttaaatattatttccacagccaaaagacaaaacagcaatagacaaatgcattctctttttagttttcttcaacggatatatttcatttttaagcctatctaccccctcccccgatttgaagacatccctcgggctacgtggggaggaaagcctgtgtgactgatcgctgcagtgactgctcttggccatgactgttactgccattttggcctctctgaaaagtgaggcagcctaagcctcacagatatgtttcctggtcacatttttgttgtctctacagaaagagaagcaaacgatatcaccaaagtcctaactctatcctcccactctgtgaactacagaaaaggaagcagcagaagaaataatagagggaataacaaagtgacagaagcatagagggaaaagcagcaggtggcttttcatcaaggggcctttgggtaagatttacaggagacaatgttttctctgcgcctctgggacttgaaaggtcatggaaagaggactcactcgcgacagaattcaaacactcgtagttgtgtctcaaagtcctccgcggacatcaccagaaggcatggtttcaggggtgtttttcagaagggcgatggatttctttggatccacgtagtctctcttatctggttagagtttcttctttttctttttgttcttttttgacacagagtctcactctgtcgcccaggctgcagggcagtggcaccatcttggctcgctgcaacctccgcgtcctgggttcaagcaattctcctgcctcagcctcccgagtagctgggactagaggtgtgcaccaccatgcctggctaatttttgtatttttagtagagacagagtttcaccatgttggccaggctggttctcgaacttctgacctcaagtggtcctcctgcctcggcttcccagagtgctgggattacaggtgtgggccaccgcgcccggccttatctggttagagtttcttaggtgggaatggagttagcagtcccagaccaggccaagttaggacaagctgagaaatgcatcctgtggttgacacatggtgaggaatacccaagcaaaatactcttgtgtgaggcttagactctgtaagaatctaccactttatgaagagactttcttctcccatctaccagattttccaccaaatttgttgcagccttgttatgggctgaattgtgccctcttaaattcatgtatcgaaggactggccccctaggacctcagaatgtgcctgtgccctgtatttgaagacagggactttaaagaggggaaaagttaaactgaagtcattagggtgggccttaatccaatctagctggtgtccttaagaagagtgccgggcgcagtggctcacgcctatgatgccactgcactccagcctgggcaacagtgtgagacttgtctcgaaacaaaaaaggaggaaatttggacacacaaaaaagacaccagacaccagggatgcattcatagaggaaaggccatatgagatcacagcaagaaggtggccgtcggcaagacaaggaggaaggcttcagaagaaaccagacctgctctcaccttgatcttggacctcgagcctggagaactttgagaaataaatttctgccatcaaagccaccagtctgtggtactttgttatggaagcccaagcagactaatacaacctgcaggctttaaacgatgaacaagggatgtgactttattgtaggaccagtaatttgaatttcttgcaaacgcttgagtgtaagcattagtcaatagtcagtgatctgactggaaagaagcagagggcacaagttcatggcagtgtgctcaggggtacctggcccctctgtgaagagccccatagaagacaaggcacttgggccctgtctcaggggcagcacaagcttccaggacaccaccgtcactggtcacttgctgctccccactgtggccctggacagatgagtcaggcccatggtggtcagggcagtggtttctcctcgtcctcccccagcctgcactactccgtgcctggagctgtgaaaaattggcctttgctcgggcgcggtggctcacacctgtaatcccagcactttgggaggtcgaagtgggcacatcaggagctcgagaccagcctggccaacatggtgaaaccccgtctctaccgaaaatacaaaaaattagccgggcacggtggagggcgccggtaatcccagctacttgggaggctgaggcaggagaatcacttgaacccaggaggcggaggttgcagtgagctgagaccgtaacactgcactctagcctgggtaacagagtgagactcagtttcaaaaaaaaaacaaggtctttgctgcttccacagatgctcacatttctccctggctcattttaagctgtgctaaaatctggtaacaaagcttgcttttatttaaggtacattttgtaagttttcgggtggcccactgtaaggtagagagccctgctcttggtgacttgctttggaactagaaaattagcatctagctgtaccatatctgggcacatgactggggcttcatcaggtagggctgggctttcatgaagtaagttgcagctcagggcctcggcgtgcgaggagtgcagttgctgtgtgtgactggctctgtcaccaggagccccgcgtattcttcagggagaattttcaatcatgctggttttgatttaggcaatatggtcttgaaaatattttcatagtctagtctccatcaatcttattcttccacactgacatctgcttccagaatttggagtaaggcgagctgggaagtagggctctgaaatcttgaaggactgcctaagcccccccaccacacagaagcaaaagcagcctccacaggatgccagcttagcaagggaggcctcacgagcaattttaaggacctcagcactgatgacgagagatggtgtgttacggattttgcatctgcagttttgccattagtggcattttaggaataaataaggttgatatgttaactacctcaaaataattttcccattcaattagattttgttagtgaactcactcatcagtttggatagttcaagtagtatactgaaaaatgatagctaaacctggcttatgattagagctggtttacattttgccttcggcaagtggaggatttccctaggctgtttctggagcctcatttattgatgagcttctgtgccctactccaagaagcacctttccacctgagaatgaggggccccatttacaatattcttggatgaggacctggggaagaatgcaggagagccccaagctaagatggtattcaaactcagagcacggcagaaagttcccaaaaagatgttagaagtatggctcggcttgctgctgttttggcttttaaaaaaagattatagcaagaaccttttagggaactccacagccaccagtagggatcggcaggcacattgccccagctaaccactggagtggtgttcagggagggtttgggatgtggatgctgctccaagccatctgggagggagacaggtgcagggacagtcagcatgaaagcaactggggactgggattgccatagctcaacagcctgatgatggcctgaggttgttgccaagagcagctcctaggaactgctccttctctgagccaccctctgggaacagcagagctgtcagagaagatttaattgttttgatcttcctgccttcttgatatcccattgagagtcacccttcagggagaaggagatagagtcgtcattttgtattaagcaatgacaagaaagaaaaaaaacttttaagatgaaatcctgatgggattgaaaatcaattaatcaatcacacagacctctgattcctggtcattctggctcagaattacagacataagtgtgtgacactgtgttaccttagggtatatggacttttagaccagtagaattttatggagagaagaaacagtaaagatacattagttcaatgtatgcattagtgtttaaggtaataattttggtgcaaaagcagaatgggccagatagactagtttgccaggagtttatggatctaatgaaatagtttcagttgctcatttagagaaaacaaatgcagaaatagagaccacagctcttaatgcaaccaaagagagaaaatgcatgctgactaaacgtccacccattaggctccttattaacagaaatgagaagttattctttggggactgttgctctcctgctgctctgtcatggggctatggcttcattttccatctataaacaccaaacactggaaggttggttgctaagagaactcactggggaaacagttaactgttcaaatgtccccacttacgtggatatgtgcaaataccaccctctgttcagatctgcatgttgcagaaagacactacgtgcagtggactaaagctggacgccggagtgtcccacagacccaggttagcacccctgccctgccactcactagacatgtaactcacagcaagttcttaagaactctttcgaaactattcctcatgggcaaaaagaaaaggatggcaaagcatgattttttaagtgttcactgtgtataccaattatgaacaaattgtaaaatcctgcttcatttcatcaccatcaaaccataggcttaaatttgctcataatcccgacaacactgtgtgtttggaaacagtggaaacaggaagaactgagagcgggtctgcattcaggatccacgtggctccaatcataggtgtgaaaagactcacatattccgtagcatcataggacccatcagagtataacagctaagattattacacatgctgttccagtgtcccactcacactgcaccacagaaagctctgcagtggatcaattgctgctgtgcagtccccaacatccgatccttgctgaagtttattgattaagctggctaatacactccttacacagttatttggtaccatattgaaaatacattaattctaaaataacaaacaaacaataactttcaacctctattgctagtttgagaataaaatgctccctttggtgcagtgagtagtgctcatgagtgacagacaatttgaataagaaaactgggctcttgatttagatttttggctgtcaattacatttggaaagttgggggtaaggtacaagctgcttaggaacccttatttcttccccctgcccttttgatatcatttctctctcttctccttgaccttaggtgggtcaaggagttggaattcaaatcacatgagcaaatagcattcaaatgtacatgatatataaggcactttagcgatccaaaaaaaatttacaatatagtttctgtctcaaaaagtttattgccttgtttggggagacaaaacataccacacgaaaagttcatgatacaggatttaaacaagggctcaacaaatcatagaggaattgttatataacatgggttcttccattaaatggtaaaggaatgctcttagctctaaatactaaaaaaaaaaaaaaaaaaagagaaagagagagaaattcaggaactgtccaggtaggattgaggtaaaggacagggacgaaatgaactttttgagaagcatgtaggtggctaagtcagtttggatgttaggaactacactgagaatcaagagatgaggaagaccaagggcaaaccgaaacgagacaggctgagacaaagcgagatgagacaaagtgagaagagatgagacaaagcaagatgacagaagtttggtgatcatcttggacattttgctaaattaggtgaaaaaggagcaagaaacaggtatccttaggcaaaggcaacctctgaccaagcttgatgagggcagatgaggactgattctagcatgagagggaggtgcaggagaggcagctgcccagtaggtcctcagaagatggtgaaggcaccactccaaagagtgtagatacatactgaccacaacagagacagaatgtgtgtgtgtgcacacgtacacatgaacgaaagaggctagggcatcagaggggagaggaaatacagggagaagggaagtcaaggaaagatgcctgacattccacaggagaagcttctgcacaggagcagtggggataacaactccaagatgcactggagaggggtttttgctagagagtcagcatcgcaaacaagcagagtacctttgcattaaggtgcgatttaaaaatatgttattatctaggatagtggtgctcaaccatggcgattttgctccccagggaacatttgacaactgggagacagttttggttgccacagctggcagtggggatgggggtgctaactgccatcgtgtgggtagaggacagagacgctgctgaacacccagcagcacgcaagaagatcccacaacctggctccagatgtcaatggcaccaaggctgagaaaccaaatttagaggatcccagggaaaacagaaaagtatcttaaaaataaacattacccagtattgtacagttgacaaatgttaacattatgcatttattaaaaacaaatgtaagcaacatttattactgtagttagaattttaaaatatgtacatatactgcagcagacttttatttatttatttatttacttatatgagacagagtctcgctctgtcgcccaggctggagtgcagtggcacgatcttggctcactgcaagctccgcctcccgggttcgcgccattctcctgcctcagcctcccgagtagcttggactacaggcgcccgccaccacacccagctaattttttgtattttttagtagatatggggtttcaccgtgttggccaggatggtctcgatctcctgaccttgtgatctgcccgcctcggcctcccaaagtgctgggattacaggcgtgagccaccgtgcccagccctgcagcagacttttaaaaagatatattcagcttcatcacccttttcttaaaaaactgaaattacttctgtcaaaatcatgccgatggaaagcaatgacatgctaagcacagtcctttacagaaataattcagatagaataagtggaaaataaccttaaagaagattgaaagaagcgacaacttaatgaaacccagctactggttccattttctatttatccttccaaattgctaatgaattctgacccatttagtcatgcaaaatatatatcctgaagaatctgtatcccttttgaggtacttaatggatgtttagccggcaaggaaatatggcatgcctattattcacaatagttgatctttaaattgacattaatatgccacacttagagtactggggaaattctagccaaatatacaaagccgctgctactaagatgaaagacattccacaaggaggaaactgatctcagaaccagtgaccacggccatgagggcttcgtggctgctacagcacgttagccataaacaatttccatctgaggaagtgcattcagtgcagctgctgatgcatagtaaatatttgatcctaattggacctaatgatgaatttcaattctgtattcaccattcttttataggacaccaacccataaacacaaaaaataaaaaaggttttggggaacatttttcatttccttaagtcatttaataatgatgaattgcctgggaggctctttgaaaagatagatgcggctagaaagttactgggagaattagaaattgcataaggattcaatgcaaaatactttgtaaaaagaaattttaacttccttgtttaacttattttaattcattgagaaattaaaggtaaaatatactttataaaaatataatctggcaaactttaatttgggtaccaatttggaattcgattaaacaggttcaagtctatttttatagattataaaaatgctcctttcagataaagtaaaaaagataattttgttttgggagttaaaagaatcaatgtctgtgcatcctttagtctcaatagaataactcttattctatcagtaggcagaaatgtttaagcagcactgtccaaaagacatacatgtaatttaaatgcttttaaatggaatagaaaagtgaaattctctggtgttttttcttgtattctttcaaaatcatagcaccaatggatgtgagtttctaacattattcacctatctttttaaaaatttacccctgaatgcttatacactgctggtggagatgtaaattaggtcaaccattgtggaaagcatttggtgatttctgatagaacttaaaacagaactatcattgacccagtaatcccattattgggtctatacctaaaggaatataaatcattttatcataaagacacatgcacgcatatattcattgcagcatcattcacaatagcaaagacatggaatcaacataaatgctcatcaatggtagacttgataaagaagatatggtatatacacaccatggaataccatgcagccataaaaaaggacaagatgatgtcctttgcagcaacatggatggagctagaggtcattttctaagcaaactaacacaggagaagaaaaccaaattctacatgttctcaagtataagtgggagctaaacattgagtacatatggacacaaagaagggaataacaaacaccacagcctacttgagggtggaaggtgggaggaggtgagggttgaaaaactacctatcaagtactatgcttattacctgggtcatgaaataatctgcacacaaaccccccataacacacagtaacccccgtaacatgctatcaatctatctatataacaaacctgcacatgtacccctgaacttaaaataaaagttaaaagaataataaaaacagaaagtttacccttgataacacgttttatgtataatcactaaatctactaaggcacatttgcatattatattatagagtctgctagctctacagtttttccaactgtgtacagtcggccaactaccataacccacatcttccaaatcctagtggcttaacaatggaaaatggaatatccagtgcagctcagtggagtgtggggtggggggctgtgttccaaacagccatttagaaatgatgctccttgcagctattactccaccataccatggggtctcacagtccttcacatcccctgagtccagctgttagctgagaggagcgagaatgtacaggatcaggtatgggtttcatgaggcagacctggaagggcaatacatcacttctacgagccagaaattgtcacacgattccttccaactgcagaggaggctggggaatgtaatctacctgtgtgcccaggaggaagggaaatgggctttgtgaaaatgtgcagcattatctctgacaaactggcaggaaaaaacccactaatgtcatatctttatatacctgagagatgtatcatcaatgaccaattctctgcccttggcagaatgccgattggaaatatagctttggacagggccaatattaggctacgtcaagatgaccagcatgtgtcctggcaagctgacaacagactctgtcaaacagtcagcatggccagattaccctcctggtcttccaggcaatcatgctcctcttcccactttgggactgacacctttgcttcccatcgcaagcacagccaattcactgaaaagagttgactagtgtcacttgcattttcatctgaataagggaagagtcactgtcacttggaatgtgaccatagactccactatccttagactacatcaaaattatgctcctttaaactatttggaggtaaaagacacaagaaaataataggcaccagaagcatacacaaatgtgagatgtttggcatggaagacagttttctactcataaaatacacaacttgaaagttggtataaatatcagatcctgaatcctgccagccacatttttactggcaggcatagcaggagacagcacaatgaaaattctcatagaggttggaagtagcaacaagtcttgaaaactcatttgactatcaaggagggctagaccacacattaactcagaccacaaaggctaaaggtctcacttagactctcttatcactcagcatttagaaccagaagaataatcacattcattctttcaagactttccctttaactatacataagaaaggaaatgtctttacattcctcatatctcacttggcataaaatctaatgtttgttcatctcacttatcttaatcccatacctcctcatgtttattagaagaaaaaaatgtaactctgcatgtcagaaaacagatctgaagtaaatatcagttaaaatgcaaaacaaaaagcaaaagaggtctcagatttttacaaatgttgttttatagaaaccataaaattgaggtaacttgatttaaaacaagtgaagacatccaagaattttcatagtatgcaagtgatctggactggtggttggcagcattgacattaaatcagctgaattttcattgacagctcattagaaagatgttccaagaaaatcgaatacaagatgctcaacagaagctcttctctatgcagttcataactgttattttatgtccttacaagtcatgactcatattagaacacgtaactctgtaaaatttaaagatttttataaatcgcatgaaaaatttccccttagtatagctataattttgctgtttatgtcacatggatttttaattacattttccaaacacgaaggcagtcaatttgataaggagaatatttcacaaaattcactcttctgttctaggatcttggttctaggtaactcattctccagaaagaaatcatatcagtcagttcacaaaagaaaaaaatatttaagccacctaaaaactcaagtactattcattgttaattttgtctggatctttacattaccttaactatatggtcagtctataaaaatgtatctgtacatatgcttacaggtaatatgtaatataagtaacatccagggatggatcctgaagcgggcttccatttttttttggcatttgtattttaatgaaggttaataaaagccaaattacagccaactgttaaagctttttttttttttttttttaattctatggtataacaaaatcagttccaggtttttttctgaacaaatgatcctttggtctttcccgtggcatgctcctaaaacaactaaaacaaccctctacgtctaatcagtcacctaagatatcgagtggcaagtctttcacatttgctgcttataattcctgaatggtccatattgagtattttcatttctgggtaagggaaaaagcattttggtccattaattcacccgctcgctcctggaggacgttaaccaattctgctatcacaaagacgtgagtggcatcaatgtcttgcatgatgaacttcgcaggcttccatttttgttcactttgggatggttttcctgtcgaactgcgtggaaaagcaggaagcacactgtccactgtaggggttcctggtccagcagaagactttcagatattgtcaagtttagtccacttctttggatctcagtggcttttattctgacataagatatttagatgttgcaagcccctccaaggaacactattttataaacagaaacatccagttgtgtggccatttcataattagcttctgaaatggacaggaaatgcacctatgtgaaggaggcagagcagggcaaatgcctttactgcttttcaaattttgatttccgggtaggaaacacaactaaacctcctatcaatttttagtctttacctgtacatttctaacttttagagatttctgttaatgttcctttttcttgttaactttgtatttgatattcaagaaacgttagaaatgaatgcctgtataacataatttcaagatattaaaatagcatttatcattaaggccacttgctttataccaacatcacaattccattttaagagttattccatgtcctgggaaattaaatcactgtctcaactccttccaggtgacataagaagacatggaggcatgatggtctagcagagagaagcctaggtggtatggattgttccatgttgtggaacatattacagagacaagggtatacattagttcagcaatttcgagttcttaaaacatctgctttctctccagctagatctatacaactggatggagaagatcaggcttaggtgttctgtaaaatttaaaaatgagacccctaatggcagctttcctattttactcatatttttggaatattttcaagcaattgctgatacaatctggtgagccactgatggaattgagtgtaagaaatggaaactgctatggattgttaacatagagactgatgaccagattacaggtgcatatattttgtttatctagagttgtgtggaggctgctgttcagagcattgctgacaccagggcatgaaactagtgacacagttaatgaggctggtgatgaagaaactctcgggtcctaaccgataatttcacatacctagtaaatcagcattatttcatttgagttacacttgactttttaaaattaaatatcatgcgaaagactttccagaattacagcattccaccaaattgctctagccaggaccccattgaggtccatattgtaaaattatcaggttatatctaagccatcatctttcttgattgcacctccccctctgacatagtttcttctcttggctgtcagcacactgtgcccgcttgccttcctcctatctccctgggcatgccttctcagtttcattgatagggttctcctcctcctcctggcctctcaatcttggaggtttttagccttgaagtttcttagcctttttgtcctctttctgcactcactgcctcattcagtctcaaggctttaaacaccatggagacccagccatctcttgccgtctcctccatttccacccattccaggcaccttccttcctcacctggccgttgcaatagcttcctaattagtctccagcttccaccttccccttcttaccacctactcccttcagtgcaaaagcctcaacctctggcactcaccctttctttctcttggttgcagctatcctggcctccttgctgtgcctcatactggaaggccactcacactttagggcatttgcagaggcagtgccttctgcccccagatgggtaaccctatgggcaacccccttcaacttccttgctcaacatttgaaactccaagctgcactgtcctcaacacattctccagatcctctttaccctgctatgttttgagccccttttactctcttacctactgtataatctcctaacatgtttaccttttactgtgtgttctgcccatgggaatttaagctctgtgggggcagggatttttaccaaggttgttcactgatgtgtctcaagcgctcagaacagtcctttgcctttggacagtgctcggatttgcatgagtgaatgactgtgctctctccagagtgatgaggatgtcaggattgctaggtttagaaatgaagcacatcctatagtatgacagagcctgcagaggagataacagcttctcgcttaaagatatggagtaggcgttaaaaatgatttctgcccaatgtaagaggaggattttccaattaccaaccagaaggagttgcttgctcttgcctcagtgattctcacaataccatatgctatcaagttccattgccctctttgtacatgtgagggtaaggtgctccattggatgtatcttgaaacagaacagagtttgtgtatgtgaggggggtgtgtacctttttctaaggattgagctggatgacaaaggatattgcatatttaacgggtagggagaacgcaggtgcaacaattcacaaaaatctcataatagtgaatgatggtgaatgaatagagaagacctaagaaatctctcaaacgggtgagttctctaggaattgaaagggttttttttttttctgttacagttttaaaagaatgtggaaatggaataatttgatgatattaagctgtggttttgatgaatgctctaagaatcatccccagtgataaatattcaaagataaatggtgatgttttagatagaagtcaatcgttattctattgcctgtaacagggttccttagttataattctgttagttgctctcatggtcttatgttactaatatagtcattatttcaaagcttatcacattctgtaaaatcctgtagtcattagcaataatctaagccaacgttagcaatccattaaggttagacatttaacttctataaaatactctatgccacagcactttcatattcctatggggcaaatttccatcgtagactccacgttggctccttgaaatggtgtgtactcaaggatagcccagcttaggggactccaaatgccatttcaattttaactttatacaacagattctcgttctccatccatgcttagacttcccagctctcaggttcaactctcagatcaggaacaaccatatgtactatgttttgtttccatcgaattggcagtgactcattatttaattactctccatgtgttggccaaatatgaggaaagaatactctgaaaaattaacaaaatgtggctggcattacagccatgcagtgcctcatgcctgtaatccctgcactttgggaggctgaggcaggtggatcacctgaggtcagaagttcaagaccagcctggtcaacatggtgaaaccccatctctactaaatatacaaaaaattagctgagtgtggtggtgggcacctgtaataccagcttctcaggagactgaggcaggagaaccacttgaacctgggaggcggagattgcagtgagctgagatcgcgccattgcgctccagcctgggcaacaagagtgaaactttgtctcaaaaaaaaaaattaacaaaatgcatctgtataggcatcctatgtctgcataatgcgtctacacaggctttgggatgcagcagcattggatagaacaatactgatccctggcaaagatacaccacaaaaaagctcggctgcctttcacaaatacgagttcatgaacacgtccaggaagataaaagtgtgcagtgcattaaaaacacatttccttctcattagttgcatgaggatataaaaattaaatcaaatctgctttgttgccaatttcaagaatgtgactgaggacaaggagcagaagaaagcagtgtcaccaatcctactcggaataatctgtcaccatgttagcagagcagaaaacatttcattttaaatgattgctatttcagttacataataaaagttaatagatacaaccccaaacataagatttaattcattcagacacacatatacttgtgttagtctatgaaggaaatatatcttttatgtcaaaattatgtacttctttgaaatgtagttcaaagtgaagaagaaaactttaaacattttccttcacttttaactccttccatgccccaaagcaaacacctgaacatatgttaaaatacttgaattcatagctgccatcagtaatgtctttattcattcagagattttacttcaatatccctctgttagactttttcctgaatgttgatcttgaaaatctgtaccgaaagcttaagtttttctccaaagtcacattcaacttccatagatcatatcagaataatactcctttgatatttacatagaagcaaatacaacaatatctctataatccatggataatgtatatatgctactatagatagctctcattctgaagatatttttcccaaggcacaaaggccatcacataaattcacctgcatttttagagtggatgttcagggcgatgtcattggagaaaggctatgctcccagtgactgtcacggacaagtacagagtcttgagtaggctctcaacaaatgattgttgtgcttattaattgaagaagaatgatcttatatgtgaatcagaaaggaaggaaattaggagtaagtgacaacgaagcaagtgatttgtgaacattgtgtccgaaagagaatctgaggaaaagggtgttttgaggttagtagcagggctgacattgaatctgagttccatgcccagcagtgagccacaccctttccttactaaggaatctggaaatgttgccagccctgccttttatctttgaaaacacagggctatttatgtctaaacacaatgcactgaatttaccttcattggttgacacagttatctttcctgatcctcaaaacctcaacagacagcaaagtgcacaacttgctatgtaatagaagtttggtagatgggaagtctacatgcaaagctgatttattttggcaagataactcagccgcaaggggttacacggaaggcagagagaatggatgtaaagtgtagtcaggatactactgagaaatcctagtcaaggatgttgcaatagcctgtgaactaggaaaggagtgatattgaagacgtgtatgtaagtagaatcaatgagtagggactaagttggtatgaagaaaaattcgaatgcttgtctaagattctaattctcagtaactgggtggcaccatcgtcaagatccagccctgggaaggaagagcagggtgggagttggaaagtgagttttagacgcattgaatttgaggtactcagaagacattcaaagggaatgttcaccagcttcttggaaatgtgagtctggaactttcacaagagatcagggatagagattagggattatcgtgaaggaagaaacaggtgaactcagggaagattacagagatttagacgagagggacagaacccaagggagtaactttaaggttgggcaaaaaaaaaaaagggcacctgtaagtggaattcagaagatgtaatcagagagactgaaggtaaatcagaagcttccagtgtcacagaaggcaaaggggaacagatttcatgaagatgcgagagtcagcagcatgtaatgccagtaatctaaaagacttgtctccacatttgtttccaataccgctttatgttaattatgtaatatctggtttctcagctttagtaacaatgacatgagaaaattcaaaattattttttgtgtcatttctctcagtgtgtttattattatttaaatatatttatatgctttcatgaactttacttatgaacgagttaagaacatggcatcccaaaatacaccactctggcatattcagtatttttagttaaaggcacttaagaaaaaccaggtgaggtcgggcgtggtggcttatgcctgtaatcccagcactttgggaggctgaagcgggtggatcacctgaggtcaggagttcgagaccagcctggccaacatggtgaaatcccatctctactaaaaatacaaaaattagctgggtgtggtggcaggtgcctgtaatcccagctattcaggaggctgaggcaggagaatcacttgaacccgggaggcggaggttgcagtgagccgagattgcgccactgcactccagcctgggtgacagagagagactctctcaaaaacaaaaacaaaaacaaaaacaaaaagcaggtacaagaagatcactctgaccttccttctgtttctgaaaagcaggagatgacattcccatgtgaaaggtgtcctcccttggccaggtgggaggcatgattcctatgggcaaggaccagaagctgaggctgagggaaacctgtaccacctgctatactggcccttccttcccagccattctcctccaatcacctgccctggcccaagcccccgaccccccacctcatcacatttctgcaatttactgctctttgtctaattccttatataagtggtcaatacaaactgcatctttgggtcttcacaaattctgaaggttttcatgccacataaacttatattaaataaatgtatatgtttttctcctgtggatctgtcttatgtcaatttaattctcaggcacaacacccacgtgccccatcccctaacaaatcctaacagaggagaggtataattttgccttccttacacctagaaacatagaaaccatcttttctttgaatttaatgatttaaaattataaagacttttggcttgcactgaattttcagattacatgtgaaattacttgtaaagaaaaattattcaatattatccattttgtcaaaactcttaaaaagatagtgatgtctaccagctttcgcattttagcataattggaatgagtctatggataaaacaaatagaaaaaattggaataaaaatcctcaaaattaagcactggttcctgccaaatggtaatgaaaagtcactagctttttccaataacattaaggaagtataaatattattaaggaaaagctgtgtgtatataagcttttctgaataaattaaattacacgaaatatataagctacagaatgaagtctttatattaaaaacaggtagtcctattttgcctggtatcgtgtcaacaggaaactcaagcatatccagccatatcactgctctccatagtcctgtagcaactgagaggactgcttgtctgttttactcacttttcatacatttattacataaattctcttaaaacagaaatcctttcttctcaacctgttgacccaaaaccagtgttaaagaggttaagataatgtatacactgctagattcaaagcccattataaattttcataaaacataatgacaaactatttgataacttaaagagtaaatatcagatttataacaatgccatacaaaaagatacacactacaaaaaccatcttgaatgtaagtttacaaaagatgtttgtctgctaaggaactaaattcattttctctttgaattcaccatttatagaagttttgagccctagaccaaaaatatggaagtataggccaaacattatactatctgtgataaattttcagaaaatttgggctgctttaagtaatgtatttatgttttacatagttcctcaatgttagcagctgtgaaagatatttacaatttacttcctatgtagaatttatcttaaatttaagaaatagcaaatagagggaaagatgttttaatgcaggtctttattgagtcgttcaaatgatgaagagaataatataacaaatgtccatgtacccatcatttatcttaaaatagaagatactaattcaattaaagcctgctgcacatgtctctaattggaagtgccttcctacctccagaggtaaccattatctgaatgtaatatttatcagtccatatatttctttacattatgatgatgtaggtttttaatgaatactctttttaaggttaaagtaattccttcctttgtctggttgtgagtttttatcttgaaagcctgtgttgggtttcatcagtttttttttctgcactgattcagactgatctacagtcagaatgtaaagttttaaaccacaaaactcatatgattcatatatggtggtgaaatgccttcaataaataaatgaagcaatatgaaaagaccctcatgaaaatattttattcaatgaaaatgaaattgctttaggcattaaaagtagttatctatggtcacctaaaacactatttggttttactagtgaattcctcatttccttcctttctgatttatatgttagataattcttaaattaataagcacagctgagggttaaacataccaaatagtcttctgccaaatgtttttacacctgtggttttaagtattttagaatattgattagaaaaattatacatgtgaacataaaaaattatgatgtggacacaaatgatttttaacatcaaacgttttttaattttgatatccaaaatacataaaaaattgtaaggggataaaaatctcactgcaatcaagctttctcacctttgcataaaaattatcactttgatttcagacaagtttttacaagctgtggttattaagaggtggatctcaccatgtgagacaaaaaaacacgtgtgtgccaattctaaattaatttccaaatatgaaatacatccgttaattcttaaagatgctcaaacacaaaataaaatatattttgaatgtagacaagtaggcatcatcaatttttttaccacagaaaaaggtagtattttattactttttccacataaaagtctacctctgaatttaccttttcactcggcttttcatttttacttgtttttttagttttccatcataagccagtcttctattatatcaatacaaactttataaacttgtttacacttaatttttgtcttattctgccttgaataaaaatagtcatagtggatataaaaagaaaattctaatgatttaatttgatgtcagaaatacaatttttaaagaaaacatcgaatttctgctgctaagagatgtcactctgtaagttttctccaaaagggagtgttttactgccctttacaaacagagggaaaaaccattttctacttcagaatgaggcgtggatcccttagtctgacatctgacatccttcttgaatttgcactgaacctccatctttatctccaacaattcctggctgagtcccttcactatgggcctactcatagatgtgcacagaaatgaaccatctggtgtgccaggccacaccttccaacacttggctctgctgggaccacaaggatgggctttctcatctcaccgtacatttagatggccatattgggtttcggatagtctcccattcttaaccatggtcttcaacagtttttgttttaaaagtgaatactcttatggtaaaaaagataaatgtgaaatagaaaatactgtagatctacagatcaaagttatatttgaaaaccacatttaattgtatattcacatatttttgtaattcacaaaaaatatacccatctgtaacttttcaacattcttgagtgttttgaaaattaacaatttgttctaaaacttgagagttacatagttttgaaatatttcaaagttcagttcaaacacacacaaaactcctggataccacctggagctaaattcaataccaatcgaattttttaggtttgcaaaattgaactaaagaagtaccactgagttgagggcatgtcaagatctagcattaaaccaattcagatttgtacttggaccagcatattccaggggtcacagtagccaacatgcaatgccttaaaaatacatgctgtacgtgtgtttttctattaagctaaattcaatctctttttttttcaggcataaatttatttgagaacaagagaataatgtttctattctatcctttctaatatcaagctggtctttaaaattttttttaaactgtgtcaatttcctaactcgattcttttcggtatgccgacaggttatttcaaccagcctcgtcctaacatttggctcattatactattggcacattcatgtctttctctgtaatcttcacctcccgtgcttgtttttctctcagtgaagtacagaaagccaaaacttaggatttgaaatgtcgtcttcactgcctggaccaatggttttcttgttttattgaaaatgaaagagctggccgggcgcggtggctcaggcctgtaatcccagcactttgggaggccgaggcgggcggatcacgaggtcaggagatcgagaccagcctggctaacacacggtgaaaccccgtctctactaaaaatacaaaaaattagccgggcgtggtggcgggcgcctgtagttccagttactcgggaggctgaggcaggggaatggcgtgaacccgggaggcggagcttgcagtgagccgagatcgcgcccctgcactccagcctgggcgacagagtgagactctgtctcaaaaaaaaaaaaaaaaaaaagagaaagaaaatgaaagagctatgcatttggtgaaataataaaaacacaacctttcatctctgataatactgagcattaaataaaattataggtgcaattattttacaggtaagttttactttctaggacaaagtctagatacacagggcagtactgactgccccgaggcctcggtctctgcaccaattggtctcatcttatttcaagtgctctcgtctttgtcctcctcttctcagttacatctgtgtaacagggtctgtccagcgtttcatttctctaatcaccttgaacattgctcagcagtattactaacacatgagcctgatggtgagacttttgttctcaataaataaacacaaactcaatgcaccttcccaggggctttgcatgggacctaaatattctttgagtcctgagttttctctcctctgaatctttgctgtccatcaccttctgccatttgaataccctcttatccaaaccaaaatcctaattccagtacagcttttcctttgtgataataccactgattttctagtacaatatacgcccagctcccaattccagctctgagctcctagagttctgggggacttcacattgcccatcttcttttgcagagtgttatatccaggtgtatgtgcccagctctcctaccagactgttcatctgcctgtggcacggctccttgcacacagtacgtacaaggcttggtaacagaatcccatgttcattgaagggcctagactgatcacattttaaataatgcacaatgttctcacgtctatttaaggaagaaacaactgatttctatcttttaagattgcatttcaagaccatatcaaaggctttgaatctctcaccaagactaacaatgaaaaacaaatttggccaagtgcagtggctcacacctgtaatcccagcatcttggaaggccgaggtgggtggatcacttgaggtctggactatgagaccagcctggcagcctgggcaacatggcaaaaccccatctcttctaaaagcacaaaaattagcttgcgtggtgacacgtgcctgtaatcccagctactcaggagggtgaggcacgagaatcacttgaacctgggaggcggaggttgcagtgagccaagattgcaccacagcactccagcttgggcaacagagtgagactctgtctcaaaaaaaaaaaaacaaaaaaacaaaaaaaaatgcaaatttgatcatatttaattgaatttgtttcaaagtaagggaaaggggagtatgcaagggcgacatgtggcctgttcttctgaaaaagcaagaaaggttatctttatacaccagatcaaggtattgacagctacagagtgaaattccatacacaaaaagaaaattttcttcaagtgaaaaaagtaagtggccaataaggtcacattcaaaaattaaaaatggatgccctggtcttgattactgataccatttttcaataaaagtaaccagagctccttgaagaaataattgattttaggactaggacatgaaatgtacaaaatgatgcgggagcatcttgtagtaccagggaaaaaaaaaagtcaacccttagcatgaaggtgtaagtcaaaggcacatgggagactggagatgcattttggatttcagattttttcagattttggaatatttgcatatccatcctgcgtcatcttggggacaggacccagatccaaatgtgaaattcgcttatgttatatgtagtgtatccaaatagcctgaaggtaattttatacagcgtttttaataattttgtgcataaaatgaagtttgtgtacactgaaccgtcagaaagcaaaggcatcaatatctcagccacccacatggaaaatctggtgttgtttggcatcaccatcattcctgactgaatttatttgctaccaataagcaatcattttcctgctcttactcagacgtgagtacttaacagtagaaaatactactatttttgtttttgaaagagtcttgctcttgttgcccaggctggagtgcaatgacaccatctcggctcacggcaacctgtgcctcccgggttcaagcaattctcctgcctcagcctcctgagtagctgggattacaggcatgcaccaccatgcccggctaattttgtatttttaatagagatggggtttctccatgttggtcaggctagtctcgaactcccgacctcaggtgatccacccgccttggcctccgaaagtgctgggattgtaggcgtgagccactgtgcccagcctaatactactattttttaaacagtaaagatacatcctattaatacagtgaaaaataatgtgtttaggtaactgggcagcacaggaaaaagaccgttttcctttctcagctgttagacaacagcagcaacaaacaatgcaggctttcagttgccacctatgatgctgtgtttggagtaaagggcactgtacactgtattttttttcttttttaggtgataagaaacatctgaagcagttgacagatcatgaagcgggtcctctgagaaatgagaggcattctgccggatggcatttttttttttttttgagacgaagtctcaccctgtcacccaggctagagtgcagtggcacgatctcggctcactgcaacctccgcctcccagtttcaagtgattctcctgcctcagcctcccgagtaggatggcttttaaaatgttttctccagcgtcatctgcctcattaacagcgatttttgtcttagaagtctctctttgagtttctaaatggacatgactgcttattctgttaggaatgcactccactctagtccttcaattagcccatcacattgtcactgtggcatctgtatgcacattttctgccgtgttaatgtcatcttcattgtccaattgtggcatcatgttggtgctcaaaacgttgcagattttggaacattttggatttcggacttttagagtagagatgctcaggctctactacttcttatttcagagaaaaacataatatccaaataactaataaaaacttggttggagaatgcagacttctagaaatgactgtttaatctgcttatgataaataatcctctttgctctactgcaaaggggagactactgctgttactgttttgtgtcatcatgtcctgatcagacaaacactgatttaaaaaaaaaataaaacaagtacattgtatatgtaaatttagactgtaataatatatccttgagaaataaatattatatggactccatttttctctgacagtcaattaagcacaaaaagatttttaaagcactgatttttgcattcttaaatgacaaatgaagtcttcttgaaataagatttttaatgatttagagaaatatttgcacatacactagcttggtgttgattctcaatttttaatttttttttaatcctttccctggcattttcatcgtttccttttttttttttttttttttttgagacagagtttcactcttgttgcccaggctggagtgcaatggtgggatcttggctcactgcaccctccgcctcccaggttcaagctattctcccacttcagcctcccaagtagctgggattataggtgtgcaccaccatgcctggctaattttgcattttttttttttttttagtagagatggggtttcaccattttggtcaggctggtcttgaactcctgatctcaagtgatccacctgcctcggcctcccaacgtgctggggttataggcgtgagccaccacgccaagcctatccttcccctttttctgttttgttatggatgatgaatgtcttaaaactactgaactccttataccttgatatggttagtgagagcttccttgtgggatggttctgaatgattttctctagaacctccatttgaacatcttcctttcctctgctcactgtaccagtctggggctatcaaatcacatatgctgataaatgctacactatgactggtgaagccagtgctaaaaagcagcttctacatatggcacttccaaattgtgttattgctagcttttccagtgctttctctactagggcatccactgcatgtcacctgctaaaatgcaaaccacatctttaatgaaagtctgttttattgaatatataagtgactatgaaatttcaaaatgaaatttgatggcaatttaattttataataaatctatatctatgtatctcaccaaagatagcctaaatctttagtgaggccacacattcatttttatgaaaattcttcacatgagtttagaaatctcccaactaagaaaaggacaagtcagatcttagtgtcctgggtggcttagcatttcataactgccagagaaccatgaggaccttcctgggactgactcatgggagttatctgcaatgattttatgtttcccaatgggtcatattttcattggagattatttactatgcctggaatcctaatgcttggtgtctctaatgagaaaaataatacaaaaaaattcaatattcagccaacacaaatttatatgatctacaaaagaaaggaatgttttcagatcctgggcttgattatttttgttttcgatgtgacagatttgctgaacaaagcttacaaatctcccttttcctctctgctcgctactaccccgacccagaaaacacacacacaccccttcccaaccggggaccatctgaccgttcacacccacatcaactctgggtcgccatgcttttctgagggacattgccttcactgagagctcctttattctcagtataccttacattcccagccacagtactgaacttctcaatgcttgcaatgttcccttggagtatatcagttgagcaggcggaaaaaaaatatctggaagtttattatttttccaccaatatatttgacaccacctttggagagggaacaaaaggcatactgtcaagcggatagacctggacaaaatgttactgtttgttcctcacgagcacagaggtatatttaagcaaagaaaggcattccacggctctcccgggacttccttccttcagctgaattataccaacatgttcacaccactgagggccaggctgctggaatttaaaacgcagacctctatctgccagtgcttcgatcccacggctacaaacattcacattaggattgaacctggctttcaaacatcatgagataaatgggagtttactgggggaaaacgtgtgccctcatgaaactatagtagaagatgcggaaataggactgtccctgttcagcagattctatactaatacaataaagcctcaaagtcaccagaagtcacctggccttgggttatgtttcaaatccaggctcactgacattcatgaaacctttggcaacacaggccaagtttcgtgcaaggctgggtagaatacttctttcatgtggaagctgggtgaaactcggtggctttggctagctttcacctgaagtttcacattcaaacaatccaaagtttcaacgtaaaattcaggggtgaagagaaacagaaagaaaaaaaaaacaaaacaaaacagggggaaaatggcttgcctgggaatggaatgatcacctaccattctccaaaaagatttcatcctggtgccatttaattttgccgctggactatcacctctagcaatatatttgcactcagccctgcagaccaaggcttcccagtactaagggagagtgagtattctagctagacgcaccccatccccccaacaaagcccaggctcaaaataacgggaggatttaaaatggtaaccatacacataaatgcgatgattgacatgcttcttataatgtagatttgaaggggaaaagtggcaatgaaatgcccaggtttgggaaacttaaagattagactgaacatctctaggtttttctactataaatccaagttctggagattcgattgcatctgctcctaatccagggagatctctgccgtagctttctccacagctccgcccctttggagatttgtcctgtggccacttgcgtttgtccttcttagcaaggtgcagaggacggggcagactgcgtcagcgctgaggagctagcgtccttgactgggacttaaacagtctcctgacaggattaggctcattctactcctaaccttcaacagaacacgcagggaccgtttgccagggaacgtcaaactctgtatttggctgaggactgtgaaaataccttgtgcttggggtgggaaagaagaagggaacaaatgtcacacacacctgtgctttcttcacaatgaagagaatattccaaagctgattgaatggctagtaagtgctacattttgcccattttaggaaatacatttttaagaaatcccttatcccttacacagcagaagtttcactcgtaaaacagacttctggctactaaggttttttttttttttccagttttcttttgattctaattttctttttctttgttatttcttcccgtttttgttactcagacgatccttatgtggttaaaatgcatgctttcctttgatatgtgctctgtgataccaataaacttttctgaaaaaaaagtatttctgaactccaaagatttcagcatccatgtttttaaaaagcaccagttgggccccaaggcacacggagattctgaggcagcagggcagccagcgcggggctctgtgcactctcatttgctgcttgctcttacacatctgccagacaggggccatgaactgtcctgaagtctgtgttggggagaactttaccagagaacacttttcttacaattgggggtccctctagaagtgaaatctaagacagatcagtgaggaaaactaaagctccaataaattgtttaaaggaaatgctatgaaagcattaaaccaaaaggaaaaaaaaggagactttttactgagcatagtaaatagccacaatcaaagtaaatgctgtgtttgaagttaaagtccacagatcaaagtacttcgcaaaatgtcaagtgcaagcgtaacgagggggagaggggagccacagaaactgacccgaagtatcacattgtcacgttagagaaacctgccagcagatgtacccagcaaaagacagtcagcttagtaaggaatcctcaacactgtcccctaaaatgtgctaggaacatacaaaacaacaataacaaaaacaaaacccccagattcccccaaatcaaccactctaattccacacgagcaatgaacgaaacagtgatgaaaggagaacattatacaatacggctcgctcattgcccttaaagaacaattacttatatatattatctttactcaggtggatggttgcatctttttcctctttttttttttttaatgcccctggaaagttaaaaataaagcagtctaaacaacaaaaatatgatgtctgaaacatcctctcattgctctggcaatcaggcttaattagacctctgatccatggcttagtcatagtcaagcgtgtactgcaggtcactattatgagagctttaagcaaagtttaaaacttacagccacaaaaatgcccagatgctcctgctgtattctggaacaccgtgtttacctgaaaattgttcacaactccccttattattttcactataagtaagttattttaaagacattagttatgaacataccagaaaacaattaaataattccagaataaaaaatcttacctacaggcagctgagttcaacagttgctctatacagaggaagtaggagtcagtggccttttacatgtagagattgtttatttagccctttttaaaaggtcttgaactccagaggtttaagattaagtccaatccaagtgtctgaaggaaaaaaagcaagagagaggcaaatgagagagggaaagaatcccagctgctgggtggtgctactgttctgagagcatttgagctattttcagcattaacagcagccggggttgtctgcaaagggatgaaaatgccttgcccagatcgccaccccccactccaggggggagaaaacaccaaccaggaaacccacaacgacttggttcattgtgcaaatattcatttaaattttgaggaaaactgccagcaccattgaaaacaaaacaaacccaaagttgactggaatcttaaagaaacacagtgctcctcaagttttcaaaatgaattacctgattcactgaaaacgagatgtcctacttatgctttattgagaaggaggcttttcttctgatatttcctagggggtcttaagaaatagttgagagccctctggtagcagtatctgttgtcagtctattcttaagactgaagacaaatgatttcttaaaagagcccgcacctaaatttccagtttcatcaactatgctatttttgaaagct

SEQ ID NO: 2080 - DNA, 212820 bp, Homo sapiens
cagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgtgtcaggggtgggggtccgctggcatctctcgtgccggcgctgggggggtctcccgtggaggaagggctgaaggtgctccgggaggggtccactcgttatggaaaggaagcggggcgcggtcagggtccctcgtccgcagtgggggtggtccgggcccctcagcctgcacccgggaggagacgcccccttttcacgccccgcccccggtggccgaggccggattcggacagctcggggtcagtcgacggagcacaccgggcgcccgaatccgccgggtcccactcacgcccgccggccgccggtaggttggccctcccgcttccagcctccgccaccccatccctcgctgctctctgaggaggattccagacccccccgtagatctccgccctctctcgggtggggctccgaggtctagctggtctgggggtcagtcccggcctctgtctcccaccgcgcccctcgctcccctggacaccgcctggtgtgtggggctcagacccccccagtccactgcccctgtgtggctcctcctctcaggagaggattctagatcccagcccggggggggttccgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccggcggcggagggcaggtgtgcgtcggcagggctgggtggcccggcagagagggcgccccaggttcagcccctcctcgaagggcgccggcgtccagtcccgctcgtgggagccgcggagcagccccagggccggcgagcggctgccctgccaggcgcgtgcgcgagggcgcgctcccgcgggaacgcgccgtgcgcggggagatttgcgcgtgcgcgtggcgatggtaactggtgggccccccgggctcgctctaggcggaggctcccgggacgcccacgtggcttcgaattccagctccaccatcactgtgatgcgtcactctggactaggcatttaactacgtgcctcagtttccctttctcaataatacggagattatcgataccctctatactgggttgttgcaagactggaatgagatgatacaagtaatttaacaccatagatttttaaatttaacaccatatgcatatttgatgcataataagcactcaaaagttattgtcgttgatgccattactgttagttaatcctcagtttaattacatatggtgcattttcatttctctgcattttcattgaagtaaaaattctgcgttttctaattttggagaataatcttaattaaaatatgaatatttgtactgcacagtccaactcctacgaagctctgccttgcagcagattggaagagagaaactgatcaactgccgatgaagttggcttttcagtatattgatggagagagaagcttaggaagctctttggggaaacttttggtgacaagaaaataaaaagtttatcccagagtttttcttttgtaaatctttgtgttttctctttcacctgcagatgttgcagttgggtttgtcttaatttcagtctctttgtgagggaccaccatttggctttcataatttaacgtggttacagagcctatgtataccctggctttccattttatggccttaagtgctgcagtggatttacctttagtaatggcagaacgtagtgtataatcattccttgcaagctcctgaatattgtgagcaaatcaatggagacaaatagttattactggatgggtgtgagtactggctatggcaactcattaaaatctctttcagggtatgtttgtacccacttcactgcagcacaagactatgatgatgaatatatgtttcccagattgttatctgttgcatgtagacttacggatccttttcttcaaagaaacggctatagatatttattgattcctcatggttatataggtcctccaacctatctgctgataagtacactgtacacttcgtgggcctagctgtaggtctaagaggagttgattttgcacatactatacttattgcatttaagttaattcatctcattacatgaattggttttaaataaatttttaaaatcatttgattattaaaatataggcatttcttggtgaacttgaggcaagtaaagcctgacagatgtcaccatcacaaagatccttagtgacctttacaaaatagagctcacccagaaaaacatttgctagatagaaacctgattttatagttgcttctgaaatctttgaagataggaggttatttgccccaaaattgctttgttgaaataatttagcctgattcgcttttatagaaaaataagggtaacgatcaagactgatttaagattcttgtatttttaaccgataaaagaaaattaagtaatagttggggaactactggtgtcagatttgaaggaatgattgtcaggaaatactgagagtattacttcaggtagcagtgtttggctttgcaagacaaccctctcatcctcactgtgaatatgtcatctttaaaaggtaccttgaggaattagtgtgacagcttctctgaaattcatgtgatcatttacatattgtttcccaggagctttggcattaaatgtttcatttattggaaattattttgccctttaatttatgacagccaacagtgcaatagagtctaatgtattttagaaacaataaaattagcttttcaccattttctattttccctaaaaatctagcagcaatgcacttggaatgcttaagttagtccagagacaaatggtaagagtaggaaaacatgacagattgggaggtgttgagttctgaatttggggacctaattgaaatgcaaaggtataatcaagagaatgaacttgtctctgtactgaggttgttttcagtgatgtactatattatctgattcagtcaacgttccttgttattttttcaaaccaagattgagaatactatattttcaattatgaacattttgattacagtttcattctgactaattcagtcggaagagaatgcaattattatggtcatttacatacaatatgctaagttaacacagctaatgagtgaaagcataatattctttctgtttgttcctggaaaaatattgtgctaagcattctttcaaagaaagattacattattcgctatcattttatgtctatctacaagtagaattggcattgagccttttctctgctattaaagtgaaatctcttatattttggtgatcacatgcctttcctctcaccccttgggggagactggaaacaattctcaatttaattagatatgctgctttcttttttctgtacatctttatctgaggaaagattgtattttctaatttgggaggctgcttaacaccttaaacattactaattactgcagtttattttatgtgtgtcgcaatagtgtagttagttaattatagctttctcattagcaccacgtagagaataatgaattaacacatccctttgatcaaaaaggatttaagtttatcttctgagaataaaagtgttattgtgttactgaaagtcactataattttcccaagaaacaaattggttggaattctgtatcactgggttaggaagctcaatgaatgagttggattgatcacaaagtagagtagagctgtggttgcttggcaacctgacattattctgccatttctggtatatttatccagtaaactagaaaattctgtttcgttaacgaatgttttaagtcagtgcacaaatagaccataactaattgagattttatgtgttgtgggtaaaaaatgatcctgcttaccttctcattgtgtttagatcataaaaatacaaagggacatattccgttttcaattttaaggcattttcctgaaatgttgacttcactttcacataatttattcctagtgaagaatacaacttgtgtatctctttggaagttaaattattagaagtgtgtgtgagtgtatatgtgtatgtgtgtgtgcgtgtgtgtgatgcttatatacataatttcaataagaatcacaactagagtttgaggtgagatgaattctcaaaattcatagtttgctaattgaactgacagtttggtacatttagggtgggtataaatatctgaatcaaatgatgctggcagatgatgataagaatgataaatgcattgaacttggtcaatatataattatattttatgctttgaccagggtttcttctcctggtagtcttataacattctcccttctaatgtttgtttgcatcttatttcccctatagttgtggaggtaggagctctgttgcccatcttctgattcacctcttcctaactccagggactacaattgtgccattttcctatacaacctatgaattttagtgtgcatcacaatttccttttcagactgtaaactccttgagggtatacatttccttttatgcatctcataaactcttaaagtgtctggcacagcaggaagcgaactgttgtggtggttacatgcactggctataaaagtcaggctgccagggttcaaaatctaagtctgtcagcttgcaggtgtgtggcattggcttagtcatgttgacctctctaagactagtttcttctttagaaacggggaaatagccatacttagctcacatgtcacatgtgttcttgtggacattgtatggggcaatctatgcagacagattagtagcacggttttttattgtagtgataattatccttctatatcatgttcagtatgtgaatgaacaaagatagagggacagagcgtatgtgtgtgtgtatccctgtgtatgtgaataactgtgagccatgatcaatggtggtgtcaaatggcaaactgttgattcctacattaattatatgcacatataccaataatgattgcttcacatatttaaaaggttttcgcaatagttgttcttaggcttggctgaaattagaatcgtctggagagttctgtaaagctaccaacccaaatcaattcaattacagtctctgtggatggtgactagaaatctggatttttgaaaacttctagtgcgattctaacacgccctaatgtaccaatattggttaagaaccatcaccttagatttgcgtacgccgtccacaagattgtgttgggctaaggcattggttcacagtcaccctggtgtcatgaaatgtggctgaaagagaaaaaatgctctggcaaacttctgaggtttttcttactaatcttcttggtttaaatagcactttattctctgaagatctcaaatgtgcttttcatttactgtgtataatttcgtttttcaaccaaatgtctctgtgaagatggtaggaaagaagtaattatcctgatttgcagatgaatgtgaatggagtgagctacactgaaattaagtgatttgactagattcatacatttagaacaggcccagataacaagattcctgtgactttggggttttgaatatttctctgttttgcctgcagacttccaatgaggtagggagagttattgtttttggactaaagtactgtgtcagaaaaagctttaaaaatgagactttcatcctttttttggttataattgtgcagtgtaaagaaaaacagatttttattttctttctaagaagaggcaccatagtctatataggagccaaaccaatgtcccttggactttgaacaccgcttgtataaatatttcatttggcccaaagaatgtttaagacaaatttcagccaacatttaaatactggagatttcatgtaaaattcatatttctggcttatcttaaaaggattgatgttctcacagtattggacctgaatgcccaggtggcagaatgccacaggttagaacccagtggtttgtccccttgatgttcttgaaagacatatcttcgctgggtaaaacatggcttcctctcaccttcactttgttcctttcttttatatagatcctactccaaagaggtaattaagggaccttaaagacgggcccacatctctttggatgggattaggggaagcccacaagggctgctgaagcacatctggagctgttactgccccttgtcctgaagggataatgggaaggtgaagttcctggaaggaggtgggagcagtagctctggaagagggctgtcacgtgggacctatggcttttggtagaggaacataactactgtcaaatcacaagacagtgctctgcttctaccccaagatttccagttgcttcttcagcaaggcagtaagacggcaagggagcctattgtagtggtttgtggaggtcagttctcccagagcagagcaggatggaggaaggcagaaaagggatctgaatctgggaagtacgtgaggaatacctagcacatcttgaaggctttacatttgtggaacgtgagtagtggggaaggggaaagctagaattgacaaaaacagtacaaaatagggaatcattaagtttgtattcaggagaatcttcaccactttttctttgtcattcctttcttctttctttcattgcccgaagtgggcatgctcatattcagtggtgtgtttcagttgggactcttaaacttcaaaacaaatttgtccatttcattgcattatctatgctttctaagatgagagctgacatagcagagagaataatgtaaaagatgtattccagcttctatggtaatggttggcatttttagcagaggttcctccctaacaaaagcttttgctgtaagtggtgattctcctgggagggattgtagttatgatgcctgggaaagcggagatacactcaaatgtcagtctggcagctgaaactcatgtaacctggatgcctggatctttggaggaagtatccttcttctttgttatagttgtatcagaacaaggacgatgaaggaatagaccagaatgcactggttgcatcttaatgtgaggaatttttatttccagggactaagagatgtatttcccagagtaatagaatgtaagtggataaaaggaatgtggggattttgatgatctgttgcggttagagttgttggaagttcggttttttattgcattgaaaaccttgctaaaaactgtaaagtgacagaatattagcttattatgggatgccttacatattggttatgttcaaaagaaataacacgtctcatgtgcaaaaggttcagggggaagataaatactgaccttttccaagactgatactggatgctgcatttccatcctttcagaagattgcctctgaagatttctattttaaaaaaaaatcataatgtcttgcattatttgtgtgctttatgctttttagaaaatttttccatgtcatctcatctgacttttacaataacatagtgaacaaaaagaaacaggttgttagcccattttatagatgaaaaaaactaatgcaaggtcaagtagttagctttaccactattccaccacactgcctacagtagtgaaaattagaattaaatcatcttagatatcctaatttgtaacccagttcatagcccactctattgctttcaggttttctttttcctttttctttctttctttctttttttttttttttggagatagggtctggctctgttgcccaggctggagcgctggagtacagtggtatggtcatcgctcactgcaacctcgaactcctgggctcaagttattctctcacctcagcctcccaaagtgctgggactacagacgggcaccatcatgtctggctaatttttaaaatcttttttgtaaaggtgaggtttcactatgttgtccaggctggtttcaaactcctggccttaggtgattctcccacctgcccctctcaaagtactgggattacaggcatgagccaccttacacagcccagatttccttttttggaagaaaagagcaacattgtataactgatagtgaattgttttttaaggaaatctagagtcaccgtataaactgagagctgtctaggggaaaaattgaaaatgttaccagttatattttgagagttgaacgtagtcctggccaaagatagggagatagacttttccaaagcatcctgaattctataatacatgttcttatgtttgtgtgtgtctgtgtgtgtgtgtgtgtgcgcgcgcacgtgtatgtgtgggtcctatgaggcattgtgaccagtcattataaaaagcttttattgatcgccactttgtgctagagacaggaatgaaactgtgccaggcagatacttaaatagccaccattgatcatttatcaagtgtttattatgtgttttgcaatctccacatcagtgatttgaggaaagtactattataacacccaatgtaagctgggcgatgcagacacagaagggtccttgtccaatgtcacacaatatgtcttgcagtaccagagtcagaattcaaactcagaagtgtctgatttccagccccagcagtgccccctcgattagcaggattctccagctatggtcttcactatggactaacactctttcctgttgtccatccaaacttacctgttctgtgtcccattatccatttgtggaaaagtagacataaaggaatcctactgaggtattagatgataatgcatacctattccaggaatggtggcattaaatatgaggttttaaaacctgccagaggtggtggtgcaagcctgtaatcccagcactttgggaggctgagacgggtggatcacttgaggtcaggagtttgaggccagcctggccaacatggtgaaacttcgtctctactaaaaatacaaaaattagctgggcatgatggcatgcctgtaatcccagctactcaggaggctgaggcaggagaatcacttgaacccaggaggcggaggttgcagtgagcctagatcgcaccactgcactccagcctgggtgacagagcgagactgtcttaaaaaaaaatcttaatgcaactttgggaggctgaggctggaggatcacttgaggccaggagttcaagaccagcaacacagcaagactccatgtctacaaaaaatatataaataaataaaaataaaaattagccaggtgtggtcgggcatgcctatagccccagctacttgggaggctgaggtgggaggatcatttgagcccaggagttggaggttacagggaggagacatttgtgttctctccaaaatcaagtcatataagcgtctaatggtctgactcttcctgtaccagaccctgggcatcattatatgtacaaatgaaacttcactctcattatcattgtttatttcttggcagaaatgtttctgatactctatgatatgaatacgcatggatttccctcacttctgggtattatatgtaaccaattgcatttcgcggttggcatttccacaaaggtgtgagtatctgctattccagattaaaatagaaatcgttggcaatggcagatgccatatctcagcattgctgttcttgaaaacggcttgaaaatgacaccgatcataatgatggcactgtctttattagcagccgtcaataaagataaggctttagaagaaaaaaaggcaactctatttcaggcacagccaatatatttgggagttttaagagatttttgagttttttgtttgggatatttacaagcaaatgttcatgtatttttaagatatgcataatataaatagcattctcagatgctgagtggctccaaaaggctcctttttgtgtactagaaagtggcaagaataagtttgtttcctgctttggctagacaggagatcccacttccttggattatacacaatggcttttctataaagcttttgtttgacccatacctgcttctctggaatacacagcttggcttctcaagaagtaagtttatttctgtgttgtaaattcaaggatttttctaacttgttctgtaaaatgcatctgatgacatagtggagaattcatgcatttgattaaaatttaaagatgtaaagaatgcttaaggcatcatacaatggcaaaaaactgaaaacactgcccacaagggtaaacatataggcaataacaattttaacatctatcacctatatctgcatgaataataggctatattgcgttatttgttattgttcactaatttgagacatatactattttccataaagaagatctgagtgaatggataaagatagccaaaacaagcctgtttaaatttgaccttgaccccattttcttcgtgacctctagcaattctcagaggagcaaacttcaaagggtttcaacagtctgctcttcccatgcatacaagtttctgcttgtaattgatttgggctgaatagattttgaacacaattgatttgcttgaaataacattaaaggaccaagcactgagcaattcaggtgcaactcatgcacacttctgagtcaagttcaaataaattggatttgaccttaaccactgtcccctcaaaaaaagggctggcagtcatcagaatgaatgccatccaatcaagtataaaaactggtatgagtggtttggatcagaaattgatctccatacacaagaccttcttttgaaaacttgtaatgagcttctgttttcctgttttaccagctgtaaactgaggaaagaaacattgactgctgcctcccagtggcagttggaggattaatgagctaatatttataaagtgctttgaagataaaggtgccagctattattattactaataaaccattttttctgcagtgtaattttggacagcaggccttaaaaacccattactgtatttaacagtaaaacaatctgccacagcctagtatttactgcctcaattaagcatgcattccacttcctttgcccctccaaattcagaactggtgaggagagacagaaaggagtgtgtcatcatttcccaagttcattgaaatattaggtttgggttgtttgattgtctcggcagaaagctagactatatcctcagtgggagactagttgagctacacttttgtttctgtgccttatgaagggagtggaaggcttggttctaggcctttattcaaccagatttacattgtggtttattatctttgaagattgcattccagtatccgttttggttatttgaatatggtaccattaatgaaactggtttatttgggtggttttatgtgtgtacctgcgtgagggtggggttcacaactaactcctaaaaccgaagtggaaaatggaggtaattctgcagctatcccatgtccaaaagtattaaaaaataaaactggagaccttgaattatacaggatagtttcttagttagtaattactgttatcattatatgatattaaatcctttcaatctgatttattttgatctatatagatgtcctaaaatatcagatggtacagggtagtgtaaatatttctcacgtattgccaaaacaatgcttattttcctctgatgctatttcagtactgcaaataaaagtaaaaaaatataaagttaataaatgactataatgagatgtctcagctttcaacagctacttcaggtattcaaatgctaggccaatatctaaaagttgaacaaaagaagcctcaaagcaacctagatctctttcttggcaaaaattcactaaaatgtaaacacttgattatggaaagatcttcctaattcagtgactatttgctcttaatttagaaccattctaatatgcataattatattatttcagcagatgacaaagtataaactgcaagttggagcagatgagggaaattttgcaaattcattctaagacaaaataagttacatttaatatatttcttccgcaagagagagggatagaaagactagaaaaagacaactcagaaatgactatatgggtgatcttgagtcattaagaaattattttaaaataaaaaataaattgacataccacctataggagttcagatcatttatctgaaaatcttatggaaccaatccttcctagtggtctagttgttcaataatgttaaatacaaattcttaacagaaccctaatcttttttttgtcattattatacttcaagttttagggtacatgtgcacaacgtgcaggtttgttacatatgtatacatgtgccatgttggtgtgctgcacccattaactcgtcgtttacattaagtacatctcctaatgttagctcccctccgctgccaccccacgacaggccccgtgtgtgatgttccccaccctgtgtccaagtgttctcattgaacagaacccaaatcttttaaacggtttcttttacaagcaatgcactaataatgatccaaggtaggtgccgttgtttacagataggattttgtattgcccattccaagtttgccacagagtatactttttattactatcacttagggagactgtttggtaaataccatcaccattccattgacttttgaagttgagctcatgctattttcatcatttgttttgtttaattgtgtatggggaattcaccatatggcttaaaactgtttaagacctcaatagatatgtgttttgcatatgagattcttggggtatctgtagggatatacacaagctgtttgttattaggaagaaaagtacctgaaagcttgtgtgtagctaaggggagaaatgatgaaaaatattctgaatgtagcaaagtaacaatttgtgtaaaatgtgaaggcacatttttccacttacctatcactgaatgacaaactaactcatacctttaaacagtaacttcaaacaacagacattttatgaaatctcatgaattgtaggtgaggaatttaggcagggctccgctgggtgatttcttctgccccatttggtgacaactgaggtaatatggtggtatctcagagagtggctggggtgggctggtggccccaggatggcttccctcacatgacccatgcaatggcaaggagggctgagctcagctgggcccctctttctgtccaagtagtcacagggcctctctcctggtccttccagaaatgtcactggacttttcacacagtgactcagggctttaaaaatctaacttggaaacttaaaggctagtcctcagaccgttcagattcaaaggaaactctcatccaacttctagcagacaaggtagcaagaaatacaaattaagaaagacatgctaattaacagaattattaaacccattgtgatacaccattcactcaccatgtgactgcttacaaagagggaaaaaatatggagccctctgttccaagggaacactcctttccccctcccgacacttcctagagatcttagacccacatgactgtgagaaagaagagtgatgtgagagtgaactttggcaaggctgaagtgccctggttttgtctggagcgagaataaaagtgagaggaaggaggcgtccagttggctgagaatactgttggctaagattctttagcagggtgggcttttcggatgcttttctcctctgatctatttaggtttatccttactcttttccatttatctgggaagtgacttgggtttaagagaaccaggagtatcttagcagagtcaaaagggccacggtgaaccccaaatgtcaggaaacaaggaactgactagattactcaaggcttcactcttgaggagggagagaaaagagctcctgcatttccttctatttattgattacagccacaaatggaaaaggaagcaggctttctgccctgaaataatgatgatacatcgggctgcagagctcctatacctataactctcaaaagcaaatggaaaggagactagcgtgtggctagtaccattattctcacatcttcctgcagtgttatgagagcacagagtaggatgcagggtgaggatagacagcagtagagctttcttgagctgcttattcctctccaaattctctctgaaagtggatgaagaactgctgccatgtctggtgtgggttcaatttgtgctctcattgcttctacttctctgtttctccagatcctaccatcacgttcttccttctgtggcttagccatttttctctccacgcttaggaaccatacatactatcattcttctacctctgaagcattatcccatccttctgacaaacatgagtagatgttttcccctcacagtcttgccaaaaagcacttataaagtattgcaccgtagttttcatatttcaaaaacacttcaacaggcaaaatgcgatatacacaaccccaaaatgctgtgctatgatgaatttagttctgtattggtaatactataaattgcttttgaatgaaagatacaatgtctatatattatttaatttgatacttgcagtaactagctatttaagcaagataggtatcagtcctctttagcgaagttcagtggaaccaatggaacaaacgtgtgggagtggaactggaactcggatgtctgattttgtcttaagttattttaatgacaagtcatttagccaccgataaaaagttacttattcagaaaattcaatcttctggacaagttttatttttacatgacataacctaaaatgttatatatgttaaattctgccgttttagatttcaggaaaacaaatgcagagtggtagaggctggtggtgagaatgagctgagaagggtggtaataaactgaggtttctacaacgagtttgcattaaaaaaaacttgttgggggttctggaacccaatcaattctcagatgtttccatagtctatttttatatagcataatacatttttattatgatcaggcaataaagcaagactgttcaccagtcttgctttagccatttaccatttcctatactctatgtatgtcctttgtctgcttttacactaccataaagcctgcttcaactttcccctcaatacactgagatttatttcttcactcaccattctggaaaattccttgttcagccttctaatcactagacacctgcaacctttccttcactggatttctgcctcgaacagtcactcttctccactaagatctacatgtcaccgctaaaatcccctttcttgcttgtcactttgaccatgatgtcacttacttcctgaaaatttcccctggctccctactgctttgcaggccaagtaactgtcacatttcgtttccactttcagctggagtcagccttcattattcccctctccgtccctgtatccttagagaccctctcctttgactcaacagctcactgctcttgtcttctcaaagctcctgtcttttcacacacagttcctgctgtcttttcttcttaaaacaaccagccattcgacagtctccaattctctgagaagacattcccctaaactcaccatcttcaatacttgtgtcatatctttgtgccaaattctaattcacttaagattttaactggcttactaacaaaatatactaacttaaaatgaaggttttatttattaccttaaatgaaacaccagtgtcaacggcaaacaatgaaaagtaagagcaaacgttactatgatgaaagcaacttgaagtcattgcattttaggtagatatttgtgcctgccccagactctgggcttgaaccctgctctgtcttataaaatagggagattagaaaagttaaattgttattaatgttctattaacacctacttgagactttcaactttttatagtaagaagaattgaaaaataattcacagagaattgattcccatgatgcgttcacctatgtcctgctcagaacacatctaggatcatttcagcgctgatagactgttcaaggagatgcagcctaactcaagaaaaattcatcatgctcctcctctttccttctccagttttgttcccacatatgaacattaaatgaaaatttatgaagttcctgctgagtgaaaatcactgctggataggtgaattccaagatgaaatagatagactttctggcctgaagttgcttactgttaccactgaatatatgcccataaaatattaaaatagacctaaatgccttttctgaggtctggaactctcaaagtgttgtgagcctccaatctaattaaagaactcactcaagtataatgcaaaatagaggatgaaaaatgccatacgaatgtatagataatgttttatgggagattagaatagagaaagattatttccagcttgtgcactgttaaaagtcattaggaaagaggtagaatttggaaagcaaagaagagattgcattgcaaagaagacattcaattgcaatgattatttctctgaagcaaaataagtgttcaagcccaatttaatgagcaattaatttttagcaatattttccacatgttcataatctagtaccatttgaaaaaactttctgatgtgaaaaaaatgtgatttaaatacctgtctcaagttctgaaaggcttcctcacatattataaaacaggagccctccctaatttgagtcaggttagagaaagccaaacataggtggaatatggatacctttactacaactacatttggggagtcaacctaatgcttgcttaatcgcttcacagaaagattgaggaaggcagtgatatccagtatcatcatagggctctttggtgccaataatctattgaggtgcttttcgattgtgagacgaccaagaaattagctgatcccagcagaaaaacagagctccttccttacttttcagctgcgttaatttcttctctacgtttcagagtactgctaattccatccactgatcccttctagggcctggttttcagtcctaggcactcaggtaaggctattctctagacacaatatgcatgtgaaacaaaaaaagagaaaagtaataatgacttcaaatattaggatctgactatgaaatatcagatcttttaactcttgtattcatgtaaccttcctacatttttcaagtgaaaatatttcctacattttttaagagacatcagtgttacgtgctacgttatcaatattattttcttattggccatggaaatgcttaaataattgacttgacttgttaaatctattttatacattgcattttaattacatttataattttaagaaacttcactttttagaaagatatagacatgaatacccttggtattaattagtagtagatgtccttacttctgatagcccttacataatgtatccctctctatgagtgctgtagatttttcacttatatctacaaatacagaagatataacttattaaaagttcaataggaataagtcctcatgttatgagagagtataaagcaatagttagagtgatgtgaaatattataactctgtcttctggaattattccttgaaaagattaattatgtatgcctaatgagataacagtgacaaggtataatttagagattataaagctgagaattgaaatgcctagcatgtgcacgtgcacacacacacacacacacacacacacgtaactgctcttttgcaaatcttcatcacatcaattgtgttgaatccattctcttaggctatacattctcatgctagcaaaatgaaaacttgaaagtaatatgttgaagagatactatgttgaagagattcccatgttgattgcagcattatttacaatagccaagatatagaatcaacctaagtgtccatcaacagatgaataaagaaaatgtggtgtatatatacacaattgaatagtactcagccataataagaatgaaatcctgtcattgtggtaacatggatgaatctagaggacaatatgctaagtgaaataagcaaggcacagaaagactaatatcccacgttctcactcatttgtggagtctgaaaaagctgatgtcacaaaagtacagagttattagtgactccggaatgtatcaaggaggggaggataggaagagattggtcaatgacataaaattacaattagacaggagaaataagttctggtgttctatagcatagttgggtgactatagtaaacagtattatagtttgtatttccaaataactagaagagaggatcctgagttctcaccacaaagaaataatgtttcaggagacggatatgcgaaagccaatgtacacatgtatccaatcattatgatgtactccatagatgtgtgtacttattgtgtatcaattaaaaacacaattcaaaaattgtcatgggtttgctctttttttttgcattacaaagtgacatctatttcttgactacatgctaggtgattaattataaaatggctctgtgcattgaagcatctctttcaagagctttacaacctgacttttgggaaagatacattgtatcttttgaatgattcaatagtgaaatttatttctgagtttaccattttgtgatttctgaattttttcactttcagcatttccactagtgttttatttactggttccacaaatcagtcagtttcatcaaatttgccaactgcaagcctaaaccattggaaattggcataatgaatgttctgagtgagaatatatatgttattaggaatattttaaatataagaaaatgtgatacaaacctggctgccaaaatatggcaaaaatgtaaacaaaaattgatgtgtaaaaaataccactgtatttaaaagggataaaactaatcagatagtattttaaagctgatgtcttgatggcacaattttaaattgaagtgctatgggggatattgtcttactggtatttgcagtttgggctcaaaaaaccagaaactatatctttaagggtgtttaacagaataattctaaatattatagttttctctttcctttttgttgtcctgtgattttaactttgacattcttatgtgacaattgaaaaagtctcttcacttttgtgtattctttctaatgtgatcaggagaattaaaatgaacattttctttcataaagctgagagttaattctgaaacgttgtaccagaatacttttatgaatgaaagactagcctttgaaccctaggagagtcaactctacaccaaccctgtctattaaaaaaagtctgtgcttacagatgtcttgtgtgagatgtggctttaccaaaagtatctgaacttcaaatttctcctatcactgccaactacccatgggtattggcaatatatttggtagacttatttcttctgtaggcatatgatgccatggccaaagtgaactctacatttttaagagaggctgctaaatatggccaatcacaacagaaaactagcatttctccaatttggcagtggtttctggatggcacacccagacttacttccttaagcaatgctgatatatggaaatgccatgatagaggctcagaagctaacactgaattcagcagtgcagaaaaactccaaatcatgtggttcttctttgtcaatattttcactaaggcagcataagatattaaatcacctggaattagttatgtgccatttcagcaaccttttgtgctcagtctgctacaagctgcttgtgctgattagcagtttaaaagtctgcaggggaaggaaattttcagtagcttgattttcccccaccctttggtcctgtgtgcattggggaagaaattaccttctgtgcaattcctgaataatttggtttgattattaatagattcatgctgaaaaaagaacaataacagaaaaaaaattacccatggggttgcagctgtgctcccagatacaaaacagggaaagaaaacaggtctctccaagcaaagggtatatgtgtatacgtgtgtgtgcatgtgtagctctgattctaagaagccattggttcatttattcatgcatcaaatatttattgagctgcgaacaaatcccaggcactgtgaggaagacagatttcctgccctcccagagttgccattactaagaatgttagccaataaataaatctttacgggaaagaaacaaaggactgtgatagaaaaaaatgggaggagaaacttactttagaaaggattatctgagaaggtgcctttcacgctgagccagaaagggaagaaggcaaacaggaaaagagccagaagagcagagttcccagcagaggggaagcaagtggagaggcggtgtggaggaatcaatttggccccatctggaatggacagaaggctagaacctgcagtgcagtgagtgtgggagaaaccagctggcacaaggtgagcttagggcagatcacataaggccttgtaggtcatggacaacaatatggatttaagtgcagtataggaacttcaaaggaattccaacagttaagctagttgatgtaatttgtgtctatatgtatatatatttatatatacaaacaaaacaaaccttggctgttgcatgcagagtagattgcaatggagaggaggaccagttggtattccgcaagggagataagaacagcttaggcttgaatgaggatgtgataaaggggattttatgagcaaggctgttttattattttatttattgtacttctattaagatgatatgggtgctttgggggctgttgtaaattataacccacagcccctgcacaggaaacctccacaggaaacaatcaaagaataagtggttgtgagatgacaaggtttacgatacgtgttttcaggcttcttaatagcagagtgattgggtgatttccaaaagacctcagggctgggatgggtgaaattttgtgagcttctggattggatgagggtgtgctcttgcagaaagaattcctgaatactttctgcactgacagaacctgcttattaattcttacagcagttatgttttagaagatgaaagaccctttccattcaattattgatcataagcatgatgtgtgttgattaaaatggcatgataatggtatcaaatggagtttggatatctttttccttaatatacttttgtgtatcatatttaagtttcctcaagtcagtagagaagatgttacccacatcctcttttccaaagaaggaatcatttgatcattgaaaggtttactgaatagaaaataaattatgttgactttagcacaaattcctgccctaagttttagcccatatattgatgatgtcaagtgctgctaaatgtgttcttcttctataaaaattaaagtttaagctttggatgctaactttcaaatctatgtgaaatgatatgatttattgtgatataaagaatgacataaagaacaaaataatacttttttaaatttatgaggaaaaagacaacagaaaggaaaaatgggcaaagaaagagaacacgtttcatgcaaatcaaaaccacaatgagataccatttcgcaccggtcagaatggttataattgaaaagtcaaaaagtaggccgggcgcactggctcacacctgtaatcccagcactttgggaggccaagacgggcggatcacgaggtcaggagatcgagaccgtcctggctaacacggtgaaaccccgtcagtaaataaaaaatacaaaaaaattagctgggcatggtggcgggcacctgtagtcccagctactccagaggctgaggcaggagaatggcatgaacccgggaggtggagcttgcagtgagccgagatcatgccactgcactccagcctgggcgacagagtgagactctgtcaaaaaaaaaaaggtcaaaaaataaaagatgcaggtgaggttgtgtggagaaaaaggaagagaaagtacactgttagcgggggtgtaaattaggtcaaccgttgtagaagacagtgtggtgactcctcaaagacctgaagacagaaataccattcaatcctgcaatcccattactatatatattcccaaaggaatataaatttttacattatgttaaaaagacacattcatatgtatgttcattgcagcactattcacaatagcaaagacataaaatcaacctaaatgcccatcaatgacatcaataacagactggataaaggaaatgtagtacatatgcaccatggactattatgcagccattaaaaaagaatgagatcatgtcctttgcatggacatggatggagctggaggctattatccttagcaaactaatgcaggacctaatgcaggaaaaccaaatactgcatgttctcacttataagtggaagctaagtgatgagaaaacatgaacacttagaggagaacaacacacactggggcctacttgaaggtggagggtgggaggagggagaggatcagaaaaattaactaatgggaactaggcttaatgaaatagtctgtacaacaaacccacatgacacaggtttacctgtgtaacaaactggcacatgtacccctgaacttaaaatgaaagttttttaaaaaagagaacacatttcagaaaaaaactcaaatggccaaaatacatactaagatagacaacctcatgaatagtcaggggaatgcacattgaaatcacagtgaaacaattgttcatctacatcattgaataatacttagtatctaaaagggatggactactgatatatgcaacaaaataaatgactcttaaaagcattatgctaggtgaaagaaagttacatactgtgggatttcatttatacgatattttggaaaaggtgaaattgaagggatagcaatagaatcattgtttttaaagactggggagggtggttgacgactgacatgatgggaatactgtgtgctgattgtggtggtattaataccccatctacctttgtcaatattcattgaattgtacctttacaaatttggttattgtgatgtatgtaaattaaaccttcaatgatctgattttaaacattacagtgaagtcaggagtggtggtatgcacctgtagttccagctactcaggaggctgaggtggaaggatctcttgagcctggaaattcgaggctgtagcatgggtgtccaaccttttgactaccctgggccacattggaagaagaagaattgtcttgagccacacataaaatacactaacactaacgatagctgatgagttgttttttttttaaaaaaaggtccatgcataatttttgtgatatctgtcatgccaccacagatatcaaagaagtcctcacattcaaaggattttacacctatgcatgtagaatgctataattgcacctgtgagtagccactgcactccagcttgggcaacatagtgagatcccatcacaaaaaagactcacaatgagaaaatgttatcatttattagactacaacaatgaaaatatgtagtacagaatcttgtgaaggtgttaggaaatgagaacgctcatgctctgttggtgtgagtggacagtggcataacctccttttagaggaggaatttcacatcagctagtaaagttgaacatgttttaacccacaccttcgaaagtctgataaacatttacaatcaattgtctctgaagcctactacctggaggcctcatctggatagaaccttggtctccacaaccatccttatcttaaccaagacactcccttctatcgattccaggtctttagataaactccttggactagttgccaattagaaaatctttgaatccacctatgacctgaaatcccacactcacccactttgagttgtctcacctttccagaatgaaccaatgtacatgtttcatgcatttattgatgtcttatttctccttaaaatggataaaaccaagctgtagcccgaccaccttgggcacgtgttctcaggatctcctgaagctgtgtcatgggccatggtcactcgtgtggctcggaataaatctcatcaaatattttacagaatttgactcttttcattgacactaatcatcattgtaaaattaagactatagtaatcagtgcattttgagccctcagttgttcaagtactatcacagaagatcgatatcaacttttgtttcagctccagattaaaaggtgagcctattagagtgtttatgtgtagcagaccctacacttattcaaagaatcatttgcttagatctaagagaaatctcatcccttttacttttaatatcatggtccttgtgaaagaccagacaaaaagtcaacccagttagttccttaaaagaggaaaagtagagggaattcgcatgagcaacacctcagtacttaacagtcattcaaggacttatgcatcaacagtacttggcatttcatgtaatccttccaatgttcttatcagttctgtgtgttcttaccattgaaatatagatgtgcacaccattgaaaagtttaaatcattaatttagtattaagttaacaagaacatagatgctacacctaaacttatccaagatattaatccattgtgccttagtactttattgactcaatttataaaaatattgtatgtgttcagtaaaaatataactacatttaagacataagtttgattttatgacttaggtttctgtaagaagcagcatacttttaactcaggcttatgaatataatatcacttcatctccttacaaagtaattagaataaaggcagcatatattttgtatgaactaaaaagaagtacaaaatattggtccccaaaattaaaatgtaagttcttaactacacatttctatgctatattacttgtattagtttcccattatggtaataaccaagttcctcaaatttagtggcttaaaccaacatacctttttctgttagagatctgaagtttagaagtcctaaaatcaaggtggcagcagggctgtacctttctagaagctctaggggagaatctgtttacttgccttttttttagcttctagaggccacttgcactctagctcacggtcctgttggagctcaggggaagctgccctcttgcccttggatggtttgctgaaaaatgaagccacaataaggcatgttaataagaagaaagcataaaatttatttacccatatgcatgtggagaatcacagagtgattacctaattacccaatcaaacccaaacacttatataacctcctttcagaagagcgggggtagatgggaaatataggtaattcctttgacggacattacatgattactagggaaaagtaaatggatccttgggaaaacgaatagatggacttgtaaatgatttggaagttgaatgaacttcagagacaggcactattttgtagaaaggctgtgccagttctgaatacattctttcactcctgtcttgaaatagataatgagataacagggaagggaaggaaaaacaattttttttttggtggatccatcctatttttatgaagatggggaaaagtctcttctaacgcatattgatttctaagggattttaattcaaagtattcattacttccagggaatcatattttggggtgaaattctctgtgtttttttagtgccatccttcatttttatagccagcagtatagcatcttccaattttcctttctttctgggctctgtcctcaaaacatcttttcagattctgaccctccagcttctcttgtgtaaagacacttgttatacattggcccacccacataatccaggacaatatctccctctcaaaatcctgaatcaccttacatttgcaaagtcctatttccaatgtaaggtaatattctcaggtcctagcaactaggacacgaacatctttggggttattattttaatcagttgctccaccctttaaactcttttctggttgatatatccataaaattaagtgacattcgggtgaagtgtcatcacccatcactatccctatctgatataaaacaatgatacttaagtgaagtgttataggaatacaaatttgcactatgaagttaatattagaagataaacatcctctaaatattatcttatggaggtaagatgacttttgtgtgaggactataccatcttttattcttggagtaatttactattcagaatgtggtcagttttggcacgttgtcagaactgcaactgtgtaaggaataaagaataagacctatctcagaaggttgttgcaattattaaataaattattattttggcatatagacttgctatgtatttactgcagttgttaatattagatccatgtgaactatcaaaaattgtattataattgtccaacaggttcttcttgcccactgcatggatagggcaaattcactgagacagcggtattacagtagagaaagagtttaataattgcaggcccagtgaagcagaaggactggatttattattactcagatcagcatctctgaaagctcagaggctaaggtttttccaggatagtttggtaggcagggggctagggaatgggaaatgctgataggttggggcagggatgaaatcataggggtcaaagctgtcttcttacatgaagtcacttcttgggtgggagctccaggactggttgaattagttccttggtatgagtcacagatcctggtggagtcagctggcctgcccaaatgcaagagtctgaaaaatacctcaaagactaatcttaggttttcacaataatgatgttacctataggagcaattgggaaggttacaaatcttgtaacctctggcacaatggctggttattgtttaactgtacctacatcctaatagagttcaggcccctcccataatcctagtcttgtggccttttattacttttacaaaggtggttttggtccctgaacaaggagggagtagtttggggaagggctatttttatccttgttttaaagttaaactataaactaaatttctcccaaagatagcttggcctatgtcgaggaatgaccaaggacagcttggagttgagaagcaagatggagtcagctatgtcagatttctctttgatatagtttgaatatatatctccgccaaatctaatgttgaaatgtaatccccagtgttcgagattaggcctggtaggagaggtgtttgggtcatgggaacagatcccgtatggcctggtgctgtcctcgtgatatagagtgagtactcatgagatctggttgtttaaaagtaggtggctcctccccaactaagtctctctctagcttctccttccaccatatggtgtgcctgctccaactttgccttctaccacgagtaaaaactccctaatgctcacccagaagccaagcagatgccagtgccatgcttgtacagcttgaagaagcatgagccagtgaaaactcttttctttacaaattacccggtctcaggtatttctttatagcaatgcaagaatggcctaatacatttattgtcataattttgcaaacgtagcttccctgttggctacatcaaattgagggtttgctaggatagaaaagtggaaaatatcaattaaacaactcagagccgggtgcagtggctcacgcctgtaatcccagctactcaggaggctgaggcgtgcagatcacctaaggtcgagagttcaagaccagcctggccaacatggtgacaccccatctctactaaaaacagaaaaattagccaggtgtggtggctcacgcctgtaatcccagctactcaggaggccgggcgggagaacacttgaactcaggaggcagaggctgcagtaagccaagatctcgccactgcactccagcctgagtgacagagtgagactctatctcaaaaagaactcaaaaagattgtgttaggtacttacagactagaagattatgttaatgaatcttttattcattcaacatataattattgcccactgagtatgtaacacgttttctgttatgtttagaaataattatgagcaactcagaatgatctccaccctcagagagtgtacagtctacctcagtatgtagatgattaatagacaaacaataagtgttgaatgttgcacaaactgtcctttatttgatccttagagttatatagcatatttaaacattttgaagtttgaaaatgcatacaaattagagagacatccaataaggtaggacttgggttaatgtttactttcctcaagcacgagaatagtatgtgagaattaagaattaattgttaaaacacatctttatatttctttatgagacaactcttgaagcaaaagtgaaagctggctcaaacacagttcaattacacagacgtatacacacacttatagtcacacacacacacaaaaccaccactgtccaggaactaaacaataattgtactcttctagatatgtaaaatcaagcgaggaacagttaagaataggttatggccaagcgtggtggctcacgcctgtaatcccagcactttgggaggctgaggtgggcagatcacgaggtcaggagattgaggccatcctggctaactctgtgaaaacccgtctctactaaaaattcaaaaaattagccaggtgtggtggcaggcacctgtagtcccagctactcggggggctgaggcaggagaatcacttgaacctgggaggcggagcttgcagtgagccgagatagcaccagtgcacttcagcccgggagacagaatgagactctgtctaaaaaaaagagacacgttaatcttaactttttttgagagagtctcgttccgtcgcccaggagagagtgcggaggcacgatctcagctcactgcaacctccaccgtcaggttcaagtgattctcgtgcctcagcctcctgagtagctgggactacaggcatgcaccactatgcccagctaattttttatatttttagtagagacggggttttaccatgttggccacgctaatgttgagctcctggtgtcatgtgatccgcctgcttcggcctcccaaagtgcggatcccaaagtaggattacaggcatgagccaccatgccaggctgaaaattctgtattctattatatattatataatagaatattttatatatatatacttatatattatataatatataattatacacacatatatattttttaattttattattattattattttttctgagacggagttttgctctgtcgcccaggctggggtgcaatggcgtgatctggggtcactgcatcaccgcaacctccaactcccggattcaatcgattctcctgcttcagcctcccgagtggctgggattacaagcgcacaccacgcccagctaattcttgtatttttagtagagacagggtttcaccatgttggccagactgttcttgaactcctgacctcagcagatccacctgccttgacctcccaaagtgctgagattacaggcgtaagccaccgcgcccgacctgtagtacctatattttttatttttctccaatcttttaatcttttaatcattctccaaaatgttgcctttcttctcaatgcttagcagacaatttgataaacaaggatccttttctaagtagacttcatataggagagttttcaaaacagaataagaagggcatattattccttgtcaaaatattttcttgttgaaaatggaaagtttttgctaaaagctgaaatgcatggcagattaatttatgcctattacttcaggtaaataatttcaccaggagtcttcataggtaaaatgaatgtttatgcttgataaaaaagtagcagttgttgatttcaacaggtttaagaagcgtaaatgttgtccacctcttctttccatcccatgcacatcttacttttactctagtaactaccacccatgaatgtccatctattaaacccaagcagagagtagtttttaaaatattcctttcctgttttctgttgaactattttatagacaagctatataaaaaagaaacacaaggaacaaaaaatgatatcttattctagtgaaggaaatccaaagttggggtctagaatacaaatacacctgtgtgcaagctccagtgatgccagttcctagtactggagagcattgtgactctgagcaaaagagggaagacaaacatatgaacagaaaacctcgtcttttctcaaacatcctcaatgactgttacatgaaaatgaggactatcaggctcatatcattttcaaagacaataggtgatatgcatgtggagaacaaatacaaaaggcatgcatagaaatcaaaagtgattaaaaatagtctgaattctggagacaatagcatgtgtggacggacagatgctacagatttaatgctgacatatcagagatgaaatgtcagctttctttattaccagtagctctcagcttttcaggcaaatcgttctttgtactctacgttctttctccttatggagttccttcttgatgcctcttcctacttcttcacatctttctactccttgagatacctgcactcattgcttgcacttctgttagtgattttgttacagtattgtgctgtgtgtttccaggagtggagccaaagtgaaggaagcccagaaatgcctgtcaagggagactatgagatgataacagcactcgtctttttccttgtgcttcttgcagttaacacccacatctatctatccatctatttgtgtatctctgtgtctgtctgtctgactatcgatctatccatcacccattcatctactcatttattttggcatacagcttttcgatagaggcaaacactgcctaatggaattgatctacaacaagaccatagctggagtgaaagaaccaggactcagaagttaaaaccaaagttaatgttattggaatgtatagtcttaaaaacaatatgttttttaaggacaattttaattcaattaagtgtgcaatgaaaacacaggggaatgtttgaagaatcttttatcttttacccaggtgatgtgcttttcgacaggattacatttagtctaagaggtagaaaaacgtcaccaacgacaccttaaaggcttaccccaaccaccagaaaaatatttgtactatttccttcttaaactttgcacaactttttatgtagatattaagtgttcaaggggatccctgcacatggatgaagtcatgtttgcatacactcagtgtaaatatgtgtacacacacacacacacacacacacagcaggggaaatatttctcaaatgactacacttaggttactttccatctctatttattttcttctgtggaataatgcagactagaactaacataaattgaatgctcatgagaccacacatcttcacatggtatagagtgtgttatcgcagcaattttataatggctcattaacccctgtgagaggccagtaatatgggatagcaacggatttctatcaactccatgagggagataagtaaggtggcatcttatgtagatttctaaatcctctactttgaaatcagctcaatggcatattttaaactcaaaatagaatgtcttctggttcctaatggttgatttaatggtggatttgaccatatgtgtatcagatgtaaaaagtattgtccactaagtggagtaaaaaatgatcttttacagaaggaaaaaaaaactgatttaaatctttagattctcatgggatctcattaaggttctctttctttaatacattgtgcagcctaatagttatcagcagccctgcggtgtgcattgctgataggttagtttacacaggattaattgtgtaattttgcaagcaaccagcacagtgaacactgatttttgcattagccccatgtgttgtttccaaggggactctgctttctattttaaggtggtgttacatttcacttcttattaattataatttctgctagcatgttttatgcccaatatgatttattaaaaatccttcataatgtttttttcctaattgttatgtccttcggtaacttcattaattttgagcactgatgtgtaaaaaatggcaggagaaaatggcattcacagaaggttctctgaccagccagtttccccatgcccccgttgataagttgccacaaatcttttgctaaaatacagacacaaattcagttgcagccactccaggtatgcgaagtgaataatcagtgcaggcaacaacctgacaatactacattcctcaaaccaaaagaatgcgaatgttcaaagaagtgttggctaagcagaactcagtccattttccacaatacgtagcttagtattttccagaaatacttgtgtattcggaagaattagaggaaggaaacttttgtttgaattttccacataatagcttagttcaatactcagctactacattttatcgactcttggtgggattatgaaatgcctattgaggtttcagtggaatctttatagctggacttgatattcttttacatggttttgaaaaaacaaaacaaaacaaaatgttgactgtgcacagtttagaacttaatctttaaattctttttgccttgaacttgaaaatcaattatctgtctgtgccccaccacctcttccctcatctcagccttcacgagataaaatttctctccctccggagcacatggtctctcaaaggggaagagtcacatctccttgtctgtgcagctgttgcttcgttttgtttagggtggatcttctctccttatccccgtgagtttctatagtattataaaggcccaataaggttctgtacaaagtgggtacttaaaatgtgtcctgagtgacaaactggcccccactggaagaactctttaaaacactctgttaccagagcttcaaaaagggcttgtttctgaaggatcaaaggatctcttgtataataaattctgagcattcagtacataatgaagagaagaaaacatgtcttttaagctcctatatgatgcctggattatgtgaagagatgaaggaagtggtgactctttctggcttttgtgtcattcacattaaacaggaatagatgaaagcaaaggcttaacactgacaaaatcccaagtaggcaggctctgcatccacagcctgttcacacattcataacaaaccaccagctgatgacttgaaaaaaatatgattttctttctagtgaaagactgactttgttttgtgttttgtgccttttttaaacatctaccttcagaaagtataaaccttttttttttttgacagagtgattgggttacaatattgttacagaaggactagaattagaatcacaatacttgggtgccacacttgacctttgtcacttgttatgtatgacactaaggaagtaatttagtctgtaaattaattttatttttcatcatttataaataaacctagtaaaatgaacatgaatagttgtttcaagggtttaatttaaaaatcatttttgtattgtggtaaaatgtagactcttatattcttataggcagattgcaataaaactctactaagcaattacactagattttatttctctaaattaaggctgaacaatctcttttttcagttccactttgtctgagtagtttgaatggcccagatcagagatgatttttgagactgttgttattgtgtttgatagattgtgctcatgaaggcacgtgcatatttatggagaaagaatccttagctttccccagatgctcacatgtgtttgtgatcctaatggggttaagaacccttaacctgataatctcaaccaattttcctttcacattaagtgggagtcctactattttagtattaagtaccagaagggtgaattttatatgttactttatatttactatcggttttgtctaacaggaattttgtgcagtaaaatatctacctttcaaattccctgggaggagaaagacaatgcatactggagatatgaacacttttccacaatacttataaaaaataaaaataattaccttggtgatttcccataattaaggcagatttttttccttcctccttcctctcctctcttttttacgttaacaccaccaccctcatcattaccactgccacttttctctcttccccttgaacagagtagataattgcatatgtacaatttcctagagaactgaagcaggcttagcccatagttgaactaagtttcaaagtttgcaaagtaagactggattaactatattttctgctaagtgttggttttaataaaaaaagaagtttatattcattgaaattttcagttgggagtacatgttttaaaaccttatttcttccttttttttttttttttttttgagatggagtctcattctgtcacccaggctggagtgcagtggcacaatcctggtttattgcaacttctgcctcctggttcaagcaattctcctgcctcagcctcctgagtagctgggattacaggtgcctgccaccatgcctggctaatttttgtatttttagtagagacggggtttcaccatgttggctaggctggtctcaaactcctgacctctggtgatccaccctccttggcctctcaaagtgctgggattacaggcatgaactaccacacccagcctagaccttatttcttaatctctgaatgtgtttggtgtgacactcaactatactttcagcttacctagcccaatataaattttattttaatgaatggtttccaacattttgactctcctcatgttaaaaaatctctggatttccttatatttgatttctgtacttatcagtatttggcaggaagacaagtcatggcaacaactgatggctgacgagacgttatgcttggaattcgtatattcatctccttaactgagaaggttttggtgtctaccattactgacctcactgtgaggaggcaccggagaatcatgatctcattctgtgtattggcatgtcattacacattattaatttggtcttttgagtgacacaactgtttttgtatatcggtgtgtttgtgcactgtccctggagctctttgtactaagttatttttatttcattttcattaacaatattttgggaattgtcattgaatttgtaccttttctaccttgcactttacaataattagcatattattatagtaaattagaagtttaataattaaggtaacatttagatcctgtcaataactatagcctactttattttttgaacgttttactatgcccctttgtaacagttttaggttttttaaagagtcattagagtcacttatttatgctctgctgattagctatttattttcacagttttacaagttagatgttcgtacttagatattttttacagatcgaagtttctatttgctcatgagtagctataaaataataattatcattaggttagatattttctgtgttacagtttgccatttatatattctcattgccaccctgtgagtgaaatgaatcagaggttgttagctccagttaaaaaaaaaatgaagaaagagaccttcagagaggttggctaaatggcttgctagtaagtgcctgagatggtgctgttctgttcatttaactttacattttagtctagaattttctctgttactccacttccttttctactcaaagacctttttataaaagaaaccagggagcacttaaaatttgttctctaagtttagagctggactcaaaccattactggcaaaatcaatctggtcctttctttcctccttttttttttttctttctctcataatgaatcaagacatccagcatccttgaaaccttaaaggtatctgaggatacaaagataccaaactggagttatcttcctgacacataaatctgatcttgtcatttcttactacaaatccacgatggtcttttacaagataaagtttaattatctgagcatgacacctagggctcttcacattctgtgcgatccaacttttcagcctcgtctctttttattatctattgcttgcccttatacacctcatcttcagcctccaaaatttcatgtatcttcttgactgtgccctgctcttttaggtttctgagttgcctctcttgcttttctataccagcccccaaccccaacaggaatgccattctttcatttgtagcttgctaaactgggtcacttacctaaccaaataactatgtggctttggagaaaatactgtttttatttcttagcttgtttattttgatgtaaaaaaatgtaacgcatgatcattaaaaatatatctattacattaagtcatcttcaatttctgcttaccactttcttcccataaacaatggtagcaagttgatgtttttctttctaatgttatttctcatgtagacattgatacatagtatttttcataagagcaaaattaagctcacattctataaaaaattttgtagtgctttatttcacctaatattatacaaagtctcagcattcaatattctttaaaaacacaactttttaaaattataaacttttctaatacataactatattctacatatttaattatttctctattattgggcacttaggttgtcacccaaattttattgttataaattacactcagtaaagatttttccattggtagttggtgatatattaatatgtttaatccaaacttagttagatttctagatctgggcatactggccaaatgaacataaaaatctatgttagaatatttaaagaagtcaaaatgctcataatattatgtagagataaatagcatatcatttttacgtatgtaatgtattcatacacatatctgtatgtgtgtatatgagtgtagctatagcactgggtgaatattaatatatcaattgaggaaggaaatacactaaaatattattttacagatgatgtccattttattaggtatatgtgtgtgtgtgtatatatatatatatgtatatatgtatgtatgtatacatatatatttgtattttaccaaatatctagagtgagaatttgttacttttagaataaaacaaaactcccacaattatccaccttaaccaattgctgtctcctacaaatcctttccaaccagacttcatgggtagaaagcgagtttctgctggtgaaagggtgaaactacttgaaaattatttattgtctcccaaggttcactgcagcatgagacgttacgtagttatcaagactaaaatacaaagacagccctgaaaatagctggggagtgtgaaaattagtaatatttaaagtactgaaaattagtgatatttaaaggaaaacagaaagtttagctcttggtttgctttgggagaggacgggactctgaagcccccatgctggtgaggcacggatcttggagggtggtcagaggttgaaagccacttgagcaaatactcagtccaaagcagcaggtgcaatggctcaagcaggaaacagagtaatatcctgagattggctatgtttagacaagttcctattttggggacacagggctccccattcatgggtgtgccttgagtgcagtgccagacacagaatagtcaagtaatatgttcttggatgaataaacaaagaccctttgtacaatgctctgggacagaaatgcttcataatagtgatgttaacatcttttcacacctaaataagcctaaaagacttccaggcagttttcacatgtatttcagtgtgacttaatgatttataattctttttttattactattattattattattatttgtaattatactttaagttttagggtacatgtgcacattgtgcaggttagttacatatgtatacatgtgccatgctggtgcgctcacccactaactcgtcatctagcattaggtatatctcccaatgctatccctcccccctctttctaaacattattaaaaatatttgtgtcactaatcttgcggccataaagaacaagagtttgctttaaaggtgtactgatgctgcgataacacctatggcaatatttaaggttatcaaaattataaagctccatcctggagaaatggtcatgtgacattaggcaatatgtaacttcttcatgccttagtttggtcattgttaaatgaaggacattaaaaaaaaagcaaaaccgtatctacctcatgggttgtaaggataaaatgagttaataaaatgtaaagcacttaagagagtgcctggcctgtagttagccctgtataaatgtatcccattatcattaccaaagaagcttgacattggtattaacttgcccacaattaactggtgtgatcaggcattagttcaaggtggtatctgaggttactatcagatacattttggactatataggaaaacatagtgcttctctataaattgtttgcagaattactaccacaaattttaatggccttctacttccaggggaggccatctctatttgcattagaaagtaatataaagtcagaactgggtcctatttgagatctaaaagattatctatttgacttattcttaacttacaacattgacatttttgcttattgctttcaagactgtttcaaacatgatttctttcggtatactatctttgacagtagtgagaaaacaagagatgcctctgccgtcatactccaaggtgggaaacagaggactagcacctccagaagagggcctctggcttctgggaggtggggcttttaagtttcatgatttggtattggtgctgggatctgagttttcaggtttgactatgcaacatgcttgaaacatggcctcaaggattgtttggctgcctcagcattcatggtgggaagaccagcgtctgaatgataagagatttggaccttgtgtggcagcatttggtctcaggccctgctccgcctgcttgatattctactgtgatgaattggctatagctggtttcccaggagctttgtcatatccacattcgactgcagaaaaaaaacaggagttaactaactttcccaaagtgacacagctagtaagtggcagagcttattcattcactcaagaaaatatttagtgatgacctgttttgtgctacatgctggagctggatgaaaaccccaaagtgtctgagtgttactgatatcatcaatcagccccaggtccttctaggtcagccttctatagggaagggaagtgttcttgagaatgtgtcttggttctccatgatgttcttggacagtagcaatgaaatgcatatcctcatttctatgaataaactatgcctgcactggccaaaaatgtgtctctccgtttttggaagctatttatttctttaacatatatgatctattatagtaatataattctattgtgtacgatttgccctcaatttatttctggaggatttcctgtcttccaagttgtaacaggccaaggttgtagaaaacattatactgacattttctgtggcccttaacattttatttcagtctatctattctttgtattcatctttccacactaaagatttctaatgtttctaatcttcctctgtgtgaatcccatggccccagcctcttaaataatgtagtgcctttctctgtacctccttcagtcccattattagagagtttttaaaaaataatcatagacttttagggcaaaaaaaaaaaccttgtaaatagcattcagttgaaattctcatgtcgtggataaggattctgaggccccagttagttaggaaacacgtcattaatagggagtgttactgacatagcaaggaatcaaactcgttaggacctctgacttgccttggaatgttctttgctgatatctctctattacgctgttggcttctaatatggtttggctctgtgttctcacctaaatcttatctcaaattgtaatccccatgtgttgggggaaggacctggtgggaggtgattggattatgggggtggtttcccccatgctgttctcatgatagtgagtgaggtctcacaagatctgatggtttaaaagtgtgtggaagttccccactcactctgtctctctgctgccaccatgcaagatgtcccttgcttccccttcaccttctgccatgattgtaagtctcctgaggcttcccaagccatgcagaactgtgagtcaattaaacctcttttctttataaattacccagtctcaggaagttctttgtagcactgtgaaaacaggctaaaatacagcctcctttagacagttgaatatagcttaaaaatagtaaaagactgaggtataatcagtatggagtccttttctcaaagtattttagatgagtgatgcaataagaaagagggtctactgtagataaaggcacaggccttgaggttacacacattaggttcgtatcttggtgttgacatttattgtcattgtaactttgtaaatcatacctaacttaattgaattcgtttaatcttatgtaaaattaaagttagtggtacccacattaaaggtacttgtattacgtgagattatactaaattattaaatatgacatctgacatataatctgtcttcaactgatattagaaaaaaatcacatatgatgtttagtggagagtcaatatctgtgatttagtaaagaaatggtaaaactcgtgatcagaaataggggctatttctatttagaatgctctttcagaagtattcttagaaaaagttgaacatcttcacattgcctatataaggttttgctgataaataattcccaaaagccaacattaacaaagtatcgtattttttctagttcttactttattgtacatcattttatgttagacatattgaagaatttctgtctgtgtgttcatttttgcagtactagtagcttataacctagggaatattatgtgcctcatgtatcattttcctttttaaaagatacagtcattcaaatttgtattgagtattttggcacacattttgagggtctgggcctccatgatttgaatcaagaactgattcctttcgggtaaatgttagctgatgaccaaaaaagaggtattttcaatcccagtttcttaagaatattgacctaaatattgactaaaagctgaggtgctcacagccttttctagcaatttaaaaaatcactcaaaacctccagtgtttaaagatcaattgagatcagatacattttttaaaggaaaaaaaataaaaaaaatagccagttttgatctcaaatgcatacacatctatgtagaataggcattttttgtcaacatatgtgtattaagcaaccaatatttggcaatctgacagcaattgtgcttgagtactaggaaggcaaaaattaataagatcatttttccccgacctggacttaaggaactcaaaatcttgcataaaacattgtaaagaaacccttttctggccaggtacagtggctcacgcctataatcccagcactttgggaggccgaggtgggtggatcacctgaggtcaggagttcgagaccagcctagctaacatggtgaaaccccgtctctactaaaaatacaaaaaaaaaaaaaatagctggatgtggtggcgggtgtctgtaatcccagctactcaggaggctgaggcaggagaattgcttgaacccaggaagcagaggttgcagtgagccaaaatcgcgccattgcactccagcctgggtgacaagagcaagacttctaaaacaacaaacaaacaaaacaaaacaaaaaatcttttttttttgtcttgtgagaataaggcatgtagctgctcacacatgtagcttatatagcagctgtcaaggttcatatgctaccacgtggggtactgtgtgatttcctcctgatggctgagttgagtggggactgtcaagtagggggaacccggagactgatctcaagtgtccctcccggcttcactggacatcatcaatcagaacagtgatgtggctgctgctaccgcagctgccccttgcttatcacagagcaccggctagatctcagcctagtgctaagcaatttttgcatgttagtaccattcctccaagccattctgcaaaacagatactattatcccttatttaccaatgagacaactagagttctaaaaggctacttgattagcttacgatcgcacaacaagtaagtgcacacttgctccgttttcagtctgtctgtcccttttttctctgctgcagcatctcttttgacagacactgtggtggtaatgtgctccctcctgctccatgaagctatgacattcatacttgtgactgtaaggtgaaggaactatgaatactactattaattgatatgtgtagctttaatgcattcattctttaattcatctaaacagtatatatataaaatatatatattttaaaattattttttcataggcttttgggaaacgggtggtatttggttgcgtaagttcttttatgctgatttgtgagattttggtgcactcattacccaagcagtatacaatgaacccaatttgtagtcttttatccctcaccccactcccaccctttcccccaagtccccaaagtcattcttatgcctttgcatcctcatagcttagctcccacttaagagtgagaacataggatttttggttttccattcctcagttacttcacttagaataatcgtctccagctccatccagggtgctgtgaatgcggttaatttcctcctttcatggctgagtagtattccatcatatatatttaccacaatttctttatccacttgttgattgatggacatttgggctggttccacatttttgcgattgcgaattgtgctgctataaacatgcatgtgcaagtaccttttctgtgtaatgacttcttttcctctgggtagatacccagtagtgggattgctgaatcaaatggtagagctacttttagttctgtaaggaatctccgtactgttttccatagtggttgtgctagttgacattctcaccagcagtgtagaagtgctccctttccattgcatccacaccaacatccactattttttaaatttttttcattatggccattcttgcaggagtcaggtggtacagagatgtagttttgatttgcatttccctgatcattagtgatgttgagcattttttttcttatgtttgttggccatatgtatatcttcttttgagaattgtctattcatgtccttagcccactttatgatgggattttttgtttttttcttgctaatttgtttgagttccttgtagattctggatgtcagtcctttgttggatgtatagattgtgaagattttctcccactctgtgggttgtctatttattctgctgactgttcattttgctgagcagaagctctttaattaagtcccacctatttatctttgtttttgttgcatttgcttttgaattcttggtcttgaagcctttgcctaagccaatgtctagaagagtttttctgacgttatcttctagaatttttataggtatcgggtcttatatttaagtccatgatccctcttgagttgatttttgtataaggtaggagatgaggatccagtttcattctcctacatgtggcttgcgaattatcgcagcatcatttgttaaatagggtgttctttcccccactttatgtttttgtttgctttgtagaagatcagttggctgtaagtatttgggtttatttctgggttctctattctgttccattggtctatgtgcctagttttatacaagtaccatgctgttttggtgattatggccttatccaaagagtatatattatgttttattatggtgccaggcagtgacattggtacaactaatatatgcccttatggaactcaagatttcttatgttaaatacagaataaaggaagtaggaatatttatagctgttaggcctttagttaattttgtctagatggagtttcaaattacttatgatttgttgtcagttcagtgcataaggagaaatttatcttataaatagcttagaaaggagtcatgtcataaaatgacatgtctcaaaatgtcttgtgaagccaagttttcttccagcatggcaagcaatcaccatttctcttgctgagcatctaatgaagtcataggtttgatgtagagggtatgttgtgtgaaaagtactactttgaaatattagataacttcagagtcacaacatgctcatattcagaaaacaagtgaccctgacttccgctgatccgcagctctcatattacaccagccatgggtaggttgtttgctgagtgtaccctcataacccagtttttactgtatcttgctcttcagcaagtgctgtttctccttccagtatacttctctctggtttttttttttactttgcctcaagtcagtagagtttaatttaactagtttttttgtgcatatactatattttctttcagtcatactttttaaatcttagttacaaagcacacaaccaataaggacccaaatgttgtttcgccttaaattactttctttttaatattttctttttaatattcctctccattcttgttttacatttggtgggtatatttatttgtatctcttaagtaaaagaaactaagggactttgaaaaaaaaacaacttttcactaataacagagaataagtaagacgttagtatctatgtcaatggtggtgagggaaagggtaaatgctttctagagtaaataaattcaaaggattgtatgtcatgttaatataacaaaaacaaaattagaaagacgttttcttagattatagtagtgtattgtgtatatacccttatctaatagtgtttgagtctatccctccactatatgtatatcctaaattgtacagagacactagtatgctaaaatttatcataagaaaagattaaaaggagagaaatgtttaaaaatgagatgaaaaaccataagtacatgtgtgtgtatgtatatatatatgtgtgtgtatatatttccatatttcttgtttcattctaaaggatggtctgtgcatctctttccagagatcatgcacctacaacatgaaggaatgaaagaaaacctaataatacagagactggctgagcgcggtggctcacgcctgtaatcccagcactttgggaggctgaggggggcagatcacgaggtcaggagatcgagaccatcctggctaacacggtgaaaccccgtctctactaaaaatacaaaaaattatcccggcgtggtggtgggcgcctgtagtcccagctacctgggaggctgaggcaggagaatggcttgaaccagggaggcagagcttgcagtgagccgagattgtgccactgcactccagcctgggtaacagagtgggactccatctcaaaataaataaataaaataaaataaaataaaataatacagagataattcttcatttacaataaacactaagaacacatgcacacaaacacacacacacacacagagagagagagagattagattagtagcaaggaacttacatacatgattaatgtgaatgccttctgaaccaaagctgaaggaagcagatgagagctctgtgggcgtaggctgctgctgtgagcatacaaataagtttgatcatagctacagtctccatgcctaatgtcaaacaactgtcttgaaaatcctaagtgagagtggggtgggtaattcagcacaagtactgatctctgttgtcatgaatgtccttgacagtggtaagaagtggggacccattgggaagagccacctgaggtggcttcatgacatgatggattttgaagagatgtcttagacagatctaatgttagaacaataaaagtggtaccatggctgtaggagatcctgaatgcatgacattctttatcactgggataaagaacattctagattaagtcatgtaacattcacctcagcaaatggaacagcagggtcagcaaatctcattttgagtcaacaaatgcaaacattgcattatttcttttccccactgagagactgtcgtaacacacataggatgctggacacagcaacatgggagccaggttctgtactcttctacttaggtaaacttctgtcagcccgcagaagtcagtgaacacaattatattaaaacaatgtgtaccatggacccattggtcagaagccatattaaatgcagtttcatgcatggttagtcatccataaacatttctgcttgtaataataatgcggtcagaagtaggccttgtggggctgaaaagaggttactaaacaaaagtattaaggacacagtctgtgcagtgtgtcacttggtcaactggaaagcagtgacgacttttcttatacttgccagggtggaattcttctcagtgtattggtgtgaggttctctccggaggcattgcaatctgtttctaactacttggcaacagcttttggaataaggccaaaaagattgtcaaataatacacagagtggaaatgagctgtttgaatttttcagccatccttccttttcttagggccaaagatgtagttttataaatctccttaattagtaatttctaccagaatgagttagaattattacatggaatttagctcttctgaatgatgttcagtcattaagttatgacagctggtatgcaaaaaaatgttgacttattccaatcgttctgatgcctaatagaaagtagagttttttaaaagcatgttcatgggatggcattcaaaaacaagcttaagcaatctttctgagattgggagccaatccttgagacacctgggaatgaacagtaaaaggattggatatattggttgaatcagtctcctcatttcacatgttgatgttttaagagataggcggcttggcaaaccatggtgagagatgacctcttgagttgaaggcttatgttcactctgtagttcagaggtctgatctttcaatgcttcctgacgaagctctcctcgttttggtccatatcgttttattttgaaagattagtcacagcatcagacagatgcaagtagctattgtgccagacaggtcaggagaaccgctatgtagaaatgcttacagttgtggtctgttgcaaaatacgtgaattcatgagagaagacacatcgataatgttttcaatgagaagtgtaattacgtggctgctttttgcatgcctgccctctctcctccttttgttccttgacagaaattcgcaggaccccttttttagcaacagagcaatactatagcttaggtatttgagtggaaattttgaggggtgtggggagaaagaaaaattaaatccatttttttaaacagaaaatgtaagaattaatttaaaagtgactcaaatgataattgtttccaaaattacaactttctaatctatccctaggtgctgtaaactgcaaaccataatcctgtcttaatactgcaaacaaatcatagtggaactaaggggaacttaatttactggtaagagtattttccttaatcagttgttttatgcatttttgattgtatttaattattgcagtacatagggcaggagtcacaaaagataaggataaggagacgttgcagaacttttgtcttcactacggtcttagcgtagatatggaccagatatatcatatagtgaaggttttttttgttttttgagttccattaaattgctggtttatttttgaaagagcaaaacccttaccttaaagttatttttcttgttggctgacctgttggcatatttgaaagtggcatatttataatatttatcaaaatgtcatttttaatagaaaaaaatagtttcaccactgagatttgagaaggttgacttctaaggaggcttgaagtttcagtgagaaaacctgtattttcagggggttaacagagctcacgcttcatagtctgaacgacttacagcttcagtcactgttccttgaatttgaatccgtttgaaatctgacctgaatccttgattggagttttttcaaattctttgtgcaacaccaagctgaattataactaatttcaaagagtttggaacaataagaaaagttcacattggaaggagggccaaacacacagtgatgtagttctaggtaagctgtttagctattttgatgacccattttgtaaatcataaaactggaataatagttgtaactgcctacaggtgcagcctaaattagattattacgataatgaatattagcactgggtttggtccatagcattgtgtttggttcagtaagtgccaataattagtatcacgactagtttttaaagacaaaataattggaggaaaaacaaaaacgagtaatttttttctcaatgatgaaagaatggttttcttactttctcaggagcacattatgtcaccaagagaatatgcactccagaagaaataagatattacttggtgcatgaagaatttttttctatgcatttgttgcaaatgggaccttaatacaaatataaaataatgaagaccatgtggaaagagatagaaaatcttggctttatgggttactgttagcatacctggttcctggtaacccccagcggccttctaaatgaatgcaggccataccaagaataagtctatgaagaaactctctgtgctttgaaaaacatttgatctcttctctcatccactggagtggttttgccctccactatttttagatcttcacttgggaactttctccaagaggggttctccatacagactttctaaccacagggcatctgaaagtctcttgtaacattaaaaatggtttgaagtatattctaatatccttagagaaaactcttcccaaaacctgattaatcaattcctttgatgatgattgtgtgggatacatttattccattaaaacacttttatgatttcactttaaatgaatttctagttcataagaaacataggtaaatcttctgagatagtaatgaacaaaatacaatacccagggtattaaattttaaaaaagagattatcatactactatgagaaactgtaattgtggttgtgtcatgatgatgtattaataattatttctcttgacattatgaaaatggatggtaacccgcaaaacacccttcttgctcgtagccctgcattctttcctgtattttattgaattatgtttatttcttgtgttcctcttggtgattgatgaaatcattatttaattctacaaaataagttcccttaccgtcagttttcattgtgctagggaaatcagccatcaggttccaggaagggtttgtggaatcgtagtcataaaacacccatacccacacccacacacaaacacgcatttacctaatcttcatttttcttttcagaatctcttgtttggaaatttcctcccagaatacccaacctctcaagaattttaaaacgatggagtaaaataatcttcaagctctgattagattacaacatatgaatgctaattttgtttttacaggtttcaacacccaaatttatctgaacttagggcacaataagcagtttaactgttagaaatcttatgagattgagtttgtgcctatcagatgaatacatatttgtatataacatttcaattattgctacatttatgtataatttatccaaaagcgatgttatccatgcatcttaacagaaggcttaagtagttgaatgacagggactacatttttgctgcagaagatcatgataaaacatgtgctgtgtggtcaccttgggtaatgtgccgagactgcttgatggtacttatctctacacactgcatctcatactgatttatggatttggatgacttattttatgtcaaagacataaagagagtagagaagagagaatagtattttcatttcagtcttaaaaaagttctatcctatgagatgttaacagctgccttctcttggtggtctgtgaagtttttataaagatattgattattttccaatgacacacaaatctactgctagagaccattcaaatgcttagttacaccagggcttggctcctgtaccctgaggaggacacgattaaccaaatcctcctttttaaatgttctcaggacaatgagctgcacatacggcacaaatgcaatttgcttgaccaatcttgcctctgtctccttctatctccgtttacatgcttcatgctcagttgaaattaattctctacacattggtctcatgaacacatctttgagagcagagttcaagttaaatttttattttcatcattacctctgagaacacaatctggggcatattagacgctttgtaagtgtagaggtggggagaaagaagaagaaagagaggaacagaaggagggaaagattttcctgatagatcactttctggacactttctgtgctgagaagttctgagattgcctctctggatcctgctatcttggcagtcttgctaagagtttccatttacacttaaacatggttactgatgcgtcttaatgttgccttaactatcaggtttctgatagccccacatagccaagtgggaccctggtcaagaagttcacctctgttaaataaatatgcatagattttcaacatctcttcacatgcattcagaggtgatgaaagattccactggatgctagaacattgtgcataaataatcgaagttgtatgctcttcagcaatgatgctaccccatatcctttttttttctttcccatgatatgaggatatgagtgcagcagaactagctccatgcccttgtcccagaattaatcattcctatccatatttgatgtctttaccttttaaatatttatgggctgttatgttcctttcttgttgttcacccactctggggacattcagaagcctcacatttcttccttagccaaacaccccattcccttcatcctctctcagctgttctttggattacctccaaattgcatacataattttggtattgaggtgccaaaaatgcatttgtttcaactggagttttattgaagttgcttttactcaaatcaagtacacaaataaatttgatttccaaggcatgaaaattcagttaggtctccgaagggaagctgaggtatacttatatttcattataatgctacaggtagattttaagtcactaggaaaatgacatctcaaaatcaaaagattatagaatgagcactatatgaagaattacattttaaagcataggtctgtgatcattttgtaggtttttgttgttactgtcagtctattggtttttattaataattttattgaggtataactgatacacaaacgacatatttaatgtgtacaatttgatgagtttggacatatccgaggactcatgagactgtcactgcaatcaaggtaataaatgtatttattacttccaaaagtttcctctgtccctctgtttttgtttgtaagattttaataggctcaagctcaatcttcatagcctttttttaagttaattttttctttctttccaaattcagaaggcagattcatttcatcaaaagaaaacagttcctcagttgctactgcattgcagagaaaagactgactataatcaccattaaattattaaagaataaaagatactgaaacccagcaaaacttgggtgatctctttcataagcagacacttttaatcttatattgacatttaaaaggactgttcaagtagcaacatgacagactgcacatataaaatgtccatgaaaatatgtagcacagctaaacaaataactcagagcaaaatccaatgaaaggagaaaattgtgtttcctcaagaaaatgctatttttgccctaaggcaattcttgctggagaaaaataccatgtaaaacattgacacaaatcacagacatctcttctaaacagtggattttattggactgcacacgcgtgcagagatttggcagatatttgaggtcttggaaaggaaacaaaccagcgaaatatatcactattatcaccaacacaactgcagagggcaaagagcagacacatctcagagcctagtgatgaagcagggcattaaaaactaaatcaaagcctctgatcaaaggctaatttagtctgtcataattgacttgcagtggaaggaagcctcatgcacaaagatcaaagattagtgacttcacatttaccacaacatccccaccctaaaggagggaaaaaaatcagaaagaagaaaggggaaaaaagaagaaacatgtcaaagctcactaagaaccctgtgcaatgtaatctacctttcttaaggatagcatgcattattagaaaaatgaaaatgaattttattatggcatgtttgagttctaccttcgaaagagtgagaaactggcactattggcttaagtaacttatttgcaaacaggcattattaggcagtgccttttgctgcagttgcttccctttatttgtagcccttcaaatgcatacattaagattctcttcacagttgcaaacagcaggtaaataattgtatatttgagagactattgcctattgaatttaagttggtcacagactttggtccatggtaacatactaattgttaacttcctgttaaccagttatatcaagccttatgtaatttttgttgtttcagtacatactgtgaatatagccagctccctaactctgtatgaatattatatggggaggaaaaaatcctgtttctctattcttctaaaatctgtacctggggactgtgaattaaactaacaaaagacagattaataggaaaaaaaagcatactttttttttttgagacatgtctcactctgtcacccaggttggaatgtagtggtgcaatcatagctcattgcagctttgatctcccaggctcaaatgattctcttgccttagcctcttgagcagctggcactacaggcatgcatcaccacacctggctaattttttatattcatagagatggggtcacactatgttgcccaggctggtcttgaactcctgagctcaagcaattctcctgcctcagcctcccaaattgctgggattacaagccacaaattttatttgatattagtaatttaatttttacatgcggagaggatgtcatagtaaagaagtgaaaatcaaaaaagcaattagaccaggtttgtatactattttaactaagggtgataaattgtgtagaagtgacaagacaaaggaaaagagatttaggcttctaggagcagttaattgtgagaagttaagtatatgggcaaacctagtggaagattagggttatttttagtaagatttgtctgtgcagatctatctcagtactgagtttctatctccagtgatagtggttgtcctcctggtacagcagtgggaacggggaagaccctcacaaaaggaagtgtatgtcctccttttaggcctatagtggggaggcaaagagctctttctgtgtttgctgcttgctgactgccttcagctcaaagtaaaccttattgccaaagtggcatattttggggtgtcatattctgatctctttcagttcctatttattatattctcctgtcattatgctttgtatattttatgacattttaaacctgtgccatgtgtaaaatgacagtgaaaaggaaggtaatcctcttatgaaatgtctttctagttgtctaattatagggtgccctattagtttgtaggaattaagcattttcaaaggcatttattcaacgattgtttttgtgtggctgttaagagccacagggttgaagatacagtcgcaaagagagacacagttcttatcctcatgaagcttataatcttataaaggcagatatgttattcaagttataatgcaaacaaatgtaaaattgctgctctaataagcgccagaatatggtgatttgacctgtggtggtcagagaaagcttctctgagcaacaaatgcctgatcagagttgagaagtaaactaaaccagaaagtaagactagaaggatccatttgattgggaactttattagaatgctttcatttttcttgagatagatgtggaatccatctgtgctggggaggtaaaaaattagtccacctctcaggcagaggacagacagtgctgtagataatgcactgagaatggattttagttccagaaaaatatgagttccagctttaactcagcaacttttcggttgaagatttggacaaactagtcaacctctctgaacctgaggctgctaatccgtaaagtgggctcataatccttatctcagataatcatctcaactactgtttgttatcagtgtcatcaacatagtgctgatttgcaatgtgatcttaggcaaaccattttatctctttgagtttcaatttcacacttctttaaaatgggggatgttggattaaatggtttcaagatttctttcagctctacatttccatgattttgcaagcaaatgtaaagctggaaatttctgtctagatatcatgggaagcctatatcctggaaagttagaaaaagtgttgtttttggaaagtagactttttaaaagaggcataattccacccgttagcgattttacttatatttctttaatccacacttagaagtttctattatcttagattcaattttatagcacatatttcttctactaaaaagcctttaaagtgtttcagtgggatgtttaatttcccattatggttggtttctcaaatcattccttttgtaattgtcacatttttacagtcctgtttaaaacaaattcagtttttcaactaaaaatatcaagctgagttggaaatcgaaatccaaggactgcaaaatcaaatgataataaaccaaccataaggttaaactttccaaccaccacaaacttagagaccaccagaaatttgtgttacttgtttcttataaaatatagaataatcttttgaagattcttgtggccaaagtaaaattttattacatttctaaatctagaaaagggaaaactatttttaacaccttgttacttatttaaacataaaaatatttagtttgattggagcctcttcttgactctattcatatttcacttaaattactattgttttagctatacaaagcctgcttctgattatatttatgttaaacatttaatctttctttgtagagccacagatttaagaaagcatccagatatatatatatatatatatatatatatatatatatatatttctattttggtattttaaaatctcactcatgttttgattaataaatattcttaagtgctttcatatttatctttatttttaccttaggaaacacatattgaatatattaaataggtataccaggtgctattgtccttacgttataggttagaaaactgggccattgatttattcaagttcgattgtatatttatcgagtgaaaattagatctcatatctcatatcttctaacttcttattttgcattgccttactgattttccaaggtaaggaagaacctacccaatcaaatgaaagagtgctgacatgaattaaatctggttaaatgtctgatggtctgattgtcctcaatgattatagcattcaatggtattttattttcatttacccttccatttgtttcttataatatttcccattttgttagcctatgtatagatacgcttttcattagtgaatgtccaattatcatgctttcattttgggtggaagactgattagcatggattaattaaggtaattaaataattatagttactgtaatgtaactatatagaaatgaacattagcatggcctaattatctagtatttaggaacatatgctttggagaggtgatttaagtgggcttgaatttgaccttccatacttactagtaatgtgtgcttttacaagttacttaatctttatgagccttaatttctcatcagtaaagaggagatagtagtccttacagagtttatttttaatagacacatttctataattgtactatattttacacatggtaaactctcaatattatgattaacaatgcttttattgccctagccatggctgtgatgtatctcgttatgaaccaattatgctcccttagcaccatagttatagaggatgggacagttaatgcgagttaggttgtttagagttcttctctgaggagttattgaattgatgctgaagtaacagagctggtatcagagaattataccagtacgtaagcaagaaagaaacaagaataagcaagaaagtctcagaggtgtttgggtttctggatccaggggtccctgtagctggttccctctctaccttttctgtagtttttgtatgcgggccaataaagttccataacttgttagtttagcttagtttgatttgggttcctgtgacccactaatgtaatccaataatacaacatcttaaagacacatttctttgtcttcaagttaacatgtattactcacaacagtatcttaatacttatttatttatatgtttattttgtttctcccaattactaaaatgtaagctctatttgaacaaaaacttgcagtactctttcttcagctgttggaaaacctctaccacctactaggttctcagtaaatattggacgaataaatggataaaaagagaaagaaagtgacacttttctaaaagtgctcctgaattaaaattgcatctgtatttcttcctgaatagactagaaaaggacacaaatttaacatttattgagaacttacactgagctagccatcatgttagatattatatacattttgaacttgatgatattatctccattttacgaatgcacaaatggagggacaaagagctaaagtcaaattggtggcctcctggttctctgctcagaccgacctttgagaaccagctgcttccccagctgctgggatgtgtccagtagctagcacttaacatgttagccctgctttagggattgcctcagtggaagagagtactcctttgtgcaatgtcatgtcccctttccagggaagcccacatctaatgcctataaaggcccaacaccatcagctcagctctggacaactcctgcttccgaacacccctttcccataaattgatctcacatccctcactaataaacaagactcttcttcccagggaaaccaacctgctatggtaattttcaaatatctctgcccaagctagtgacatggcctctctaaggaggtaaagtgggctgatacccactgaaactgggagaagtatagttccaaggtatgatctgagaaagggctaggtattttctagggtcttaaagataggttttttagctgggatacagggagcttgtgatgagatgattgtcagggcagcagacatcagactatgcagggccttataagccacgtatcttggtgcttttgtgctgctataatagaataccacagactggataccttgtggatagtagaaatttatgtctcacagttctggaggttggaaagtccaagatcaaggcatcagcatctggtgagggccttctcgatgcttccttcagagtggaggtagccatgcctcacatattggaaagtggaaaggcaagctagctaaatcctgcatgaagcctcttctaaggcctttctgagggccttaatcccattcatgagggaggagcccttctgacctaatcacctcttaaaggcccaccagttaatactatcacattgaccattaagtctcaacacttgaatttgggaagggatgcattcaaaccctaccatcatgcaaagaagccaaagttatatttcctattgtccctaccctttcctcagataccaggatttgcctatctccatctctagctacaattgttctgaattttggggcccgtttttgctgcatgaatttgtatttgaattcaagacttgaaagattaattttcctttcagaatgttattcatataccccttcattcttaacctgctcactggtttcctaccataattacagtctcaaacagtggttgcattctggcaaaacgatgttttgagttagagttgttatgcagttagtcagttgtttgtagttaaaaagtctctttcttattcactgaaatgactggagtcccagctgctaggattcaaaggcaacagggaagacttcctagagtttcatgtgatcataaaaacctttccagacgttttaagtgattatgatttctatgctgcattgacttacaattagagatcattcaagtaacttagaattcagtaacttctaggtcacagagaggctcagatacacactgttgacagccttttggtgtctttgtatgtgtgtgtgtgtgtatacatacatacacactaaactgtactgctgtatgtgtgggaaaaagtctaaatactaagcatttttattctattttgggcaagtatctgtgctcaatggatgcaagttggtatctaaaatctaaaaaatgcaaagataaatggatcatctgtgtacttcaagctttattttcttgcatagttttttcctagtatttcctgacaacctagaacagtagttctcgcctttgactgcctattgccattgcccgtagcatattttagatctaaggatccctggacagatactctaactcagtggatggagcccaggtagctgttttgtttgtcgtggtagttgctctttttaatgtctacccattgtcctgtaagacaactagggttgtgaaccatcggttttttacactatctaaaaggaaggtgtctgtggattgaggatatttcttaccttgcctacttccacactttcaactttctaaaattcctgggattcatgctcccattccccaaagaatagtgagttacctataattatctacagcatctatcaataatgcctttagttcctcactttgagttctgcttagagctaaacatattctaagcgaagtaaggaggtttcatgcttctgtgtatgcataagtgtgcctgacaaagagatgaaacatgaaagtgaaacaatactgataaatgaaatttaaaaatatagtatgactttgataggtagtctgtattctggcacttcatgaaatctccaaattattgtatattaccatagcatgcaatttttacttatagcatggtaaagcagagctcctccttttgagtgatgtacagctattgcaccactctaagtggtaacttaacacagaataaatatgaatagaattatctagagttgtacaactcagtacctttggtttggaccagagaaaaaggccttagagtagtggttttcaaccaggagtgatttcgcccttcaggagcatttggtaacatttggaaatatttttagctgttaacgctaatgagggagagacttgcacctggtcagtagaggccaaagatgctgctacatgttctgcaacactcaggacaactgaatgcccaaaaagaattatcttgccccaaatggaatcatgctgaggttgagaaactctggcttagagaattgtattagtcatcctggcccataaaattcccatgaaaatttgggaacgaggggaggattcatatgtatctttttggtattgtatttctggcgcctgggagcttgctcagcatgcagtagttgctaaatatgtttttggatgactgagtgatggcatgatttgaatcagacaacattattttaccagccttggaatctgggcaaaagtgggctgcttaggagcaaagacacgagtctgtgtatttctgtggttgcctttccatggaaattcccattcaaggggatacctaatatgtaaggattaaagatgcctcctccatggattttccatggtgtctcacattctctaattagttattccttaaagttttgtccacctgtgtatctttagtggtatggcttcatgtcacctcaaatatggaggcattagctttgtttagttcagtatataccagattatgggatggaaaatactgaagggatatcaaatgatcatacgtaatctaagatataattaaataataaacttacataaagcatttaaaaaaaatttagttctctttcccttaattctttcaatatttcaggtagagtcaaaggctggttttgtgctatcatgattttataactaatttttaacaccatctccttttcttcttttcttcttcttttttttttttttttgtgagacagagtctctctctgtagtccaggctggagtgcagtggcaccacctcggctcactgcaacctccgcctcccgggttcaagcaattcccctgcctcagcctcccaagtagctgggattacaggtgcctgccaccatgcctggctaattttgcatttttagtagagatggggtttcaccatgctgaccaggctggtctcaaattcctaacctcaggtgatctactgcctcggcctccctaagtgctgggattacaagtgtgagccactgtgcctggctctctttttcataaagagacagcaaacctcaaaatcagagattcagcttgccacaggtctatttaaaattgtttttatttcaattcatgtattttttatgtaaagtagtgttgatttcctgtttatagcagtggagaacatattaagatattttaatttaaatagaaaagtaagccaattacaaataagtgcaagtagcgtacagatatgaaaaaaatcataatcatgtcacttaaataggcgaagaaatcattgaatttatttgttttgttaacattgtctcatcttgaaggagaagatggaatctggagattgcagcttgaatggctccggaagaggcagcatgttcggtggattggatgtgtttgcataactgtgggaccacatgggaggtgacgcaggaaggctgaaagaggacagtctccaaaggagggagcaaaccttgaaaacacctgcagggcccttttaatggccaactgcatcaatttaaaacgttcacttgctcccccatggctgtctgtccaggcagaagcaacatgacctctggtttgaaaggcctctcagattaagagagaatattgtgtcttggggaaatcaatcatattattatgaatcatagaattatgagtcatgtgttataggttgtttcaggcaacaagacctcagatgtccttcacttcaaccactcttgggatactgaagggtattgccattgcaatctgtggccaacatctacttccacatctctccctcttggggctttcaagtccaagcttggagtcatgtttgtaggagcctcaaatctctctctcaagaattttcatttgttttccccagttctcccctgtggaaccatggaaattaaaatcgaaaccctgttctattactttcacatgtttgaagatagatttcatgtcttacttgagccatttttttcttcaagaaaacatttccagctccttcaacttttccgtccatgagataatgtcagtccctttttccatcttcggaccttgcctctgaataagctcagcttgtctgaatcagttttaaatagaagcatttacacttggatacaattttccaggtgttgcttcagtgggacaaacgaaagtgagacaattgcatctcttgttctagatatcatacttctttatccataccctaaggttactaactttttggcaatttcatcacattgttattaactaagtcccctttttttttttataaagaaggtactacaattatcacacacctttattttaaacgtatggcaacatctttttttttttttttttctgagacattctccctttgtcacccaggctggagtgcagtggcttgatcacggctcattgcagcctcgacttcctgggctcaggtggtcctcccacctcagcatcctgggtaactggcattacaggcacatgccaccatgcatgtcttttttttagagagagaatttcaccacatttcaggctggctttgaactcctgggctcaagtgatctgcccatttcagcctccaaaaatgctgggattacaggcttgagccacaatgcctggcctgcaaatgtctttctaataaaagtatgtgtatctgtagtgtgtgtgtgcacacgtgcgtgtgtgtgcttgtgtgtgtgcgtgcttgtgtgtgtgtgtgcatgcgtgtgtgtgtgtgtgatatagtgggggtggggcaggagataggaattgcagagaaatacgaacagttaaacataaagagaaactggaaatttgaaaatatatgaagtgtctgaccccaagttcaagctgagaagctaggcatcaattttatttttccttagcctgtttttaaaaaagtattttttcaaagtttggtccttgagccacttttcagcatcatcttatcagggaggcctttcctgtatgtcccattgcttgttatctcatccaccattccttgctatctgctttaccctgctttattatttttttcatagctcttattacttccaagcattttatatctttttatttatgtattacaaggcttcatgaaaggaggtactttgtttttttaccactgctatttgtcacaacgagtttattaaatgaacaattgaataataagtaaaaggctaacttgggatgtgattgcatattcagatttttgggtcccaagctgggcctacagaattagaatttctggtcatggggcccgtttaacttacttttctagtgtttcatctgtgttctaaaattttagcaagactgaaagtgcacacaatctcagtgcactaaacactgaaaataaagtgtaatgagtaaatttttgaaatatcagctgggcatggtggctcatgcttgcaatcccagcactctaggaggccgaggcaggcctatcactccagatcaggagttcaagaccagcctggccagcatgatgaaaccctgtctctactaaaaatacaaaattagctgggtgtggtggcgcggacctgtaatgccagttactcaggaggctgaggcaagagaatcacttgaacccaggaggtggaggttgcagtgagtcgagatggtgccactgcactccagactgggtgacagagtgaaactctgtctcaaataaataaataaataaatgtttgaaaaatcaaaaaatggccatcttcctttacattcttaaaggaaaacataagtctgtatcaaggcattagaatataattatgctgactgtatattttaagtcaactgcatattactggccaactggagatcactatctattaagacataaaatttgctataatgtaggtttattatttacagaggtaaaagggccttattcaaaccttgtttcgactatgatgatgtcatggttgaggattcactcccaggtcctaaataacattccgataccagcacgacagcagattcacacaggcacaggcacttgcagactgccatagcttaccaaacaagacccaggtagagcatttcaaaaagctaccaaattgacacagctggggtgtagtttgggaaatttgttcaaaatgctaatctttgaagttaaaggtggaaagaaaaagtctacataaaaaccttccttggaaggagaaactcttatttccctataaacttcattactaacaaaataagggaggagagcaataagaaacaaataagattaaggaagccaaatggtttttaaatgagattattttttctcagacttttccacaaggcgtcagcagctctgtaaccaccagattgtcagaaattagcctggttttttttggacagtttgagaagccattccgtcggccttatttattgtttattaaattgattctacttgattttttgcagacataaatgagattcttctgaatgatgacctaagctgttaaaccttataataacatcactagtcactacttctgcctctcagctagtcagaagggcacaccctatggctttacccttgatcattgcacaaaaagaagagccaagactgtgtaacccaagtgtaatcaaagttacataaaaattacttagtgaagccagcccctgatctgtttagcatcatgtttactaatttattttttttacctccaagtaaagtacttggtcttttttaaaaaagaaggaagaagagcaaaatagagggagggaagaagagagggaaggaagaaagaaggaaagaggagaagagaaaaataaaggaaggaaggagggagagagagccttctcaaattcagaaaataatattattttttctattatgaagcatcgtggaagaaaataaggccagttgctacttaaaagtaagcattgggctgaggttaagaaatcatattctatctttaaattttatattcactacctgtttggcctcaaaaagtcacaaactcattgagctaagatcttacttgtaaaatatatgaattagagctgaatgatattattgaaacattccagctttaaaaactatatggctctttgattattaatgtaactgtcagatttgaaacacaaagatagaatgagtatttagaaacataagccacagacttaacaaccagctctcaaaatcctctcctcagtatttataaagagaaataaattttgaataaaaagataataattgggaagtacaattgttactgattataattcaatcttcaatgttttactggaaagaaattgaacaatatatgttcttaataacttcctttagtcaataatcgagtttgggaatttttagcagcttgagtatatttaagcccagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcccagatctacacagtactcacagggcaggattcacacgtttaagcccagatctacacagtactcacagggcaggattcacacgtttaagcctagatctacacagtactcacagggcaggattcacacgtttaagcctagatctacacagtacttacagggcaggattcacacgtttaagcctagatctacacagtactcacagggcaggattcacacatttaaatgctaagggatgaggtatcaggagaggtataagacaacagggagtggtaaggcctggtacactgaaaaacaggattgttttaaagcaggaaagccttgctcaactctggaagaattttgctgtgtgccaaagcagaactagtcttgtcagactttctaagttttggaagaaaggacagaaatcagcatattaatgttaaaactcataatgtttaagacatgggagttcattcaagccttcaaagacatcactgtgcaaactaatcaaaacacacctgtgagtttggccccactagggtttctggagtttccttcctcccattcaactatcaggtgaactacaattaggtattaatccttaatgacagcttcctaatgaccttgtttagctatttcaagaggatccttccctaaagtattcagaatcgccttgaaacatgaagaccacttcaagtgctatgcaaagtgagggaaatttggagagtagattcttctgaagatttctctgctaaataagttgcactcaactgaaatccagatgtgccagcactgaagctccatcgcaggcaaggccgactcattgaccccaacttctgtccactcaagtgccccgagactgctggtgatttagcaagtgaactccttgccagttgtaagagctaattcaatctcatccccagggtggtataggtacattaagagttgcagctcttagagtagttaatccggaaaaagaaaaaaaaaagccaaagtgcttgctgaacatttaactgaaaaatttctcatttgtacctgatggttctgaattttgtcaactgtttctttgtatccttgtgacacgtttcttatttgtcatgttttcttttaagaaagaataatgtgagggaaatgaaatgttcatttgttactggaaacttacagtgatgagatgtggtgcataagacatcataaaatatccctcatttccatttgcatttgtcactgctccaaatcattcacgtatctctgtatctgcgtctgcatctagctttgatttattcacataattgatgtagagtgacttttcccaaagacatgaattatattaaatttttgatttgtgcatgtatttgcttttgcatatcttacttttagatttttatagctcttcgaactcagagaacattcaccacatctatattggcctagggaatgttgaaagaatgattttaattatgccacatatttttgcactgttcttatctacaaacaattgtataagctatgccttttgaatatattcatgtgctgtgccagatagtagtagtgcaaaatgctaatgttgattttaaaagaatgacctttccttgtgtgtttctttccagtgatctgcttatctaagacggatagtattgatggactgcactatcacagtcttagacttgcagaaatgccttggagttttttgtttgacatttctttgtcccttgggtactttgctctgactctgtcatttagactttactgtaaggataaccaattagtagttaaatgagttgaaggagtctttttatgtactctattcaaataacactaaactcactgtcacatgaataggagatatgaattatttctctacgcacttttaaagcaagcccacacagtaaatgatattgttcataacccctgcctttattgctttcttccctacacttagggacttattttaaagaagaatttatagatcctctattctgtattccagtagaaataataactcagtaggaataggagtatgtagttttttttaataaacatataacagaatggtagaattagttttgaaagccatactctgaaggaacaacaatgagaatacttgctgggaattcgcctctttaagaaatagcagaggactgccaaattaacaaaatgcccctggtctgtatcatttatacatggtacagatatatattgtggacctactgtgttccaaacccaaagattgaagaagtaaattctcacttcctgtctttgacatattcagaatttggaaatatttcggaagctagaagtcaatactcacaatctaactcttagaatgaatgatccttggtcttttaacaaaggacatctgactaataaaatagtcttagagttgtaggagaaatgtgtcattctggacaacaaagaccttctgtctctttcgcaatggactgtttgcgtaaaataccagcgtacttagtgaattagacatctacaacactgtgtaaacattcctttccagtcattgcttcctggtcagtcatagagaccactttgaagtgcctttattttgaacactaggaaagaactacaggagagccacagccctctgaagtagtaatttttgtaaatttgcgaataatgatgttacatcacgtcactgggacatcaaacctgtctaatgtgcactactactcccacactactactgctaaggcaacaaccatttactaggcttattggccgtgtgccaagtgctgtgtttatttcttattttcataggatatgttatttaattaacgggtagctaagagagagggttccagagacaaactgctaaggttcacattcttgcttccattatttgctagctgcatgaacttagccaaatttctcaacatttctgtgtctcaactaccttatctataaaatggaaatacttgcctgataggtttttatatgattaaatcagaagatagtggttaagtgcttagagtgcacagactaaatgttcaatttgctataacatttctataatatcactcaatgaatatttgctataatattttcatatctcttactgatcactgtaactcaaataattgtgctgtcttattattcttagtttgcaagtgaaaaactgaagttcacactaaccttttagtcaaaaaatgcactaaatttctgagctgaaattccaacactgtttgatctgattctgcagttccaatgggggatgatatgtaaagagaaggggtaggactgcacctgaaatgttactagaattctattcaatgatctgtgatcctcatattcattcaaaacctatgggtgggagatgtggggaatgggtgggagatgtcagaatttgtatttacagtgaagcagggagtttaataaggtggaatttcaaggtttttaaaactcgatggtttttgtaaggtgggagtggaatggagagtgaggtagtaaattgggataatcaacctcggagtctctgggatgggagagatttctcctcagtattcaaattctggaaaccttttgaacttccaccaaaaataacaagccgtctaataaacaaaccatcccatgcacagagaaagaaatggatggttggggctttgaagccagtggtggttcttagtctgtgtggctaacccactagggacagatggtattattgggggcagctctcagaagatttgtaaaatatggtgaggttagtagcatggccaattttgttgtacagtatcctcagttaagcatgtataccaggagaaggatccatctttcttgcactttgaaggatttggtaacttattcaggacttggtcctatagctgtggcagcaacaagagtagtcagctcagcttaagcctctgttcctaaaggaacttggtctaaacttgtaggtctaaagacctacaagtggctctgatggggacctgcagtgatgcaccagcgagcgacaaatggagacatttctttaacaaggaaagcgatacaatttctacatgggaaggatgcattggaagcaacctggttagaagggggctggggactcattttgaaggtctggctgcacaacaggcatcatgttcttacttagatttaagtttctttggaattaataaaaattatgagcaaactgactcctttcctgaggtacaagtttgctctgcggctgctctttctcttctgtgaaaacgtgaagctccagttttggtgctagcaacaacaggacagaggcttactttgcaatatgtctgatagtgattgtgtggttttcctgcatcaaagggttaaagttgaaataaaacttgcatttcattttgagcaaataaagcaagagcaaatggcattgtcctgagaaatgttagcacactgtagattcttaaatttattgtggttgaggatggatgctctccagattagcaaggcagcacttccaatgttcagtggagggcactttaagatgcaattatttacacttcatgttgtgatattacaacaatagttaataagagctggagagatttcctaattatctgagggtgcaggaaatcatttcaccctccccttacttgaaatactaggaatcaagtctgcaggaagctggctgatcacaaatcacgtgtcagcacctccataacatttacctgcataatttgtccttattattttttatgttgatgaatctatattgataaatcttgcatttatctgttttttgcagtatgtatttcctatttcacagtagtagggaccctacgctctatttactttgtgctctttcacagtacaccataggatttaaataaatgcctattgaaaaattcaacaaataagccatgtcatttttgttaagcagctttacttggaagcaagacttctgttcaaaattatgctaagatgaagagtctcaccatcatttccctggtgacctgtgggcacagaatttaatgagaatttgtttccttgccctcatagcaacttcctctgcataagatcctaattaaccaccataaggtgatttaggccttggggtggggtggaattattcattttcctctattttacatttatattttacttcataatactgcattcacttcctttgaaatgttagtattaagaagttttctagtagctgttctcttaaaattacgaggatttttgattttatgttattttattagtcaaaaactaaaaccaaaagcaaaatctgtaaaattccttttttgaggatgtaaaattgccttatacattatatctcattatctttaccgattttaaaattaacacctaattaaaccgtgtgtgtatttcaaacgtgaggctaggttctcattgatgctctccactaaattgttgcatgaagctcaagaaaaatgtgaaagattatacagtttttgggcaacaaatattctccctaagactcaagatgtgttttcttaagaaaatagatttaaaatgtgaactatttccaaaatataaagcaaattaagaagcattttcttgaaggagaaaatgtaacaattaccatagaaatgcatttgccttgatatcgtcatttttagcaatgagtttgatcagctttgtgttgatgatcaattctaaaatgattctttcctatgaaaaaccatgctttggtttcatttcacagctgctaatttatttacttcacatttgttgtcattatcgcattctctgtttattcttgcttcaaatgtgttttgccccgacacatgttcaatagatacaatcctttacataaaaatgaaagtagatttctaaaactctgtagtatatttacatcaaactgtgggtaaaataatttggaataataaagtgttttagatattatggcagtgatgaagaaaatgtattgaaaatgatgactaggccaggcacagtggctcactcctataatcccagcactttgggaggctgagatgggcagattatttgaggtcacgagtttgagagcagtctggctaacatggtgaaatcctgtctctactaaaaaatacaaaaattacccaggcacagtggtgggcacctgtaatcccagctacttgggaggccgaggcagcagaatcacttgaacctgggaggcagaggctgcagtgagctgagattgcgccactgcagtccagcctgggtgacagagcgggaccccatctaaaaaaaataaaataaagtaaaataaaataaaataaaataaaataatgactagcttatgctctcagtacacattttggattagatttcctacttcagttaatacaggtttcttctttccctcaatattattgcacatgccataaatatatcttgcaaaactgaataagaattaactttgaggcagctatacatcttatagtcttgttagcatacagaaaacaattaataaagaatcttcggaattatttagatttgagttcaaatcctgagttcaattattaggagttaggtttaagaaataattcactctacctctcttccagtattcgagaatacagggttaaaggcagagctcaatcagatggcaaaatattggctttgtttacacttccccagtaattatgaatgttaaagggtgttgagtgggattttgtattttgttgtagctgttgttgctctcaaattggtaactagagttcacagctgcatgcagagattagcctggtataccatttactaaagagagaagcaaaaaattatggtcagaatcctgtctcaggagcttcttaagagttgaaagaaaaaactcaatttccccaaccatcaaccagctgctcggcttgtgcacaaaaagttttggaggcaggaaggaggagagtagctctttgaaatgttctagcattgtggaatgtgcatcatttatgatcagatgggattccttctatagcgcttttctcatctcaagtcaagtgaagggctccaacttaatcatttgtacagactggtgcacgtgaaagaaggagacttgcaaatgttccctgtttagttaactgaatcagtaatgaacttccgaatctgtttctgtgccaatgttgggcagataggagaaaaatggagagagatggtagggagggtcagtggagcacctacattctcgcctttcagcccaggtggggtacatgaatgttctgtagataaaaaagactctctctctctatatatatatatgagatggagttctgctcttgtggcccaggctggagtgcaatggtatgatcttggctcagtgcaacctctgcctcctgggttcaagcgattctcctgcctcagcctcccaagtagctgggattacaggcatgcgccactatgcccagctaattttatctttttagtagagatggggtttcaaccatgttggtcacgctggtctcaaacttctgacctcaagtgatccatctgccctggcctcccaaagtgcacggattacaaggatgagccaccacactcagccaaaacagacccagtattaagcagctgggcttgagctgttgctggtacctcatctaagggggttggtaacaggctacagtgacaaaagcagcaagaggcagtgagatctccaggaagctggaggaaggtgggatgaaggtggaagtacctgagacctgtgcagaacctgacccagtagaggggccaggctagaagagatgtgataattccaaggtgctaaagaggaagggggaatcaaaaaagagacaacgctcttttattttcatttcagctccttccagccatagttctggccagaaatggggggaagggggaaatattttgaatcaaactgagttttagtgacagaaggtgacttgagatttatggaagaatcaaatgcataaaggcatgggaaaggagaatttggcaaaaaatagtgtggaaaactgtgtttgaagaaaaaaaatggaaatatttcaggccaatgagggtctttgataaaccagttacagctggattagagaactctatgaggcttcacatgttatttttcctgaatttaaaccctgggactcaatattatttctaaccaatcataggtagcgaggttgaaagggagactacagagacctgattggtgtttttaccacctggacctggaagcactgtcattgacagatcccaggtgtaggcagaaagggcaggggatccgggtgcaaaagaatgagccttgccttgtttttgaagtttccgttgaaccaagctgatgagacatctacctgttgttctagttactgttagtgcataaaaaattacccaaaatttggtggccaaaaacaataatttattttgctcacgatattgtggattaagaatatagagagggcagttcttgctaaaagttttaaatgcaattgcagtcaagttgttagctggggctgcagttatatgaaggttcacctgggctggctgctcaccacagctttcccacatggctcgtagtggacgtctgctgccaactgggagctcagctggagctgtggacttgagggtgcacacatgtgtgacctctccatcacagcagtctcagggtagttgaacttcaggcatgactgctggctttttcagaaccaagaggaagtagaaagctttgtttgatcacaccttagaataattggttacaagtatatcattaagaccagcctgaattcaaggagagaggtataagcctcatctctcaatgggaagttgtcaaagagtttgtggacatgttttaaatctatcaccctgtgaaaagccaaaaatactgctccaatcaaaaaaaaattcttatattttggccaaagttccatttcctaaggattgtggggagggggaaggaaagtttttgtgaactcgggcaagtcattttaactcgctgattttcagttttctcttaccaaaatgaaagcaaaaatgcctactttattgtgctattgtttaatggggtgaggttggtggctcatgcctgtagttccaggtactcaggaggctgaggcaggaggactgcttgagcccagcagttggagactgcagtgagctgtgattacaccactgcactccagcctgggcaatagagtgagaccctgtctcaaaaaaatcattgcacttttgtaaatttaaatgaaaagacagtgtctaatatatagtagctcttattatttactcatattacatgaggtatccaaagagaatttctcgcaagatataatgaagaagatttgtatattggaagctttcatttatggttggagaaaaactgctaaagatttgtaattttgaatgaacattggcataaatagaaagccagcgcgcagagcagagaaggctgatatttttatgctaagctgtagaaatcaggaaatgtgtgataaggttatctgaaaaatagattcagagaaaccacagagagaggaaggggaaatcaaagtgaacattgatgaatgtgggtaaggatattgtgtgttggggaagcatcttagttcttccatttaatacacatgtgatgtttgaagcactcttatgaaaagtcatctttcatgttaagtggagatcatgtatttgtaacatttccatttggtagtcatatctctagctattaaaaatcacattgtgataaaatactcttttgataggtgctgactgtaaaatcatatggtagacattttctgcaatgtagcatgatttaatagaattgggaaaataatgtttttatatttctattataaataacattcatatagataatcttaccagttgctatcaatacagggaattcttgtttcaattaattagttaaaattttcattgtttttgtgctttactgtaatattgctactgttatttgaaacacattacatttgtataagcacatgtagcaatgccaaaaatattggggtgcctactctgtgcaggggtttacattagttgttgcatatttccaattcataattttgtgttttttgtattcctgtcattatggtatactttgttgtttttgcatagattttatagtctttttccaggttttaggtttggtaatagaaatacttctatctcatcaatttcaagtctactttcagaaatatttcaggaaggcaaactgcattcttaacaagagactatgttttcgttctttggaaatgggaagataattaagacccatattctgtcctcaggtagctaatagagtacactagtgtattagcctattagccatggcattttcaattgcaagaaatctaaggcaaaagggaattttagatcttacaattagaaataccgtagagttgttcacattatgaaaaataagttacaggattagggaagagcttatgttcaaatagttcaaagcagcaatggacgtattttgtattgaaaattccaaagatgatcataaagatgactccttggcacttgctcccaaatggattcatccttttattcattcagtctttcatccatccagtacttactgaactcccatatttgccaggcatttggtgctagagatagagaggtgaataagaccaagttttgcccttatgagagcaacagtctaatctagggagatgacagacagcaaaatcaatgaagagataatgaagggccacctagggatcattcctattaagctggtataagttggtttaaactagataatgaaagaaggtctttctgaagcggtgcctttgaacctgagatttgactgacatctctgcgaagatctgggaaagtcttcaggtggagggtagagcaggtgtaagaccctaggaaagtgggagcttggtagtatttcacaaacagtgaggaggtgggagtaaattcagcactttatgaagttttgtgcattcttcagtgttgttggcatcagtgagtgtgcgatagctagaaacaggtcaataaattattcatgatcaaaatgaatttgctgtttctctggccacattattgcacccttgggaagtggttagtttgccccacctggaccaaaggagagttccttacccaagaacctgaatcaatatgttttagtttagctatgtttttccacaagctcttaagctctttaattccataaagacaattatcactcctagacttaatcatttttctcttagcctctgtgttaccttctttaatcttattcaagacttgtttcctccagtcccttattgttttgccattaagccttatcaatatttgcttggagctatatttaatatattcacgttctttttctattctctctcattttttctgtgcaaggccaaatgtaaatgtcacgaaattatcagaatcttgaattttgatgtcacatttatgttttctatcataatgacttcttttaaagaataagggtatatatctcttatgaatgcttcttatttttaagttataatgtttctgccttttaaattagaggtggtaggatggtaatatgcctatgttaaatttgcttttctactagatgtgtttcctaactgctccaatctactcttgcctatactgtaatgttccatgctgtaaccagataattctttctgaaatacaaatttgaccacgccataattctgcctaaaatgtgttgatgatttcacattctttttgggtaaagatcagctccttacatggcctacaaagcctcaatgaaatagactcagcagcagggaggctcctctctgaccaaatcccttctcacttcaccagtttccattcactgaccttttcctccttagtttctgttctccatgccagtctgaaaacagagaatttgcatgtactcatttgtcgtgttcactacatttttttccctccttgactaactaacctatacatcctcccaaatctcaattcaatgatcacttcatgacagtcaccatctctggatagattgttaaaagcagatctagacagagtaccacatgcaatttctggtcaccctaaaacattatacatgcacacacagtgcatacacacatataccccacacacattccaggtaatattcagaaatcttactattttaataggaatgtgtttgcctaagttgaaccatgctcaaaaaaagaacattccaaattattaagctgactaaagctgtctttaaacagcagaatacatatacccactgttcagattagctaaatggggaaataactgcttttcaaggttattaacccacaatattctaatctcagatgctgtactagaacagtctggcacagttactgtttggtttatttttttactctagtgagctgtaggctgacacgttaccaatagcttcttttcattgtaagcagcatacagtgtgatgctcaaagtgtaaacaggataatttttaccattttcaggagcatctaagtcatctacagttggataacttttttccacaatttgtgaaatacaggtgtatctgtcaaaactgatgcacaattttctctgtttcttttatctgtataatgacttacccaattcctagtgtgcaagaaatattattgatgtcttattgaatcctgttgctttctgtatatactactgtgatcttggtggcatcttcatttattattctggtggacgcatgtagcttactatcagtgtttttatgagacaagaagcaatatctctcttttctaactaagcatttagacagtaaattctctttgcatggatagcagtgtggtcctactcaccactgcaacttcgttgcctagcatggcaccagcacacagttgaaacttcattcttgaaacagcctgtgggttagggatattctacctatttactagtgatgaaactgccccttaaaggaatgggtgagtgattgcccaagtgtacacagctgctaagtggtaggggtcaggctcttagtcgcagtgtggctcattatctagcatttgctaacatgttatggaggcattttgctactttaaaataatttatttattcaaacttcatattcactggtcagatttcccttgtcagactgagaaaagaaaccactcatttgcaggacagtagcaaacatcttacttgcattccagttgtgtatgggttcttttaaacttcataatattcttttcttattcctcttgctatatattgatggcaaccgtaggcctaggtttaccacatctctatagaacaaagccatatcttatgaattgttttaggtgctatctggactgacacagttttgttacctatagcaaaatatttactgctttgttgcagagaaagctagcagatggttttcatgacatcataggcagggaagagtagacatgtagggtccacatgtttggccttttttccaagagtctaacttcatatattcatgagaattttgaatgaagaattcaataaacttgttattgttctataatgagaaatctttatttgctgaaaacaaagcctattactgtgttctaaagaatagatctcagtctgaaaagaatgctagtgcaaagataaacttacataaaaaaactagtataaaatttaaatattattagcaatcatgattaaggatattattaattgtatatatatactatgtgccaaacaattggctaagtagtttatattttaccttatttaatccttaaaacccttttaacatatgaaaaaacttagaacttgaatgtttaagaaggtaatttttgttctaaaaactaataattagaagagttggggttaaagatatgttgaactctaaagtcgaaattattattgtttatattattcttttaaaaattaagataaatattatatattcattgtcatgattacttttataatatatttttccgacctgtctaaaatgctgtgaaggtaaagatcattatgtctgtttaattcaccactatattaaaagtattatattgcaccaccaatcatattgtatatgatttgtgtccattgtagatactcaataaaatatatcaaatgaatcaacttgagctttgaaggttgggattgtcacaacattaagagtgttataacctttcttctcagacatttttgaggagttggagataggaaactgcagagtttagcctgtttggaagaaagctggtgttttatagtttgcagcatgattggaatccagtgactcaactgcctttgaccatgaggtttcaataagaggcaagaagaacttcagttccaaggaaaatctcctgattaaaagagtcgtacactgatctcaaaaagacttcaatggcagcatggcatggagttcaagagtatgggctctggggctgggcacggtggctcacacctgtaatcccagcactttgggaggccgaggggggcggatcacgaggtcaggagattgagaccgtcctggctaacagggtgaaatcccttctctactaaaaatacaaaaaattagctgggcatgctggccggcacctgtagtcccagctactcaggaggctgaggcaggagaatagcgtgaacctggaagtcggaggttgcagagagccgagatcatgccactgcactccagcctgggtgaaagaggaagactccgtctcctaaaaaaaaaaaaaaaaaaaaaaaaaagagtatgggctccgggccagattatccgggttccattctaaagcactccacttattagctggtgacttttcaaatgacttctctatacccaaatgatctcatctgaaaattggagataatgattgtacctgcctcataggattattattattaagattaaatgaattactgataaaatacttagaacagtgcctgatacacaatatgtgttatgtagtgtttgttacatgagtattcattctaaaaagtcttttaaaatataaagtaaatgcttatagattttttttaaaaaattatgcatctgcttgaaaactaaaggatattatttgataaagtgctaagatgttctcagtgctagaattatataatagtagccacatcctggaaccataaaggcattcttaaggaagtttatatttaaaaaagcaaaataaagagccaggaatgagtaactagtgcacagactgtgaaaccagaggataatattctatatctgtaaatacacataacattaaaatccttaatttgacaactggcagaagaacacagcattgaatcttgtatattttcattttctctttctcttctctaccacattcatttccatgttacttttatccttttcagaatgaccaattgcttccgttttaaactatactcactgtacttgggatttatttctcttaccttatactggaaaaaaatgcaaaaaaagggcattcagaacttacgtgtcatttttatattgcgaattcaaggaaaataaatatttttgtgactttatttctaagtgttacatttgcttattttgtcttttccatatttccccctttccctgtctttggcatgacatttggaattgttattggaaagagaatcaactcagaaatcaggaaagttagccagtgacacattcctttattacatgatgcaaatattttgctttgctcttttaacatttttcttttccataacaagaagttttacagctacatttcacagattttacatctctgcatctaacagaaacataaaatgtagtttgcatttaggtatttgtattttattttactaggcaggaatgtggagtgtgtttgtgagcttgtgcatgtgagctggaaggaagtgtggttgcccagtacttcctcaactcatgactgaaactttgttccagttcaagaaggaaataaagagcccttcaaaatagaatactgaatactttcttcatccgctctatagaaatcaggccaggaagcaaattaaaattacaagaatatccaaaacagaattattttgcttgctgtctgtgtatttgaccactgccttttatgattttaacctttccagacattctctttggggtcggttttccttgtggcccataggagatcccactgaaatcatttactagttgttccagatttccccacaatccccattgcgctaagtggcggctaatgtgggagctgtcatgtttggaaaataccatgatgccatgagttaatttcatacctgtcacaagatcttgcatgcgatcccaggggaccagtggtatgtcacacactactgcaagcgttcgttagtacctctcaaagcaatgaaccatggccaagagatcttgttgcaacatatggcagcacctgtcaccaggcttcatgactggcataaaattaacctgttttcctgtttgatgcgctgcttttttttgcttatccgtaaaaaggatgagaataaattgtatttggaaacaatttactgttcctttcaagaagtataatggtagacttgggttactggacacaatgaatagacagtgtccttgtagaagtacacacactgctattcagtaaaggtggtattttatgaatttctgaatggcagtctgcacatctcacacaggaagcaacgttttagtttctgaactctgtcaaacttagacatagagcaagaaatgacattattgtgagccacattgtggaagaaaaatccaggaagcatgagtttcagatgtgagtttgcccttgcctttcgaatggtttcaagcaaccttgagcttcctctctcttctctctatatttctcacgctcagatcttagtattctaatggggacgcacgaaaaagggacccacagaaaaacaatattcagaatgatgccggatattcagtgtcttagaaaaatagattaatgggatttagtctttaagtcttaaaactgcaatttagcagttatttttatggataaagacaaagaatatagtccagcatttatatatggctttctacctcagagaaatagtaaaagttttttgatcaaatgatttctcaatagagaaagtatccggtttcttgcatcatttttcttttcttttcttttctattttggatcttcttatatatctttttgcagagccttaagcttcttaaaatatttattttaatcgaggggggagctgttttctatagctagtctttttccttcttcttaaggtaaatgcttcttagattctgtgagttttaaaattcatatacagcaaagaacaaagataaatttagcagtcttttccctttatgtcactaccaagtctagggaacaaatggtgctgttcttccacaatctggactggttgctttgaattctggagtaatcaatttttcctggcatttcttaaatggtcttttttattcactgaatctcctttgaaagtataaacattagtccttgttctatggttttggaaattgatgactgctattctcaaaggatagtatagttggaatgattgaaggagcagagcaaaaagctgaactgaaacaatggagggaggaaagatagtaccagagacaatgagagaagtgggcagtgattggaagggaatccgaagtagggattggggacttaaaggctgcttagacttgattaataaatgctgtataaatgaaatgctgagacaagggataaaattgcacttgagaagtcacttgaaaatgtgttaatgcctttacttgacaagcatttattttttcatcctgggtataaaaccactgtaggaaaatgtagatcattttttcacactgagtattttttaactgctgattatggttatgttgtcctaaaatcaggtttctattatctgaaaagaaaataaaaagaaataaatataggtgtgtaaagataagtattttggaggcatggatcttcaggtgaagtgtcatgtaatatctttgctaagtcgggataaaaataaaatttaaaactgaaattcatatttaaaaagttcttagtagagtctaggcatttttttttttttagtgtacctaacagtgatgaaaattttgtatctaaaagaatgagggattttgcaagggattttcaggagactgtggcactgtcatggatggtagctataccattttctaacaaagtatgtcaagaaaattgaacatcagtcttcttactagaaaagagaatctgtggcaaattattttattaataacagcaaactgaagagccacaaaataatttagataagaattaaagtgctgaataacttagataagaattaaagtgctgaataatttagataagaattaaagtgctgaaacaattttattactggtaaagctgaattcagaactgcttctggtaattttactgtatcaagcaggccctgagaaagacaacctggaactgtttaaagggagatgttcaacgatggtcacaagatgcaggactcaagagcttccaccattagaaactatcacctttactaccaccaacaaaatacctttttctctgagaaggagtcagtgaagggtagagatgaaataggaaaaatttggttggttgggtgggtagtaagtttaatcattactcttctttaatgagtaatagagtggaaataactttcctctctggttttaaaagttaactaatagtaagtgtctttgttaaaacacgtagacacacacatgcaccacacacacacacacatgcaccacacacacacacacacacacgcacacacaacaactgtttgctacaggatttctaattaatgatatcacattttctaacccagtaattcccaactggggttatttttttcccctaggggacatctgacaatgtctagatacattttttggtagtaatgacttgtattactggtttctcaagggtagagaccagtgattctcctaaattctcctacaacacccagcatatctcctcacaacaaggaattattcagttggaaatttcaagggccctcaggttgataagccctgtaattgcttgaagtaacttaatctccctagtaattgtgcagtatctcatagttattccttcttccactactactccccacaaatttgcccacaaacttgagaatttacataactccaggagtacaatagaaagggacctcacatccaagtgcttgggtactgtgctatcctctggttccttatttgccttcaccactatgatttactattggtaaagttgtggtcatgtcggttctcctggactaccagagcccagaaatcttctcttgttgatggttcacctctgtcttaaagtctactttgtctaatgttaatataactaccccagatttgttttatttttccaatttgtaccttttttttttttttttttgagacaaagtcccactctgtcgcccaggctggaatgcagtggcacaatctcagcttactgcaacctctgtctcctgggttcaagcgattctcatgcctcagccccccaaatagctgggattacaggcacatgccaccatgactggctaatttttgtatttttagtagagatggggtttcaccatgttggccaggctggtcatgaactcctggcctcaagtgatctgcttgccttggcctcccaaagtgctgggattacaggcgtgagccaccatgcccagcctatttctttttcctatatttttgcttttgctttgtaaatacctttgaatatacagtttatctcttctagatacgacataatcatatcatttcaaaaactattctgctaatccttactttttgttagtgtttaattcatttatgtcttatataattactgataaggtagaattgatgcctggtgtttctatgtctttgcttttttattccttcatatctgccttgtttttcattaaataaatattgtctggcatgccattttattaccttgtttcttttgttgtagctttaaaactattttcttagtatctgttctggggaatacaattagcattttactaaaataatctagatcagataaaaattaacttaatagtatacagaaactttgctctaatatgtacctgttacttctttcctccttggctgttattgtcatacaaattacttttatactgtgtaagcccattaacgtggtattataattcttgatttatgtagttgtcttttaatcggatagaagaaaagagttacaacaatattttaatactttcttttgtattttcctttactagtgttctttatttatttgtatagattgaggttaacatctagtgttctttcattttagcttgaaggatccttaacatttttggcagtgcaggactgctagtaagaaattatctcagtttctgtttatccaagaatgtcttattattatttttgtaattttcaaagaatagttttgctgtgtatagaattcttggttgactgtttgtgactggttgactgtctttctccttcagcacattgaatatgtcatcccactgaaaaatgtgaatggcttcacaaatttgcatgtcatctttgcccaaggaccatagtaaccttccctgtatcattcaagttttagatgggtcaccaaagcaagcactctggatctttccatactgcaatagaaatgaggaagacttgggggaacttactatttctctccatataaatcctgcctttgccactttttatctgttttctggactatactgtatagaatacagggtctttctaagaaaacaaaatactttgattttgtgtccagggatccaagtaaaagccctgcttttggggcatctggtggttttctaacagctcctgctctgattgtttccttgtattccagttttctgcctaatcacatgcagaaccattccattcacatagtgaatacatctctcacttgacacagggatcctcatttatgggaaagaaacacaaacctttcatttgaaaaagatattattatgtttgctttatgcagtacataaataaaacttgatgatcactttctcatagccattctcttcacgaatatcattagcattcaatgcagaaattagcctgcagtcttcccctaatgtttgcatgtatcttttttgtgatccaacattttgctattaaatagaatgaattatgtggagacatgattagataataccaagagtataagtttcctgagattagcaatcacacatggtttattttagtcctttgtagaatgttgtgactatctttctatttatgtacacatgtatctatgaagtacttattcatccatccttttattcattagtctagccagtcaactatctattcatctatctgtctgtctatctgtctctaacatatctttttcttcacaggaattcaatttgatgttagcatatgatagttgtctaataaatacatgttaaattaaattcatatgaggaatacagactctagtgtaaactattggcattactgaaatatgggcttgatcattcattgtgtgggtaactaccccatgggtacatacattggatgtttagaaccatcatccccggcatctcaatataagccagtattattctcccaattgtaacaaccaaaaatgtcttcagataacataaaaacatccgtgggggaaaaatccctctcctccaccccagttgagaacagctggtataaaagcatcctttccttcttttatcacagtatgtatgattaaaataaatgttaacaatgactaatagtagggaatttatcagatgaatgaatgcatttacatatgtattttccagatagtcacactctccctcactgattcatccacccatttattattcaacaaacacttactatgtaccaattatccactaagtactttgccaggtagaggggatacattcgtgaaatgtaagtttctgccctgatggggcttacagactttcggtggaactagataaaacaacgaaacaaaagatattactaataagtgttttgtttacaataaggcaggaagttataagggaaagacaggggggctgcatgagattagtggacaaggaaggactttctgaggtgacatttaaggtgagaaatgaataataagaggaaaacaaacaaagatgtgaaaaatttattcattaattttacttatttcttatagcatatgaggtttatgctaggagtgcaaaaggatgatcatttggtggcatatcaacttgcttctctacccatatttgtgaaaaacaccagattgtttgtgtggaagccactgggaactgttccaaaccgtgtgagaagtctgacgttttttattgagggagcatagccctaccaatgtaaaggcgttgttttatgacaatgccgtgaaaactggtaagacattgaaaagcaaaaatgagacatgcagaccttaaaatatcctgtgtgataagaactagtgattgttcactgaaaaagacaaattttagttctatcttcatgacattatatgttgctggggagatggtggtgaccagggaaaactgttcagaggaaaatcctggcctgatacatttaaaagaaagcaggtaaatgcgtattcatctttttttttttttctccaacctcagtagatctaaggacattaatcagaccttgggataattatatatagctgtgctatgagtacgtggattcatttataattccattggtagtagataatgcaattaagtacaaaattctgcagaatctattatatcgttgtttgacgaatcaaataatgtattctgcatttttattctcatgaatatttcccttataaatagatgtctaaaatgaactattttgcatatgcttgccttatgaaagtaggcttatccactggaaatacaaagctgttttaagcatatttgtgtgtttaaacatgcttacgcatgttttcaagcataattgaaataattagaataagtttcattatcacctttcaccttttatgctagatgctggatcaagtcaaaactggaattgcaagtcaaacatcttgatgagatacagaattctgtaaagggaagagatgaattacaaaatacaaccttgtttgaggaagacattatgacagctgggtgacttgggcatttaaatggaatctgatgaagtccctcccaccattttctctataaaatgccaatggcatttaaaagtagtgtcaccagaggagccaatgtatatttttatactgcaattaagcaattgagtacaaaattcagtacagtcagtgggaatgtgatcagatgaataaaggaagtcagagaagataatcatttcagttctttccctaattttgctttctagcctggtacttaaaattcacaggctcacaagtctcactgggctccagagaagaagcctgactcctccccagctgtgtactctcaggcaaactacgtagactctacctcagtttactcaattttaaaattgagatcataattcttgtcttctagaatatttgtgaggattgaatgaaatactatgtataatatgcacattacatagctaatgctcaataaatcataactttatgattagcaatgtttgtttccctcagaagtgacctaaaaccaacaacaacaatatttttattttgctttctatgatcactgctaattatgaaaaaaaaaatgtgcctgccttgatgcttaggaaagaaaaatggttgcaatgagagagaaagcagtgtttccagacttgtgatgactttattcagttttctgcattttgtttctctctggcagttttttttctcctgtcactttcaagattgaacataattacagtaatgaattataaatgaacataatatgtaatgaatataatacataaagtttattacccccattttcataattctgattccaagttagagatccccttccaagataggctccatagcctcctgtgtaagatgtctctgcccaccctaccccagataacaccacccagtttgtctcctgcaaggcacttatcacaacccttaatgttttttgttattcgcagggggtcctgatccatgccccaaaagtgggttcttggatctcgcacaagaaagaatttggggcaagtccatagagtaaagtgaaagcaagtttattaagaaagtagggctgggcatggtggctcatgcctgtaatcccagcactttgggaggccgaagtgagtggatcacctgaggtcaggagatcaagaccagcctggccaacatggtgaaaccccatctctactaaaaatacaaaaattagccaggcatggtgacgcacccctgtaatcccagctacttgggaggctgaggcaggagaaccacttgaacttagtaggcgtaggttgcagtgagccgagattgcgccattgcactccagcctgggtgacagagtgagactttgtctcaaaaaaaaaaaaaaaaaattaaacaaagaaagtaaaggaataaaagaatggctactctatagacagaacagaagcatgagctacccagttgcttatacttattgttacttattgattaatgctaaacaaggggtggattattcatgattttccaggaaagcggtaggcaattcccagaactgagggttctttccctttttagaccatataaggtaactttctgacgttgccatggcatttgtaaactgtcatggcactggtgggagtgtcttttagcgtgctaattagaatataatgagcagtgaggaccaccagaggtcactttcattaccattttggttttggtgggatttggccagcttcttcaccgccacctgttttatcagcaaggtctttatgacctgtatcttgtgccaacctcctatctcatcctctgacttagaatacccatccttctgggaatgcagcccagtaggtctcagccttattttacctaacccccattcaagatggagttgctctggttcaaacgcctctgacattttcatttatacttttcacatatgtatcaacatataatataaaaatttaaaatgtcatatattatatattaatacatattatatttaccatcattagaatgtaaattctagtaggtcagtgaagaaatctgtcttgttcaccactccctctctagacaatagctctgtgccaggtacatgcagacactcaatgtatattgaatgttgaagaacttttcctgcaaaccgtaattgccacctgataggtttacacattcgattgtcttttcacctgctcttatataaatttgtgctgagacacgcaagccatttgatgttgtagttattttttacagtagaggtgctttgggaaagatgattgagatacctccttataatcttagaatccatcctaaaatgtcttctactcagataataaatgccagtctttgatttgatatatttaactctttaggtaatatttacaatacatagaactaactggatttagtaagatgctttaatttactgatagcatgctacttattagtgtgtgccttcaagcatcaaatataccaaaaaaatgatcatttttgttatggtagcagatagatacattgctccactggtgtctttttttgtttttttttttgagatggagtctcactctatcatccagggtggagtgcagtggcacgatctcagttcactgcaacctccgcctcccgggttgaagcgattctcctgcctcagcctcccgagtagctgggactacaggcgtgcgccatcacgccaggctaagttttttgtatttttagtagagatggggttttaccctgttggccaggctggtctcaaactcctgacctcgggcaatctgcccaccttagcctcccaaagtgctgggattacaggcatgagccactatgacccgccttcactggaattctttagctagccttattttacttggattctgattgaaatatgttctcctcagaatacaggatgaaacaaagctaatttaaggtgaccaagtttatacattaagtacaattagtgcatttttcaccagaaagttggtcactactttaagattttaccttcattttcattagaaggtattggttaatctattatctcctctctctaactgcagtcatcatattaaacttttgcaaattttaggtgacaaacacatgtcgaatttacatatatacaggcataatttacatatatgcatatacaatgtacaatatatccagaaggtaattagcaactggttacagtttgctactaatgtacaatatatccagaaggtaattagcaactggttacagtttgctactaatgaggtcaagtttacagatctactgttcctctgagtctgtcttttggctctgttgcattgccacagatcctatcatgatccctgggctgctgtttcacacacgttgtttgtcacaggaggggggccatgaaggaggatgtgattgctcccctgccaaccccctacctctactggtcaaggatctcagcatttttctgacgaatggcatgggcgggatgcgctccatctttgcattctctatgtgtcaggctgtgtccacagggaattgtctgtgaagggtttttaaatcagtgggaccagtaacaccatctttatatagtgaagacagcttatcattaaatatagtttgagacaagcttaattgtgcaactgaaaaatattttcgataatatttacaacttttatctatttagtgttattagatgaagactttatcatttttttccatcatgcctttggttttgtgagcttcttttttgtttttatttcccgatttctttctttcagatacttttaatcaacatttcttcctttggaaaacaggtcaaatgacaatgcgaagggtgatcaaggagaaaatgtgtgaagtagaagcctagaactcaagagaaatgaataatatcttggcatcacttactttgctttaatttcttagttttactcctttaatgtaacaactgtttttcatttaaaagggagtcatgaaacaaacatctatataatattttggggattaaaaatgcatttgcaaagttagatttattggtttttatcttaaagacataaaaacttgatatcatatttaattttgtgctcaaacttaccgataacacattacttaatccttgaaattatttgctttattccctgttgtggattaagatgagtgattttattctgaaaatattaggttgttgtaaaagtaattgtggtttttgccattaataattcacaatatgagagcaattatagaatctagctaaaattatatgtatttatccatctctcattattcatggtagttatcttctataaagtctctgcaaacactgaattagtaaatactgaacaattactcctggtaggtaaataagagcttggttcctgcacgactctggccacatttttgtcaatctatcaatacataatcttattttatatgtatttctgtttaatgatatcttatgtaatacatattgtatgctcattaatacatttatttaatacatattgatttaatacatatcttatttaatacatattttatgctcattaatacatttatttaatacatattgatttaatacatcttatttaatacatattgtatgctcattaatacatttacttaatacatattgatgctcatgtgctttcgagcatcaaatataccaaaaaaatgatcatttttgttatggtagcacatagatacattgctccactggtatctttttttttttttttttttttgagatggagtctcactctatcacccagggtggagtgcagtatactcacagtatactcatagccaatagcaccgtaactcacccctcattgaagcttgttcaacacagtttttttctctgtaaggcatgttatagcctccttgtgcttaagaaaactagggagcacttctgcattatttttaaacagcaagtcattttaaacagcagaatcataaacaaaaaacataaaaatgagaagaactaaatagaccatgaaaaaaccacttgtttatagtaagagaactgaaacatgaaggcagagtttcactttgttcaacctcagctggcaacatgtgtagggggtaactcaaattttgtgattctctgcacatgttggggaaagatcacacaaatattgtgagtattaatttggagtacaaattaatattagcaaatagctgtatttgcaaatatggaatctgtggataatgagaacagacagtatttatattctaggttagaaaagagaaaatgagctccttttagtcatcagaagccaatgaaagacctgggtttagtattttcttccatctcttgatttctgtttgcttaattgaatgacaaattctaattagtcatgcctgactaacataatttaggatgaaactatgtcttcatcactctctacttctgaccctggccctgttcctagagtacagtaggcattcagttaatgcttgttgaaagaatgcataaacccctttcctcatttggaactttatggaattgctgagaacatcagatggcaataaggtgattggagctgtaatcacacacaaaaagttgtctattttaattagccaggtgtggtggcacacacctgtaatcccagctacttgggaggctgaggcaggagaattgcttgaacccgggagacagaggttgtggtgagcagagaatgtaccactgcactccagcttgggcaatagaatgagactctgtctcaaaaaaaaaaaaaagaaagaaagaaaaagaaaaaaagttaaaaccaccaaattgtttattttctattttgaggattttaattttgcttaataacatagtcattgaaattaatttataaataatattgtatagttcaaaacattaatataggacttttttgctgtaaaccagggttgcctgtttaatatttgtatttcattatgagtagtgaactagtatctcttgtaatgcaaggtaaagaggaagaggttggttaacaaaaaggaactatgttaattttgctattaataagggggaaaaccttttgaatttatttatcctggagacacaaaacttaaactcataatgatgtcatatatattagcattactatatttccttattattgcaaatgtattctacccaggtcttttcatcattgtagtcacttaaaaaacatattgggtaagttttattatacaatttttctcagattgattttagttttattttttcttttctcttcttttcttttctttttctttttcttttttttaacctcagaaggaattagatgtccagtataaagaagcctgatcactctggccttacttggctttccaataatagtatttttaggatcactgatataaaacctacaaagtaagtaatttggttcatataagcaggcaagtaataaattttcctatacattgttatttctcattaaatacatactattactctccaaataagagatttttagaggtcattttttttctcatttttttaaaatactgactgacccatatttgcactggtagactcagaagtgtttggtttatacttgttcaaaatgattgtcagcagatgtaatgagccttggaccagtccagtaacttggctaacatatgtctgcagaaggattttaaaatcctgctgactaggctggtcctgtcgagtctcacagcagaaaaattgtcttttgcagctcagcttataaatataacctttgtgtgtttggaaatatcccttctaaggcaggacttatgctcaccctgaaattcaaatgttcattttgatgtcagcactaaccaggagaaagaaaaggtggaaacgattcctcttgcacgtttcagagtgttagaaaccgcctattatttgtgtcttgttctttgctgctctgtacaagctctagaagtcataaaagtgttcctcacaaattgactccttagaaatgctgactctgtgtttcaaatcttataaaaatatctaaatggtagacgtattgttttcattacagatgcattaagtcaaaactgccaaaggctgtgttgtttctgcaaacagggcaactactgcttgaatggggctaatctgtttaggcactgaggggctagctgtgctgtctgcacatatttaatcacaaagctttacttgactttcccacatatttccttttagtatttttacttatggaaagcaagaatcaggttttatagtcattcagtaagtcctctttttaaataaaaattgttatattggaaacagtgtctacaagaccactggtggaaattaatatagccaatataattagtaagttggattcaccacaccacagtaggtaaatcttattgggggcaaaaattgctatcttattcacaagtgtgttgagctgttcttgtattgctataaaggaatacccgagacttagtaatttataaagaaaagaggttagttggctcatggttctgcagtctacaaccatggcaccgctcagcttctggggaagccacagggagcttttactcatggtggaaggtgaagcggaagcaggcacgtcacatggccagagcaggagcaagagggagagagtgggggaggcgccacacgcttctaaacaaccagatctcaagagaactcactatcatggacagcacccagccatgagggatctacccgcatcacccagatacctcctaccaggcaccacctccaaaatcagggagtacgtttcaacaggagatgtggttgagacagatatccaagctgtatcaccaagtgaactaccgaagctttttattgatttgtattaagccaacacatgggtttacccagtaactcatgatttttacacaaaaaccaaattaatgtttatcgaacagttatttggatataaatacatagatatagcacagtgcttcaggttagtttataaaaatcaagtctttcctttaaataataaatgatttatgcattcattcaaatttagaatgctgaggaataaactacaaaaaaaacttgtggctgagtgcagcggctcatgcttgtaatcctagcactttgggaggccgaggtggatggttctcttgaggccaggagtttgagaccagccttgccaacatggggaaaacttgtctctactaaaaatacaaaaaattagccgggcatgatggcaggtgcctgtagtcccagctactctggaggctgtagcacaagaatcgcttcaaccggggaggtgaaggttgcagtgggctgagagatcgagccactgcactccagcctgggccacagagtgacactccatcaaaaaaaattttaaaaaaaccctaattgaatctttccccctgtatttctgagaaaaaggagcaaatataaaataaacaaaaagaatacatatggaacatttatttagaaatcaaagacccagcgtcatacgttctaatgtttgataagatactacccagtttcctgcaactttcacttttgttctgtcaaagattccaaatgatgattgtgagccactgtaacctgaagacatattggatacatttacttatgtgtgttaaattgtgattcttaatgctattttgtggaaaggctggagaagattttttttttttttttgagatggagtcttgctctgtcactcagcctctggggttcaagcaattctcctgcctcagcctcctgagtagctgggattacaggcagttgccaccacacccagctaatttttgaatttttttgtagagacaggcttcactgtgttggccaggttaatctcaaactcctgacttcaggtgacccatccaccttagatttttaaaataaaggttacaggctgggagcagtggctcacacctgtgttctaagcactttgggaggccgaggcaggcagatcggttgagcctaggagttcaagaccagactgggcaacatgacgaaaccctgtctctatacaaaattcaaaaattagctgggtgtggtggcaggcacctgcagtctcggctactcaggagggtgaggttggagaatcacttgagcctgggaggtcgaggatgcagtgagtcatgattacaccactgctctccagtctgggtgacagagcaagactcttgtctcaaaataaataggtacgtacatacctacatacgtactagaatcaagggggttgtttctgagttcattgagttaacgaggaaggtaaattaatcaggaccttcccaagttacccatgtaatattatttaattgtacatgtttaaacaagctcagattacgttgactgtgagtcttaaaacggtaaccacaaacaggttataccaagatccctcacaatgtgtgttgtctgagagaaaaatcttatcattttctttttttccacattcactattgttcctagattatgaaaggtagtcattcactaaacccttctaaaatattccttttttttccaaatatagaattattatattagtaacagtacaggcatgcccataacaaaaaatggaaactaatatagtcaatataattagtaagtttgattcatcacatcccagggtagaatacctcttgaccttcaaaactgcggtcgaccacaattcagattttgagctattcaccagtgagaatgcatggcaatacatgcctaattggcatagttacatgtcattaatttattccttttattcatttaacaaatatttattgaatgtttactatgtgccagacactataatgctgttctaagatagcttatattacttattattgaaattatacttattaaaatggtaataatttgtagagagattaaactttgttttcttgccctccctttctccttctcctcttcctttcttcctttgtttcttttctttctttgcctccttcttttgtgtagccataaacaggagtctactgggtcgtttctgtttgtaaggcacaatctgcctcccaatccccctcccaaaaaaactaacaaaatttagggaaggagctgatttcacatttcttcagagggcctgttagagtgataaaaggcaaaattattttctttacacgaacagtcacagaaccaaaaaggccaaggaagaagccagagagcacatagtatttaattaggagagtttctagtgtcccgaagccacagaagaagcagctgcttaaacattgcttaccctttgactaatggccaaaagcactgaataggagaaggattaacatggataagacttaaataaaagtgatacaatcatcagagcaacaacaaacaaaggcacattaaaaagtaacatgaaatgatgttaagaaagaggtcatggatgcaaaatgataaaatgtttcgttctttggaagtaactctttttttttcttctgttcttagtcatccatctctgtcagagttctcaaataaaaatgcaaaggaaagttagcaccactctaaaacagtgaagggtcagttctctgcttttggatatgtaatttgaatgggaagtgtcctaatgacaattaaacacaattttctaagcacaggaagaggactgataaagtcaagcaatggctgtggcttttcttttgtacttccgttactattaactatatgcaagttaacaaatgctggacagcctgtccagtgagcagggttgctccgttgccaggcttatgttttaagcgacgattgagtgtacacagatctaaacaatcatgtgcaaagtctaagtctctcattttgaattcggaagagagaaccttggtgccccttcttcctgaggaaatttgggaactatagtacaactccctctcaaaaaaaaaatactcctgtaattccatcctaactactgattgctttatatttttgatgtggtgaggagttcagaccccttcttagtgaatgcaatgtttagcacattctttggaatatactgcttgagtctcttggtgcatcagctgaaacttcattttaatatcccgtacgcacttagtagatacttgcctttcctctacattggtgattattcctggcctatcattcagttaagacctatcctccatatacagatttttatatcgttcatcgaaattaagacttgttgcaagtaataaaaactgaactcaagctacctaatacaaatggaatttactattttatataccaaaattctgtgaaaatacaggtgggactggccttagggatacctgatattaggatataaatcctgtcgcctttctctcatgcttttttttcttccctttgtaatcacttctttattatttgtcactgacctcttcatgaatttagaaccacggtcgtcggcactttctaactcatgctttcatagtttcatgaccacagaggaaaagaggctttggaaattctcaaggaatcactgtgactatccacacttgggtcacattttggactcattgcagcagcctgaaggttagatggtatggatgccccagcttaggtcatgagcctgcacttgggaaaaatgaggggaagttatttttaaaatggaaagaagtggaaggcagacattgtatccagttttatatatttatataaacaaaacactgtaagggggaaaatatagacttgaatcagaggagaagagttaaaccaatgtttatatatttctttaggtttgttggaatatatgtgcatgtaattatatcagcaaactacatagtgaagtcagggagacagattagagagataggaagagtgggagggagagaatgtgcaaaacaagcaacagaaagaagagtggggacatcctgagtttgtatgtgaggagaggacagataggagaggtacaaaggaaagggattagaacagagaattagttagaggatggggagataatacaagggagagatagccaggcatggtggtgcgcacctgtagtcccagctgctcgggaggcagaggtgggaggattgcttgagtcggggagatggaggcttcagagagctgtgatcacactactacacttcaacctgtgtgacaaagtgagacctcgtcttaagaaaataaataaaataaaataaatataagggataagtagagagatcatgagagaaaggaacatagagggacacagatgcaagaacagggaaagagaaggggtcagaaaagcgtaatttgtggagagaaaattaaaatgctattattattggtattattgctgcagttgctctcttttgcccattagactattttggcattattggcaggtttaatgtaaaatgagatttgtgagtaacattgatctccaaattataaatgtctttcaataggatatgaacaaatatcatagtaattctcaaagaatattgctatttttaatcaatggagtatacaacatattatattttaaaatcatacaatacttcaaacaccgtgaagagagaacaaagccatatcaaataatgaatgaatggttgtattacggaagtacttgtcctgatagaacacttcaaataccatttggctgctacttctctctgggtttgctttgtatcccatggagatgatctgagcttaagcttttgttagcttcaaagagagctccgttcttgcctcatctctgcagtattgaaaaaacagacccttggttaacaacaggaagccaaactgattttaatattgtgaactctttaccctgatgcaggaaatgttatctgggccatctcagtgggctggggattatagagctggataaggcttcaaaatacaaatgaactccataggtctggtacagctgtaaggtacaggggtagagaatattaggtggtcatcttgataatcatttgtgttatgttaatgcactccaaagtggacttgtttcttctacctgagtgtatatacaaccagtcttttcactattttcagtggttataactcaggaaagagacaacatatcaacatatgaatgtgggtatatccaacgagatctctcttataattttagtccataaataggcataaaaaatgtgttctttcagaaaacacttactggaacctgagataatacaataagtcgaattgctaaaaagagaccccatggatcacaggtctgacctaatatctagttttactaataattttaatggtataggtaatcacatggcatgggtgagccagggagagaggtctttgaccttcagtatagctcgcaaatgctttctttccacataagagcatgcactggacccacaggaaatctctaggtgacatgtgcagtttacattccttgctcaataggagtatttaggtaattaaaatctccatttatattcagatacttgcatagctttttccaggagaccatgcccataaatgcatagatttcaggtttgtttatcataagcagtgctagatagtgagcatttgatagatagggactgtctctaaatgccattaacttgcttgccaggagggtctctcattcatgagtcaaatctcatgtttaataggagatttgactgggctaccttgtttatttccagggagtggtcccttggtgaaaagagagaatgagtggtagacctattatttgaccatattcctcctaaataccttcttggtgatatggatacagagattagcaaaacagtcactgccttcaaatttttttaccatataagatgatgaacacaaaatcaacaccagagataatgtgcctaaacccttaaataacttgtgtgacacagaacaagtatctcaatagacagtaatattttttacgatagtattaacaatgccgtgttaaggtgctataacctggttgaatcttatttggatggtggagtcttagtggacaatggaatttgtacaagttttgagtatacttattctgctgacatttattgagtaacctcccatgtgccagacattatctgacgtgaaatgaaagagaattcctggtttccgtgagtttttagtcttagagaagacacagtcacgtaaataaataattgaaaaatatcataaagtgtttataaaaatctacttgttaagtatgagagtgcagcatacttggcctccagaaatgcagaaagtttcatcaatatacaaattaaatcttgaaggatgagtgaacacttactgggtaaataacaagatgaaagactttaggggaagagaatgagatgggctaagttagcagcatcagtgaacatatggacatgggggtgctgcagattcttaccattggttcccttttggatgttgatctaggaaaatgctggaaaattaggtttgcctcagatgatatattaggccaacaggaatgaatgataataaaaatagctaccaattttgagaaattactatgttccaggtacaatattaggtacacatttttaatattcatgacagattaggaggatgtaacatcttgattttataaataagaatttagttcagcagctagttagatactatgttgggatgtgcctccataactctcttactgcaaacccatccctctccatgaccctgtgtgagctcccctaggcttcgaagcttgcacattgttctcacctgacaggggagcagtgaaacaacactaggaggacaattagtcatcattcagagtgtatatcagtgtgcctctgcgaacacccacaggaaaaaataaatctacgaatagtgagattgctttggaaatacaatatcaaaacaaggtcactgctaccttctctctccattccatcgagattgcagctcctggcacctcttcaacaggaagttgttggccgcctctcccttgaaggttttagtaggagaatgaaaggatcagtattgggtttcagaaagataaattgcttaccaattgatggaaaatggcagcttagagaatctgtggttagagaaaattgtttgaaacttactataatatttcagagatgaagtaataagaagaatctggagtggcaaacatagatcaattgattgaaactaaaactaataagacttgctgtgaccattgaggggacccaagatatcagtttgaatcactacagtgagcagtgaggctacttagatagaaattgccagaaaaagaaaataaatgaacctttggatttactgagtttgtgggggctgaatgctaaagttttttgtttgagttgggggtagcttataggcaggcaggaactggctctgatgcaaacagaggtgatgggatagaagacatggatttgggttctgatgactttgtgagagtgaatgggaaagcacattcaatggcaagaaccttacaaggaggtagggcacaatgtggttaagctataatttttactatatttcttcatttttattggcatccaattattttatatgtactcactatttatttaaacagctttattcatggggtgcctattctgtgcaaggcaatacctttggcaatgacgacatgatgatgagcaaagcctgaatgtttcttactctcctgagtttattgtctagtaagagacaagcatcataagacattacactagtgaatgtataatttgaaactgagataagtgctctcgtgtgaaacatcttatttctaggaaaaaaaaaagtgcaacaaaaaaaagagaaaacccttgtgatatgaaaggtttccgaagaaagtgcagctgtgttaagacctgaaggataagagttgccatctaggcaaaaggtgatgaaagtaaaggattctccagactgatggaaaagttataacaagagattggagtgtttaggaagttaaaagaacatgtaattgaagctcaggagggggaagagagatgagagatgtgtgtagagtccagagcactcagaatttgcagaataataaggattttgatccatgttctgagtaatgacatgccattgaaggtttccattttttaaaaatattaacccagatctcctttacatgagcaatacagataggaagtgctgaggaatcaaagtagaggtagaagggattcagaccccagagtgtctacattaggagggagctgaacctcatcaagttctttccataggattttcttcatgcacaaatatgcatggctggcttagtctgcagaccacatttttggttcacctagtgtttcagatggcagatgacataactctgagtaaattagaagttctggctgtaccaaaaatatatacatcaggaaaatgaaaaaggaaactgttctgtgctgcttaagagaattcattgccaacctcctactggctgttctgacccaataaacaagcaaaagtgacttgttagagccagcagctatattttgagtaccattatccccactgaataattcaacacttaatggtggtgattttggttgctcagagaaggtattcttttgcaattgtgtagctctttgttgagattcagcattgtctagttaacagtatgagaagcaaagcagaattcttgctgtgaaaatcactacttctaaagagatgcggcattgccatatagtagttacattgtgcaattactacatggaaattacttgctgtcttgtagtctttttccggaaagaagacactcttttttattattattatactttaagttctgggttacatgtacagaacatgcagttttgatatataggaatacacatgccgtggtggtttgctgcacccatcaacccatcacctacattagctatttctcctaatggtatccctccccagcaccgcaccgccaacaggccctggtgtgtgatgttcccctccctttatccatgtgttctccttgttcaactcccacttatgcgtgagaatatgtggtgcatggttttctgatcttgtgatagcttgctgagaatgatggtttccagctttatccatgtccctgcaaaggacaagaactcatcctttttatggttgcatagtattccatggtgtatatgtgccacattttcttaatccagtctatcactgatggacatttgggttggttccaagtctttgctattgtgaattgtgccacaataaacatacatgtgcatgtgtctatcgtagaatgatttataattctttgggtatatgcccagtaatgggattgctgggtcaaatggtatttctagttctgcatccttaaggaattgccacactgtcttccacaatggttgaactaatttacactcccaccaacagtgtaaaagcattcctatttttccacaaactctccagcatctgttgtttcctgactttttaaagatggcaattctaactggcatgagatggcatctcattgtggttttgatttgcatttctctaatgaccagtgatgatgagcattttttcatatgtctgttggctgcataaatgtcttcttttgagaaatgtctgttcatatcctttgcccatttgttgatcaggttgtttctttttttcttgtaaatttgtttaagttctttgtagattctggataggtcttcgtcagatggataaattgcaaaaattttctcccaatctgtaggttgcctgttcactctgatgatagtttcttttgctgtgaagaagctctttagtttaattagatcccatttgtcagtgttggcttttgttgccattgcttttagtgttttagacatgaattctttgcccatacctatgttctgaatggtattgcccaggttttcttctagagtttttatggtctaggtcttacgtttaagtctttgacctatcttgagttgatttttgtgtaaggtgtaaggaaggggtccagtttcagttttctgcatatggctaccagttttaccaacaccatttattaaatagggaatctttttcccattgctagtgtgtgtcaggtttgtcaaaaatcagttggttgtagctgcgtggtgttatttctgaggcctccattctgttccactggtctatatatctgttttggtaccagtaccatgctgttttggttactgtagacttgtagtgtagtttgaagttaggtagcgtgatgcctctagctttgttcttcttgcccaggattgttttggatatgcaggctcttttttggttccatatgaagtttaaagtaatttttttccaattctgtgaagaaagtcactggtagcttgatggggatagcattgaatctatacattattttgagcagtatggccattttcacaatattgattcttcctatccatgagcatggaatgcttttctatttgtgtcttctcttgtttccttgagcagtggtttgtagttcttgaagaggcccttcacatcccttgtaagttgtattcctaggcattttattatctcagtagcaattgtgaatgggagttcactcatgatttggctctctgtttgttattggtggataggaatgcttgtgatttttgcacgttgattttgtatcctgaggctttgctgaagttgcttatcagcttaaggagattttgggctgagaagatggggttttctaattatacaatcatgtcaactccaaacagagacaatttgacttcctatttgaatacactttatttctttctcttgcctgattgccctggccggaacttccaatactatgttgaataggagtggtgagagagggcatccttgtcttgtgctggttttcaaagggaatgcttccagtttttgcccattcagtatgatattggttgtgggtttgccataaatagctcttattattttgagatgtgttccattgatacctagtttattgagagattttagcatgaaggggtgttatattttatcaaaggccttttctgtatctattgagataatcatgtggcttttgtcattggttctgtttgtgtgatggattgcatgtattgatttgcatatgttgaaccagccttgcatcccaggtacgaagccaacttcgtacctggtggtaagctttttgatgtgctgctttttgatgtgctgctggattccatttgctagtattttattgaggattttcacatcaatgttcatcagggatattggcctgaatttttgttgttgttgttgtgtttctgccaggttttggtatcaggatgatgctggcctcataaaatgagttagggaggattccctcttttcctgttgtttggaatagtttcagaaggaatggtaccagctcttctttgtacctctggtagaatacggctgtgaatccatctggtcctgggctttattggctggtagattattgattacttcctcgatttcagaacttgttattgttttattcggggatttgacttcttcctggcttagacttgggagggtgtatgtgtccaggaatttatccatttcttctagattttctagtttatttgcatagaggtgtttatagtatcctctgatggtagtttgtatttctgtgggattggtggtgatatcccctttatcattttttactgcatctatttgattcttctctcttttcttctttattagtctggctagcggtctaactattttgttgagtttttcaataaaccagctcctggtttcattgattttttgaagggtttttcgtgtctctatctccttcagttctgctctgatcttagctatttcatgtcttttgctagcttttgaatttgtttgctgtttcttctctagttcttttaattgtgatgttagggtgtcaattttagatctttcctgctttctcttgtgggcatttagtgctataaatttccctctaaacactgctttaaatggaaagaagacactccttaaatgacttggtgggagcttttattttatcaatttctctctgataaattatactggtagtcatatctggtcacggataaactttatttcgtttttgactgtcaggcatgttgaattcaaattgcatgccaaaccataacatttaggaaaacatcatatctctagagttataattgatttgtgctaatgatatgttagtagaaaagaatgacagtttgatttctttcattcaaaggaaaatctctacagtaaggaagaaagtatcatggctaaaagtcacttttatttaatctcaggttttatcaaaatatttacagaacactttgtctttgtcacctgctagtcattcagtatatttcaatgacgacagtattatctttggaatcacaaaaatatgatgtaaaagaaaacttttctagagtagagtgaatgcttaaaaatataatatatatccaataaatgaattacagttaggaatgttgacatgattaagaacgcttgcattactgatagtgacctctgccctattataactttatagctaaaaagtttaagatctttcacagtttctccttcagtaatcctttttccaaactgaatttcgagtgcctagtaacttgtgatttttctaggaaaaacccatggtctttacctgtttgttctatagataacaccctataacttgcttttttcacttaacaaaaaataatagatatatcatttatataacagatataaggcatactatacattatatataatataaatgtacatataaataaaaataaatataaatgtctggaagtgttcatatcttaaatgttttctggcagggatggggagaagagggttgtataatcttcaaatttttactgaatacgttcctttgccattattttctgttacaataagaatatattttattgtaaaataagtaaaaacaaattaattaaaaatggtacgtgatgataaaaacagtagttcttagaaatattatcaatattggaatcaaaacacataagactattaaacatgtgtatttaagtaaactgcacattatatccagaaaattgaatctaactggttatcatgcaaatgaagaaggtaatcagttcaaaaatgacatagtaactgatattgccttcctgttcttatttcttattcatggaaaacgaggacaagatatgaagggtttagggatctaggtcattggcccgggatttggcattaattcttctcatacaagcacagggaacgatcaatcagtgttgacagctctaatgccatcgttggagcagaagatgagccaaaggaaattatgagtttcttataaatgtgtcttaagtatctggaaatcatactttgtatcttatggcttgaatagaatacgtttgcttttaatgatttgtacagtgagaagattaaaatttctaccaacatatccaaagcactgatacatctattaaactgtttgcaacaaaaatacctatacctttttgaatttgaataaaaaatcccatttaaacaaccactgggatgtgattatgccccaaatctctctgattatagttggtttgctttattatattccacttgaaaattttgaattgacaagagggatgtttctgtgaactacagattttagaggaaaataagactaaagttttttgtatcactgtttggtgtttagcatttttcaaccagtaaattgtctttaaccaaaaaatttgtctcagagaatggaaaaagaaatgtgatgacaaaaaaaataatgcaaaaaataaacagttatgaaacagtatagagataaaaaaatcaaaggtgagatatcccaaaccatgaactatttatcttaatcatgcagccttttcatctctgaaagaatctattaatgtcatattcaaatgcttaatgttcactagcagttgataattatgatgaccatccctgtcactacaagatccttaagtgccttttgatgagcaaagaaaaataaaatcatattcaagtaccaactgttggaattcgtactttaaatacaacctgagaaatggccttaggttaaggctaatggtgtataacttgctcacatttctaaagagtatattttctgacaatgattccatatagaaagtttaccgcagataatagtttcttcatatttgcatcctgacctaatttttggtcattaggttactttttataggtatcaatattttccaagtcctagagaaaaatgagagttttaattttctcttataacctagctaccagatgctatgtggcaaggacagtcttaggatgaaattgtccagacaaacaaatatgtattagccatcaaatgtacacatatgctcataagtatgtgtacacatgcacaagcatgcatttacacacacaaacgtacacttcacagaattataccctgtattctgtcagcttgatggagtcccagctgttaaacctttgaggcattgtgacagaaatctgcaagaaagcttcactagaggcagatgagataatattctagctgcaggattcagctacattttcgattggagtcataggaaaaaacactcattgcaaaaatgaatgaaatcctaagcctggagtgcaatgaaattgtgtttaggctgtggggctcccttgattttttaatatcctattcactcaaggatgcttgtgtctgagcaaacatttctagcaaatccaccaatatatacaacactacttgtttttttttaatggaacattctgctaacatcgactatagtgattaagccatacttacacacttaacatactttacgaaataaagatacctgaagtacatgtagtaaccagtgctgctacatttgactagagatttagaagagttttgtttaagaccttttgaatattgactgactatacttatggggtacattaaaattcagtagcctctacattaccacacagcctatgctaaagtattttaaagtaaatttcagaaaagttaatgatttgtttttgttgacacttttaagaaccactaaaacctatgaatatggttggccttaagtagacactgtaaaatgaatgaggttgagagatattcatttaaagttctattagcctttatggaattattgtgagaagcccagcaatgttcagctcagtgttttacattcagatccatatttactttaacgagtatttcagaaagtttaatttctgagttgtctttggatgaatgagaaaataaaaggaattcagaattttatcaaccgtctatatctatgcagattatattcttttgtggacatatgtatgaaattcattcgttcatccagaaggatttattatgtgtatttcctatattctaggcaagcgcaaaaataatgaataggatctggcaactgcctcataaaatgtacagtctcctacaaatatgtagacaaggcaggtacaaaaaattgtgagcccttgtttattttagttttataagtaatgtgctcactactgatatccacctgaacaatttgattaacacaaaaaactggagaagtagattaaaaccatccaaaacattgggagatatagatagacagctgatagatagatagataatcatataaacatagatagtcatataaacatagggagattatatatatagataatatctatattatagaacatatatatgttataataatatgcaatgatatctatattatataatatatatactagaatgataaacaccgttattaggtgagctgagacaggaaggaggcgcgttggtttgcctctccagaccttgatctggctcagatggagctccagttccttgcactctagcacgtgtagccctctgctcagcacggccccatccttatgcgatgcacgacagaagctcgccctgctggaactgctcctccagaagactgctgtttgcggcattcattttcctttcattatatttttttctgaatttgttctggatcgttttttgtttaaaatctcttcctcctcaggagtccgctgggcccccttcttgtggcccggacggtgcacagtggagctcgcactgctgttgccaaggtgcgcggccggcagctcctcgccagggccccggtgcaggccggctggctgtgggtcacacgcagacaagatcagcgaccctcgttttgcgagtgcaacactcccagccacagaagttcccgggtccagcctcagagcccagtatttcccacggcctccccacacacaccccgcgtggatgcggcgagggcccgccttagtcctggcagtgcgcaccccagctcagactcccgcttcttgtggcagctccttctcttgcccctgtgccttctgctgcttgtgccagttgtcgtgagagatgcccggtgctgggcgctggttggaaagaaaaacttaggtatatattttctttttctttccttccttccttccttcctccttccttccttgctttctctcttttcttcctctttctttctctttctttcttttctctttctttctttcttattccttctctctctctctctttctttctttttctccttcctcttccttccttctttccttccttccttcctttttttgaaacggtctcactctgttgcccaggcagaatcatagctcactctagcccgaaactctggggctcaagcaatcctccaaccttggcctcctgagaagctgggagtataggcacgtaccctatgccttgctaatttaaaaaaagaaaatctttgtagagatggggcctcactatgttgcccaaactggtcttgaactcctggccttaggtgatcctccagcctcagtttctcaaagtgctaggaatacaagcatgaggcactgcacttgatcctatgtttttctaattagttttctacttttaaatgtaactgtaagttgtaatcaaacattatatatattatcctttaaaaaattctgaatttattgttatggttaaatttttatcattagtttccagactcaatgagagtcatttttctattaatggaaaataagggacagacctttcagcttacctggaagtgcctcatttcttttttgaaaattcctgccatggtactgatcaatgttgatatatatgtgaaaaaaataaagaggagacaaacagaggggatggtatttaataacaagagaatagtagagaaggagagaagacagttttaaaaatgagcattcatgggttgggcacagtggctagcactttgggaggtcgaggtgggaggatcatttaaggccaggagtttgggaacagcctggacagcatagtgagacccctatctctataattttttttttaattagctgcatgtggtggcggatgcctatagtatcccagctactagagaggctgaggcaggatgctcacttgagccaagagtttaagactgagtgatttcaccactgctgttatcagtctgctgtgattttaggtgtccaaggtgggagtgagtgatgaaaatctgaaaaagaattaagaggatgttctctttaatttacaaatatatttttgaagttgattttttgttatagcttagaaatctgtcatatattattattgcttcctctcacatattgcagtttttctttccaggaagatttcattttttagtgttgttttaggttcacagcaaaattgggcagaacgtgcagaaatttctctcatactaccggttctgcatatgcacagcctctccgttatcaacaccaccagcagtgtgcatttgttacaactgatgaacctacattgacatatcaataacgccccaaatctatagtttacattcgggtttcttttggtgtatacattctacgggttttgacaaaggtatagtgacacatatccacaattgtagtatcatacaaagtagtttcactgccgtaaaaatcctgtcctcctattcattccctcttctcccttaacccctcacaaccacttatctttttactttctcaatagttttgccttttccagagtgtcgtgtagttagaatcaaacagtatctggtgttttcaaattggcctgttcacttaatgtgcctttaggtttccttcacctcttttcatggctgatagctcatttctttttaccactgatattccattgtctggacacagtatagtttatttatccatttacctaccaaagaatatcttggtgactttcaaattttgataaatataaataaagctgttaaacatccatgtacaagttttttgtggacataagttttcaactcctttgggtaaaaaccaaagagttcaatggctggatcacatgtgagagtttgtttagttttgggggaagccatcaaactgtactccattgtgactgcttcaatagtaatgcatatactatatccacaatttattgaccacacaacttttttttttttttttttacccagcatactatagcatcagtatctgtcacagtgagggtttgcacttttcaggtagggctgttcttccttgggcaggactgtgctgagccctgcaggtcgtttattatccacggctcctgcccactggatgcaaatagcactgcccagtcatgtgacaaccccagctgctcccacataatccaaatatcacctggaggagagatagcaccttggttgtaatccaaaaggctagaggaacacaaacaggtcttaccctcttatgagctggccatgtgggatgctccaggagtgaagctagtggaatgtttttagtgactgaaagtccttaagaaatgtgaaaagtggttacctggatttatacatatgtaaaagtttgctgagctgtacacttaagttttgtgcattttagtacatctgagatttttatttaatttgaaaaatagtccctacaggaatttcacagctatataagttgttttctgagaaataactcagaaaataacttaatgttgggattattctccatccctgtagtcaaatgaccatgaatttccgtaattttctttcttagtctccactgtgaaacaatttgaattagatgtcattacagtatactattttttaagaatcttacatgtataggtgggaaaacaaaaacatgtatatacataagtttttatataacctgtatgtatatataggttatattcaattatattccagttagagttcaaccacagtaatttgctatttaaataaatgatattattaatgatattagtttatcccacatcattattaactaaagctgacattttcccaataaaatcaatttgcttataataacatcgacattcctttgatctactgtgtacaaaatgtgccagctctgcagggatgatgagttaacactctaagcagttcttttgtcgtgtcactgcggtgttatgagacatgaaagagtgtttgaatggatatggctataatgcacagtgtttcctttgttttcagagtaaaagccattaacagttatttcaggattactgtgtttatgacacttgtaaattgatttatggtattagccaggcaggtgattgaacaaaagccttttaatgtttgtgtatgtgtttatccttctcagcttcacaatgttgagtgattcagatcacacttcaggcttatggaaatttgctggacctcctccccataagaactgattccaaaccaggggaatagtttaacctagcctgataatcacataaaaaggagtttcataaagggacacttgaggtcagagagaagtgaaggtgacatccactccatcatgaaaatgtcaaatggctttatataagacatcttgcttgatgcagctcagtgattcttaagccattttatcatggagagaaaagaaaatttaaacatttccgagttatagcactgtctcagactattatacaaatccattgagttatttttaaaactataatttggatgccagtgtcataaaatatctcttcctgctggctataataaaagttgttgatctatttcaagcatcctgagtagaaaaatgttgtttaatgattttgcatgcatgaagttaatttctacctctggaactcatagtagctgaaacaacttaatgctgtttcttagtgaagaggaatgtcaacgtagcatgcttttttttcccttcttttttggctgtgtgcattccatgttgtcaatgaaaatggcagatggactgtcactgacatttctgctttgtgtagttgctgccatagaaatgaaaaagtttttaaaatggtgacgataagagtcaccttttgttcactgaatttgctgtgttatattttcttcttggaaatttgacctaaaactgtttgtgaataattattcagaaaaaatgtcaaggatttttaaaaatcactaaaataaaatgtgctatgtcaaaccagctgcctttctaagctgctttttgcccatgtatcacactcatcagattctatttccctctaggataaagtagaaacctctttttttaaattccagcatataaatttgaataatgttatttgcaaaagggaaaatcgaagcatttactattcattagagccattagagaaccatagtgccaaaggttttgtgtaaacatgacatcatgactgttaggtgaaaaaaacaagtgattattaggaaatgattattattcagagtacattaacaatagccttgggtctttaaagtaattttaaaataatttgttttagtgttcagtttataatggtggaatgatctataattgtccaaagtgaaaacttagtcttaaccatttgtatgcattgttgcctttctatgctttattattggaatttaaacagtctccagtggaaacataatgcaaagttggtgaattaaggatcaaagcattaaagaaaaatgaacaggcatcatgtatactaacagctaccaagacttaaatgatggtgtactataaaatgggcttacattttctttaggtgggctataactttcaaaactcttaaaccaagaaagaaaaagcaatgagttacattagttgcttaaactaaatatgcagaacatacacactgatgtttaaagaaaccccacattttctcatcttgttccaatagaagaggtgcagacagtatggtagctttaagaaagtctttttttctgtttgttttttatttttattttagatgtatggcagcaggcattctcaagattttgtctaccttttgcctaaagaatctccttactgctgttgaaatattttaggctgatttctgatttccaaagactgaataaacattaaaaatgtttccattaggaaaatgttaaaatgcacccccaatagaaagattagcataacctccccccaatcttgcactctctctctttctctctctctctctatgtgtatatatatatatatatatatatatatatatatatatatatctgcttcagcaatattcattattgcatcaatttgtttattctatctcttctacctaaattagctatttctaccttgaaaaccatcccaaaacactgattcaataaaggaaacatttattattgttcctaagtctactgtttctttgggagattctgctgaacttagccagtcttgactgatactgaccagctggttctagcatctgtgttcagctgacaggttagtagggcagtctcatctaggatggctgccattttacgtttagtggctggctggctgttggccaggatgatggggatgatgggcaaaatgtctcttatcttccaacagggtagtgcaggcttctttttaaaatagctgagcagagttttcagagacagagagaaagaggaaaaaggtgcaaggcttcttgaggcctagactagaattcatcctagggtcaaaagcctaccagattcaagaagtgaggaaatagcttcttaggaggagctacaaagtcttattacagagagtgtgaccacaaagaggggaagagaatcagagaagattttgcaatcaatctactacactctcacacttttggggagagtattttatatcaatcaatatcatttcaccactatatactttagagaatttgcctttattttgtaagttgttatgattttgtaactctaatagcatccacaaagttaaccatgctccttggatcagaatattagtaggagggactatatcctcattgccactatcaacacaatgatcatcactttcactagtattagcaaattttatttatttttctctgctaatgacacattacctcacttaaatctcataagtgtgctatacagcagcaactatcaccccagtttgtacagctgagtgagcaggctgggtaaactgcccacagccatctagcaatggtggctttgaacccaggtcatactaactttcccatggtctcatcactgcacatcactttgtcatgtgaccagtcaggaggccacagtagctttgcacttacttgggaggccaagtagaatggacaaagacttagccatctctctcctccatttctcaaggaataatatgaatttaaattaagggagcaagttgtttctagatttgccaccatggagcacttttaaaaacatcaaggggatctatgtggtcactttataatactcatgatgtgtatgttagaggcttctgttttgaagaggcaaagaattttatttcctttttgttgtgttggaagttgccctaggaggtacgcacgcttgtccatgttaaactaatgtcttgaaatcagtgtattcttaattcttatcccactagtcgtactggagaacctgagggagtcaggaaggttccattgcattgaagcgactgcattgtctggggtaaatacctggggttcattgtctcatgtcaagaaaatttagaacatggacacatatgaggagtttagaagcagaggtttaataggcaaaagaaagagaaagaaagataaaggaaaacaactctctctctagtgagagagaggggcttcccagaggaaaaggctggcctgctgcggatgcactatattttatagacaggcttgaggaggtggtgtctgatttatgcagggcccacagattggttcgatcaggtgtgacgtttacatagtgtgcagaaaaggcttgccaccctactcttattaccctaatcttatgtgaatgggctttccagttgaccggtgccatcttgtctgctccttactgtacatgtggctgggaagggaagatggagccaccatttttgaacatgattggcacaactgccagggtctatgtctgcagctctattttacaggttgctctttgttagaaaataatttgggggctgcatttcattgaaaaggaaaaccttaccgaggactctagtaccctcactatctgcctaagtaatttcttcttaactcctatgtcagtaagatgtgacagtaagatatgtattatgttggtgcaaaagttattgtggcttttgatggcaaaaaccacaataacttttgcaccaagctaaatttttcttttgaagtggttggcagggatgttttttttcctaaggatgagctacgatcgtaggaattaaaatttaacccagtttacccagattcataaaaattaatagatttctttgtggatctgagttgatatcattaatataagctatcagacatcagcttcatgtgacttaacttcaaaaatattttagtaagagtatgactggaatgtttataacacaaagaaatgataaatgcttcaggtgatggataccccaattaccctgatgtaattattccacattgtatgcctgtatcaaaacatctcatgtaccctataaatactagatactcatagaaagtaaaaattttaaaaaaattagttcttgtcttagtgccagctccatcctgagtttcaacaattgctattatctttgaggtctagcatgaggcattaaatgccattgtttcaagaaagataaatgggaatataattttattgctatcttactgttgcaaaatggaattcctaagaaacataccctttatgaattctggcaatgaaactaagactgactttccgttttcaatctgaaagctattttggagctttcatcgtcagctaatggagtcttacttgaacggggtcacatttaaacttctaataatttttatgttgtagcctgtgaacatacaaatttcaggtaaattgaagctaattcctgcaggaggtaaggtcatatgtagaattagtcattattcatattctgaaaagtgatgatgtcattatgggagagaatttcttgggtcaagaccatgcatttaaaacgattaaaattcaaaaaatgggatcaccattactgaataattagtatctataagctactttactaaaattagagaccagtgaacttactgccctaagtcaagagattaatggaaattgagagtgttctcacttatttggctatctagttattcttgttccctatttcagaggtgagatgatgttaaatattaatctggaaatacgatctcctagtagcataatacttgggaaagtcttgctccttacaaataaaaggcaactcataaaacacatacatgagatgctcttaaagccatcagcattgaaaactaatggaaccgagtattaaataataactagattgcaagtaaagattgatatataataaacaatgactttagatgactattaccaaactgtttcagaaaaaaaaaaaaacaggaaaaagaaaattcgaaggggcagggcattgatattttcctcaaaattttcatattaataatagctacatggtttaatgtctcccaactttgtacaaatacgtaggactcaccttttgtagttaaggcagtattttgctttttataatgaaagcatttttccatgttttatttcattgattaggataactcatttcatcagaagagtagtgtcaattaacatagtgacacattgaacatatatgttaaatttaccagtagaagttaaattacaagtataagttatttgtcattagaaaatattctgaagcatacatgagtcattttttccaattcccattttaagatgggtcagttgaggtcagccagagtagaataatgccattactctaattcaggacaaagattcacaacttttttggaggtgggagggtagtattttcttttatgattaatataattttgttctcaaagtaaagcataaacagtgttgctgttccttaagactgctaaaactgtgaaacaacagccattagttactactttaaattttaccaatcggtacatatatacaaaagatacaggtctataatatcttaagatgcaatttaaagtgaaataataaagcggaaatacttagaatttaatgtaagtttaaagactttactatctctgtgttagctaacttttttcaccagttctaagtgaacacatagagtaattgatttttagaaaacaaaacaaaattacatacctgaaagactaattctcacattttggagcaaattattgtattattacctgcaagaatacatgatagacaatgtataaacaatgtttagacatctattaacacaatgtttcagaaaaaaattgaaattgtaagagaaagtaaaaaaaattaaaaccttaattcttattctatttctgtaaactttgaaatgaataaatattctgtttaaatgagaagcatcttacgcctttgtcttctgcttgaaccaaactcacatttgtaaatttcagttaaaatggtggcctttattcttttgttctttattatttctttcctctatcttgctggaactatccatcttctattagtgtgaaaactttgaagatgaaaagctatttcaccggaaaaatcattgatgtatttgtgatccttaataatgactcaaatgggaatagatatctaatatgaggaactgagtaaaaaagaaccactttttaaataaaattaactaaatgaagttattgtcttagccattaacactcatcagtcatatacaccatggaatactacacagccatataaagaacaaaattgtgtccttgcagcaacatggatgcacctggaggtcattattctaagcaaattaactcaggaccagaaaaccaaataccacatgttctcatttagaagtggaagtccaacactgaatacacacggacataaagataagaataatagaatattatggacataaagataagaataatagaatattatggacataaagataagaataatagaataattgtggactactagatgggggagggtaagaaggagtgaggattgaaaaactacctatcgggtgctatgctcattacctgagtgatggaatcatgtatacaccaagattcagtggcactcaatttacctatgtaacaaacctgcaaagttacctcctgaatctaaaatagaagttgagaataaaaaagaaaaaccactcatgtgtataatatcataccttccaagtaaaacttcctctgacttaggattttttggaatagtctgtggtttacaatagagtatatattcgctgtcctttattttacatacaaagaggaaaaactaatttcattcatgcggagttatgagagaacagtttcataaggaggaaacatactgccaaaccaaaaaaaaaaaaaaaaaaagaaggtatttaatttgttctgttgaaattttagagtttgtgaactaacatgttattctgtttgtgtttttagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcaggtaaagttaaaacattcagtgcctattaatggaatttcatatttgcattttgatttttaagtagaatacttatggattgaggatgtgacttttctaccatatttctatatattctttagcaatctgtcatgagaattcatatctatctttttcgttttgtgggtggctgatacatgactgctgtaattattttgcaacccaggcttttagttccttatgcaaacttagaacataacaagaatagtaacctatagataagctagtatttttccatatgtcttggattatctgcaatattaccaacaacttcacttttgtatacttaggttagttaatcaagattcagaaattactggcattcaacaaattatgtcgaaaaggaattggatgaactttgtattctttttcaaaatgattatatttaagaatgaaaacaatgaattagcaaaacaataagccattttacaagtaaaagtataagatgatatgaactctcaaaatttacggcattatatagtgtgaattcatattaagaggttaaacagtagtctgatggaaatatataaatatatattctaacatatattggtaaaatggatgcagatttttagccattataaatcagtttgaacgaaccatggtaattaatagttaaaaaaatagatcagcatcagcaggacatggtgacacatgactgtagtcccacctatttaggagtctgaggcaggaggattgcctgagcccaggagttcaagactatagtgtgcaatgatcacacctgcgaatagacattgcacgccaacctggacaatatagtgagactttgtttttttaaaaaaataaaaactaaaaaaatctgcaaacagaacatatgtaatagtatatcaagtctgccatgtatagatcttgcagatttttcttgtattacatgcatatgggttctaaaagacccacgagaggttattaagacatttttatccgtatcattcaggaataatctctattgcatcttctgtatataatttggagggttattatattagaggtgttggttgtttattagaattttagcattgcaggtgatatttgtggattttctaaattctagagaaataatcttgagctcataaaatttaatacatcttagaaaagtgttgggacttaactaaaacgttgcttttgaagtgctcagacagactgaatgtcaatagaaaggaaacaactctctgactatctataatataatgtatttaaaaactattctaagggccaccttaaattacttgatgtacctattttatattatgcactttggaaagaactgaaattgtagttccatccccccaggtagaaatcccttctctattatttttaacagataagtaagctctgttttgacatttccatttcttaagaaattccacttatctgacctacaaatatacagacttaaagtctgctttacatttggctgaaatctttcggcctacacaatgtattagatttcttcactgaccagcctttttgtagaaattctggtcgggagtctaaagtaccttcatctttagtgaattcttttgctttgagtatgcagtagcaagttaagagcaagcttcttggtaatcctgtggaaaaatgttaataatttcacattgtcttccgaatagcaacgaagatgccactgagattactgattcagatttttgaccataatctctggcatacacatttattcttcatcatttcttactttgtcagtggtgaaggatgtgaaattttgtattaattcctggcccacatttttattctggttgtctcagttacttatgcattttcatgctgtaaggtccttagacaacaattgttataaaatattaatggcatattttcagaacatctgaatattattcatttatttcagggctctagagcactcacaaataaatgcaactaaggcagatatccaatttgaatgtcaaggagtctggtgtctctgtaattggcttaattatagaggaaaggatttataatgtagaatatatattcttataaacacccaaaggttattagctccgttccccaaataattagttattgctgagcctttacaaccttagcaaatttaggaaagaataatgttctaataaacaagttgttcacaagttattagctgatatctaagggactgtggccactgtgtatcatccctcaccgtttataactgcaataaaatttaaataatatgaatttgcaataagctcaagtcctgctctacacagaaatagtagtagtcagaaacaaagtaaatgtgaatgaaaatacagacattttgcatgttggtttatgaatatccagtagataaacactgaacttgagctaatatccataacctggtaaaactcacttatcagatttatcgggcaataatgaaaaattaaaaaaatagaattaatagaaaaaaattagagtttggaaaggcatttagtttttattctactctggctgtcaatgctcaaaatgtggtttccagaattcttggggtcccagggacacatccagatggtctgtgagattaaactgtttttatcataaacctaagacgccattttttcattttcactgcgttgtcatttgctctgatgatacaaaagtaatgagggctgggcgtggtgtctcatgcctgtaattgcggcactttgggaggcttgaggtcaggagttcaagaccagcctggcaaatgtaatgagacctcatctctaaattatatatatatataaaatatatatatatatatatatatataattatatatatatatataaaacgaatagctgggtgtggtggcttatacctgtagtcctagctacttgggaggctgaggcagtaggatcatttgagcccaggaggttgaggctgcagtgagccatgatcatgccactacattccagcctggcactggcatcaaatttactggtagtcaggtgatatttaatgtccatatactcagagtaaaaaactctcaaaacaaagcaaaacaaaaacagttttgcttatgattataattgttgaagcacttaaaaattattaatgttattaattatctaccttggaatacatactttctaacattctagtgaactgggaagtagatataaaataattctgctatgcgtcaaagtattatgacaatctctatttcttaattgcatcattgcttgagtcctgagctggacatcatctttactttaaagttatgactgacaaattatggttgttcagatagatataggtcagatattttcctgaaagtgaaccaagtgagcccattcatttcaagataaacaactgaccatatataaggtcattgattaaatgtgagtgttcaagaaaacattagaattgtggaggacatgtattgtccactgtaagcttgagagcttcccgatacttaatactgctgattagatcagtggcaattctaacaagtgtcaatttttgatattctataatgaaatgcatcaatgtttggaagacacaaaattcagtgagcgggtattttttccaaatgaaagctccatgatgttacaaaatcatttgtagattaaaaaaagtaaaatggtttaatggtacacagtatgaaaagttgattgatagggtttagatttcacatttcaatgaatgtttaaaaaactacacttgtatctacaatcatcagaaaggactctaaaatttcccatcattttttaactacgttatctgtgtacggctggattttctttatatctttgaacaaatcaaccctatttcaacagatgaaatgcagaagcagataaaagaatccatctgccttctcaagaaattgcagagatggcctttagttctagccactcgaaaggctgaggcgggaggattacttgagcttgggatttctaggctgcagtgagcaatgatcctgccactgcactgcagcctgcatgagtgagcaagaccctgactcaaagaattaagaaaaaagcaattacagagatttgcaatcatgtaaagtaatgcccttcttctcataatatttaaaggttttcataaaatatgtgatttactttaacattgaattattttaaataaattcataagtaaacattttgaaagacattttgaaagactttttcagtttttattcctgttatagtaaatattgttagctataccccacatgaacaaatgctctttgagatgtcttgtaatttgtaagactgcaaaagagtcctgagaccaacacgttgagaacaatttatctaggctaaatccttaatattacaaatgagaaaacagagagtggttcagggcctggtccaatgtcacaggttttagggcctcatttgcaactctactgtggaatagtacttatttaagttaggctctgtgcctgtctccaaattgcttttctcatactttatttgccaaagtcaggtccctgctgcgaaacagttttcatttccttgtgaatcaaccctgtctttttattagagattctaagaactgtactaaaactgggatgtctccttttgaaaaatattgagtgctcatcagcagtagatctttacacacttcatgatctatgttttatttcaaagcttaatccaagttgtatttccagcattagtaaatttattttatagttgtaattctcagaaatgtaatctcgctgctctactaggtgagaggcaaaatcacttcctactttatttatttatttatttatttatttatttatttatttatttttacttttatgaaagagtctcactctgtcacccaggctcaagcgcagtggcttgatcacacctcacaacagcttcaacctcctggtctcaaaattaatccagttaatttttacatttttttgtagggataagagtctccctatgttacccaggttgttcttgaactcctgggcttaagtgaccttcccacctcagccacccaaagtgttgggattacaggtgtgaggcaccaagtgtggcccactccctactttttaaaattgtgtttgtcttgtagattacttatcaaacactaacagagtttgtcacaagaggaggggatatttgaatatgaagaatctattaatgccattatgcatcagttattattatataataatggttattagtaagttaaattctctaaggaaacagaacaaaacttccaatagataagtgagaaaaggttataaaatgaaaacataaatgaggaataacaaacactaaacaagcccatgaaagaacatttattacccaaaaaaaaaaagaaaattaaaataaagggaataaggagtttatattttcctttgtaataaatgctaaactattttattattttgaaatgttagcattcactggtggcaaaaatatagagaaccactctatttttgttatttgtgtatatattctgtggtgaaatgatatttacaatttacccagagtaattaccacttgtgtccatgcctggaaatttatcataaatcagtaattcaaaaaaggaaaaatctatttactcaaaattcctattgaaatagtttacctggaaagaaaaaaaatggataataatctaatgaccagtaatagaattattaaaaattatagcatatcagtgggaagaaataatgtaaaagcagtacattaattataatgtgtttatagaaacacggaagattacaaacagaactttcaaagtgactgaactaagtaaaaatgcatatgcatgctaacatagattgaatgccaataattttaataatatatatttttaaattgtgatgacatagcaacttttcttctgctataaaaatcattaaattattctgggtttaaataaaatgaacatatattaaaacatgaaatgatggcagtgaagtgtattccttagaagtaagtacatgttgcaaagagagagtgagatttattctgattttcacttttgtatcatcctttcacttatcagtatacaaaagaggtttaaagtgttttcgctatagattaaccttgcctgctgtttgaatagtgtgtttttaagtacatattttaatatttagttcaacaggttccaacaatcataaaacagtcaaaagtccaagttgcctttcccttcgatgagtattttcaaattgaatgtgaagctaaaggaaatccagaaccaacgtgagtattgtttcaaacgaagtggttctttaaatgcgtgctgttctttatgctgctctttactcttaccatcacaagcctgttggactatgaatccacgcatgattaaagctaagggtttacaaaaaatcatatccatgcaaacaaaaaaaaaatttggttatttcacatatgtttttctgccacttgaatttattttgaccataaactaagggctgttattaaaatacttagagtagtctttggtacagcagaaatactccacaatcccttagtctacaaataaataaggtagctgaaaactagaagatcctttattctacttagtaaaatgtagcatttattaagtcaaagtttgtaaataccattctatacatatttataattgtgcgtctttaaatttaaacatcttattttgtggataggttgttacttgattttttttaagttgtcatagaaatattgtcatctcaggtggcagagtactattgcatgatatactactatctagtattattttattttagaattaaataattgttattctaggtgaccataatcactgatgagctttttcaaaataccttctatgtttggggaggaagaaaaaaatgtggatgtattggaagtgagaagggagaggctgtgggaagaattcccaatattaaaactctacgtgattctaaaatggaaagcaaagctacatacttttattattctgcatgattatcttatattcattaagaatatccatatttaatgaaaattgatgattttcaattgtatcatgactattattattgcctgatgggttgatatttaataatcattagtgacccattaacatgctaaattataattatttctatgtttaaccaaatggaatatattcaatcaaaatatgtaagtatggatagaattacaatggaattaaggataatttattcaatcaatatggatatattgatcaatatcatgatatattaatattaattagctgaattattatgtcaaaaggtaataccatacacttgtcaacagtgaaatataagacacacagagagaagtaaaataagtcaggagggtggctgggtaggcctactcctaatgagaatacatgtccattgaaggtttgttattcctgttggaagaataatcacatagattagtgtaagaatatggcgtcctgaaatatacccaaatttgcatgggtaattccaatatacaatgctgaatacaatctaattgggaagtcattgtttgtctatcagactgataaagatttaaagagacttcttaatgtcattgttcatagaactgacactctagcatactggggtgggaatttaactgtgtacattttttttctagaatataattttgcaacatttatcaaatactataaaaagtttttaattattggtttattaatcttatttctaaggaactggcatattgaaatatttggacaagtaccaaagaataaatatatagggttgtttctcacaatattgttcataaaaggaaaaacattgaaatggttaaaagtaattaaattagtaaccatatgacagaagataatgtagctataaaaattgtctttagtatcattataataatggaaaaattcagttggccaaattatatattcagtgtggtctcaaatatgtgacaaaattctaaaaatactaataggaaatattagcaagtgtaataatactgggcttatctgttttgggattttgagtgagttccttacacacacaaatacatgaacagaaattatatatgtttcttgtagtctccagaatattaataataatcttgtattacctttctaattaaaaataaataaataattttaatttaaaaaagcaaaagctaatttcaatcttaatcctctcatttatcaagctgttttatggacagtaatatttctcagattcttctgagacccttatttatatcctgttatattccattaagtatatactttttatcataaaatgtcttggttttgtcaattttatgcaattgttaataagtactctaaacatatgtcattatttttcaggattattaagttcagttttatgttttagattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatcaacttatatgtgtcttgtattttatttataaggaaaaatttcctccaggtcttgatacttaaaatcggatgaccttagaaaacaacataatttgactctgtttcagtaaccttatatctaacatggaaaaatataatatctgctttgccttataagatgagaattaaacatattattagttaaacttggctaaattctatgcagtaatagataaccccaaaacctctatgtaaacataaagttattccccgataaagcaatttactgtgggcctggcaactctttcatgcagccttcttgctgatcacagctaatggagacatcgtcattctgtggttgcctcttgtgaaacatgccattttggtcaaagagtctgggacgaaacatgaaaaattgtacactggctcttaaatgcttctgacaagaagttatgcaggcaactcctactcatgttttgttaggtggggcaaagcaagttgcatagtcccatctaacatcaatagtatgatgctcattaggaaaggagaaacagctattggtaatgttaaccgtaaataaaatttgtgtaaaactgcaagacactttgttgttagaggtgtatttatcagtaatcgtcccctgaagtagcgtactttattcatagcttatttgccctatgtgcatgggatatccatgaccaccttttatattttatcacgttttccccctgttcttaatatatccaccattacacaattttagccaaagcctttatagagtaaattggtaagtataaaactgtcagccagcttctattcggtaatttcttcttttagagtcctagatatgaaagtatttcaaagaaagtcctaggacttgcaaaatatgaacacttgattctgggggtgcagaatggccacaaacttcagaaaaacaaatgatgaatctttaacccaaaagttcagagagggcattgtatttaaattgtcctaaagtccttatataattctagaggaaggaatataggtcaaatttagactcggaagtaaggtgtgcatcttaaaatttataagtatgtacactaaaattataagaaaatagtattatcacacaatgtggttgatgcagggaagaaaaaataaaggagagaaaaaaagtaagacaagcagaaagaaaaagagatagaaataaattcaaatatatcacaaatgaaagacaaaagtaaatagaataaatgctctgagttaaaaaaaagctataaactttttacaacacatctatctaaaccttaaggatacagaattgttgaaatgaaaaagacagaaaagatatcccagacaaatgctttccaaatgaaggtaggtatgaccatattaatgtcagtcataacagactttatttgtaaaagccttcatggaaattaatttactagacatatataatgttaaaatacctgaagcaaaaatagaactacaaagagaaatagacaaattcaccataataatgagatattaacatatctttttcattatttgctcactcaagcagagaaaaacatcagtgagcatatagaagatttaaagaatacaatcacaagctccatctaatgaaaacacatagaatattgtaactaacacggcaaaatgagttttttcatacacatggggtaaaaggttatatttgatgatatattgggctatgaggaaaatatcaaaatgtaattaagttagaaatcaataataaatagaaaacttaaaaaacttatatctttgaaaactaagaaatacatttctaagtgagtcttaggtcaagtaccaaatggtaaggaaaatagaatatattttgaagtgatgacagtgaaaactctacataacaaaacatgttgaatgcagtgaaagcattatttagagggatctttatcattttaaagacatattagaaaaacataaaggatgaaaattaatgatcttagcttattaggtaacataattttaggataaaaatgaatgagctaatttaaggcaacagaataaactggagtgaagggagaaaatagtataaaagcagaaaataaattcaacaatgtggtatgtaatctttgtagtgaaagtatccatatttattaaaaaaagaaaaaatctagacaaatagaaaataagtaaactatttctatttattggaagaatctatacacttaaaatgctcattctcaatgggttgatatatagaagaattgaaatcagaacgcctatagtttagtttttgtttctgtttgtgaaatgtgaccagctggttcaaaaatatctttgaggaacaaagggcaaacttcagtagaaattattaaagaataacaagtcataggggattcttgttttcagaaatcaagattcagcttaattcaggaattaagccattatggttctgtgcagggttacacaaatcagaatagcatagtaaacccagaaacagaccatcacatgtgtaaaaatagttgagggaattggcatgttagcatggatctctctctctctctctcccccactctctttactttgaactaaacattgtggaacaattgataattcacacagagaaacatttatatggacttccacctcatatcatataaaaatcatctcagagtggataaaaggctgaacagtgaaaggaaaaaatgttttaaaaagtgagactatttgaacaatacgtttatcaccagggtcattaatacagagaaagatttcttttcctttcttttcttcctttctggcttttttgtttgtttgtttgtttgtttgtttgtttttgacaggaactcactctctccaggtcaggctggagtgcagtggtgcagtcatggcttcatggctcactgcagtcttgaactcctgggttcaagtgatcctcccatctcagccttctgagtaactaggactacaggcgagtgctaccgtgcctggccaatttttatttttatttttatttttgtagagatggggtctcactatgttgccccgggtggtcttgacctcccagcctcgagcaatcttcctgcctcagtgtcccaaagtgctgggattacaggcatgagccaccatgcccagtgtgggatgatttctttagtcatattaaagcctcatgaaggaaatcatcaagaatacattctcctacatttgattttagatcctttttttattgaaagactctaggaagaaagtacaaacaaaaataagccacaactcagataaaaattattgataatgcatataactaaaaatggtatgtattcataaataattttacaaatctttataaaaaaggaaaaatgacaaagtggcaacatatataaacttgaacctcagactggagggccaataaaaatgtgaaaatgtgttcaacctctttagttaccagaaacagacctattgtaaccctagtgataaaagcatttgatcctacccaattgggaaatatcagaaaatccaaaagtaaaaattttagattgcaatatacatccaacagaatacgtatccactactgatgacagtccagtttactgcgtgatctttggaaaacattttctaatcccctccttcgttgaagatgctcttacttatgaccaaacaattccgttccctagctcatgtgcatgtgcctcttgtccatacataccaggaagatttgtggtcacattgtttatatttaaaaatatgctggaaaaaatacagcagtccactcaaagtagaatggatcaatgcattgtgctctattcataccaaaaatactattcaatagtaaataaaacgtcaagaatatgttgagcaataaaagtaaatcttggagaaagtttgaaatatgtaaaactgactacaattttgattggtataattttattgttaaattataatgaaaaataagagaatgataaaaacaatattcatggcagtaattacctgtaatggaagtaaaaattggaaaatggaagtgggggttgagatcagcacctgacaaaaaggtgatgacgatattcctattttgtaaaatgggtagtaagtgaatggatttccattgtgtttctttctttctttgtgttttttttacatttattctataaacaattgttttatattcttaaaatgagtaagtgtgaagcatcccgtttgtctcaagtggacatttctgagttactgagatattttagaatcagaccagtgacatgtcaacctgaaaattgttctcaggagtttggatttgaattgactttcagtaggaaatgtccatgaattctggattagaaagtattgctatgaaaattgtggttgatcatcgttaaactgtatattacatttatatacttcactgaaataagttaagaccagagaaaaggacagataaaatatcttttgtaggaggcaagtcatgaggatgattcctaacctaaattctaggggttgctatggagacacaaaggaaaaggcagcagctagatctattgcaaagaaaggagcggcagaatttggtttaagattctgcaattaaaggatttcagtttttttttctgtcattatctaggcagaccaagtgaagacatgaacaatataaggataattctgaccagaatatgatatgagagtattgtattaagagctgggagttggatctgagctacgttgttggataattgctctattttttttattttttttttttgctgctgctgcagaaaagagcaaaataaattaggtttcttatgcatcatttccagcctctcctgaaattacttcatcatctgacagctttctgcaaccatctatatattgaatagtaacccaacccaatacttaggagtttataaatcagagacaatttaaagcttcctacaatctttaatcgattcttctcttaaactgtagagaattggttcttctcaaagattgatagaaactttgtgattcaaatgttacagtttctacttctcaatctcctgttaacaaacagaaacctttgtatacaatgtccagttttctattttcaacaacattgcagttaagtttcctagggaaagagtgaaagaaacaacaacaacaagaaccaaacaaacagaatgtaccatttttatatacacgaaaaactatttaactaaatgtattatccaagacatggcacagggattttgtcagtgagttattcaacaatcttcctgaaactcccataatacaccagccactttctagtaatttgggatttaacagtgaataaaaacaaagactgtcctccagaaatatacatcctgtgcatgtatatggtgattgggtctggaaaggaagggagctactctcttgccttcattatccaactatcagtaaggttaaaatgataatataaataatcctaatttgactgttgaatactactcacacttcagtgcacagattagatttctccacttagcattcctggcctattccagcctagataatttttttcctttttctgagtttttaaacaacttgtttgtttgtttgtttgtttttgttttgagacaggatcttgctctgttgcccaggctagagtgcagtggtacaaacatggctcactgcagcctcatcctcctgggctctagcaatccttccacctaaacctacccagtagctgggactacaggcatgtaccaccatgcccacctataaacatcttttttgaagtataatttacatatcataaattttacttgttttaagtgtataattactagtttttatacattatttatttatttatcttagagatggggttttgctatgttgcccacactggtcttaaactcctgggctcaggtgatcctcctgcttcagcttcctgaatagctgggattattggcacatgacactatgccccaccaatgacttttttagtaatttttttagtgaagtatcattataatgtagtattaaaacatttccatcaccacaaaaagatttcttgtgcccatttgcagtcactctctgttcccatctccaggccttaggcaaccaccaattaattttctgcctccttaaatgtacttttctggacatttcatataattggaatcatgtatatggtctttttcatatgtcttctttcacttagcatgttttggaggttcatccatgtagtagcatatatcagtagtttatttctctatattgctgaagagtatttcactgcatggatatcatttcctgttaatccatccaccagttgatgaacatttgaattatttccacttttggctattataaatagtgatactgcaaattctctggggttattaaagcatttagttgtgtactgttagggacagtctatcaattgtcatatgtattaattaggatccttaagaatgagaaaaaatatcagacagactgtcatatccttcccgttctgcattgccttgtagatgtcacaagaatgtgtattatatttatttcattgatttattggttgataggctgaaaaataaaagaatgaataaaagtaacactgcaatttgcacatgctattaaaatagtctacgaaatgtctgacaaagatgaaattttctatataataatttaatgaaaactaattagaaatattcatgcactaggtttctacatttgtgttaacatacttcctcagattcctcaggacaatttccttaagataaaccctggctttttaccaccctgattttggagggggagtgtaggaaacctggatgttgtagcctgtgctaaattctcctaagtgcaaatcaacaaaaacagatcaatttgttcaattaagggtgcaactttgaattctaaagctttaattaagttcgaggattttactctgattcaccaaagtatgtgaatgcctgtaatgaaatgggctgaactgggtgtccttccttagcatgaattcattatgagctcatggactgaaagccagtgttatttctctgtagtcctaagtggattaatgggatgttctgcaggaaatgggaatcaattaaatctctttaccaaaggaaaccggagttagaggtgataaagtatgtgcactcagtagcatgcagttgtgacaatgatggcagactgtgagcaattcgccaagcatatttaagtgaaatgtacggccctggaaagctcaccaggccagtcctgtaaacggagtgccaagtcaaaatagataaagctttttggtataggaagattcgtccaatgatggaaaaagggaaaataattcaataaacacatcatatgttctacatgaaatgaacaaatgaacaggattttcttccttctgtccttctacctcctctgaaaatgttaattcaaataattgcacaaagtcacagaagttgttgagatgcaggctatggagaaaatcaggagcagcagcagaagaaaactccctgtccctttggcctaccttgtctctgtgcgtttggctgtaccatgcaaagtgaaaatatttgaggagtagccaagatgtattgaataatttttaagtgcttgctcctattttaatcgattcatgtgaaatatttaaatttcaacataaatcaaatgagttaggtgttattacatttcccacttatgaatgacgacactgaaacatattaagtagcagattcaaagatcgcataggaagagaagccaggacgcaggcccaagcagctgacttcagtgtttatggataatctgatgctacagtgttgtctgtactttgagactcaggtaacacatgctacagatgagcaaaaaggcattgtacttctttgttgaaaataccttgatactagattacagtatcatctagaaataggaaaatataaggaaaccttctattttgttcctagagtgccggagaatctgtagtgttgcataacatggtagcggttaagatgccagtgttttttggtttttgtttttttcatcacagtggttagttagcatgaattgtatttagttaaatttccctgatggcatttcactactactcttcactattaaacatgttggcatgatgggattacacagcttaggttttattatatctctacccttaagaagcttctaccctggtgaggtgtttgaggagcctagagagatgaattcaaaggattctaagacaccaaaggaaaacaaaatgagatacagaaaaaggtaaagatattggtctgaatctttgtaaccagttagttttctagtgcctgggctagaacctagtttatgctgtaggatatcctatagatataaattctgttttcagaagtcttctttatttcaggaatgaagatgctatttttctgtatattatgttgaaataattgggatgatgagttttcaaaactcattgacagcatctgaagtcatagagctcctgcaaattttgtatctgcaggttggttgtgccttgatagttgtggtaataagactcctgtgcagctagcttgtctgtagggaagtgtttccatgatggatttcaactggggaagttttcaaaaacctagatgtgaatatatttgaatgtcacttatacccttggtgttagttgttgctagaaatctgtctatgacactgaataataaatgtgaaagcctaatggagaagagtgaaaagatagatgctgtgatatgcttgctttgctgatgcaaatggattaatagtggcattagatagaaaggaaattgatctcatctagacttggttataatgggatttccaaacattcttttgtttttgtttttttttttttttttgagacggggtcttgctctgtcgcccaggctggagggcagtggcacaatctctgctcactgcaagctccgcctcccgggttcccgccattctcctgcctcagcctcccgagtagctgggaccacaggcgcccgccaccacgcccggctaatttttttatatatattttttaaattatactttaagttctagggtacatgtgcacaatgtgcaggttagttacatatgtatacgtgtgccatgctggtgtgctgcacccattaactcatcatttacattaggtatgtctcccaatgctatccctcccctctccccccaccccacaacaggccccggtgtgtgatgtcccccttcctatgtccaagtgttctcattgttcaattcccacttatgagtgagaacatgcaatgtttggttttttgtccttgcgataatttgctgataatgatggttttcagcttcaaccatgtccctacaaaggacatgaactcatcatttttatggcttcatagtattccatggtgtatatgtgccacattttcttaatccagtctatcattgttggttccaggacatttgggttggttgcaggtctttactattgtgaatagtgacacaataaacatatgtgtgcatgtgtcttcatagcagcatgatttataatcctttgggtatatacccagtaatgggatggctgggtcaaatggtatttctagttctagatccctgaggaataacactgtcttccacaatggttgaaccagtttacagtcccaccaacagtttgaaagtgttcctatttctccacatcctctccagcacctttttttggcatttttagtagagacggggtttcaccatgttagccaggatggtctcgatctcctgaccttgtgatccgcccacctcggcctcccaaagtgcaaacattcttgaaattctgcttagctagactgttatgtgcaagttgattctgatccctttgcagagaggccattcaggatcaagtccagtcttgttgaaacaaagttaagtgatttttggttttggtgttgatgaagtacccatgtgaaatatattggcaagataaaggagtgtaattacctcatttaccgaaaaaaatatttttttaatttacttttaaaaatattactgttgtccaaactcagcaatgctaatgtttgtcaccagataaacacagtaaatgccactggttggatttatttttaaatggagtcatttctttatctgaattgaggtagacttcatgttagctgctgtgttatagtaattaaagttcacatttatctgtgagtgttaaaattttcactttttatcgtgccatcaaactcactaaatagtttcagagtcaaaggataagacataaaaaattcctgaaaaattaatgccatttatatatcttctaaaaccttaaatttattgatgtataagtatgcgtccctgttttccaatattcattttgtatttagttaaaagctgttctgaagatttatggcacgcgatagcagttttggtagagttataaattttcttttcttttttattgttggtgccttagaagccagttgaattacaaatttacattttcagaattagaattgtataatctagatttaattaatgcaaggatgataatgcttcagtggcagtactatctgttcgaattgctaggttttttttaacgctctcagggagcagctctccaattagggatttatacatcttattaattaactactttacaatagatattatccagtgaactgtgtattcatattagggactgtatagtttgcttgttatcgaagtggattacatgccctttccattttctaatccatattttatttcctctgctgcctcttgtatctgagtatagatagattcaccaactacccaacagcaccactgacttcaatgccagtgtttactgggcttaagttacagcgaataaaactaaataagtggttcaatttggagatttgggtacataaacgttttgtatattactatgccttatgtctataaggtgtactttctgcaaaatgttttccatagcatttgatgtcaatcaaagccgaggctttaccaaatagctggcatgatgttttatctacaagctcttaatgtagtgaatatactaaacatactttcccgacttttgagggaaatttcatgctacctatagcaaaaatgtgattcaaagatggttgctatttcaaaaatgtttccagagactttctaaaaggaatcttatagaacgagttgagcaagaggaaacccactaaaggactgtcacatggctgaatgtataaagagaaccaaagtctgccttccgaaattgcaaaggcagtgtaatagccacaccgccccctgcaatgttaagccttggaaggtccttgaatttagacaaaaagcaattcactgtaaccagctggtgcatcgataagagaaatgtcagcaaattccctcaacctctaaaggcatggatgggggttgaggggctataggacaaatatataggaagtgcacaaagcttctcaagaagaaattttacagtaaatgagtaaacctttatatttccaagaacaatgaaaatcggttgtgaatcataatttaagaatgaaacatacaaataaataccttctaatgaattccatcaagttgggactgttataactgccttcctaagatccttctcctccacaagagactgtgtaattctataatgcaaattcccccaccaaaagttgaaagatatcaatgtaatgctcaggaagaatacattttgaatatccttataaatatcaatacttccataaaaatattaaactttggtgttagatttcaaattctgcacaattctgacttatattctgattataactgcattgctcttttaagaaattgactccagtgtggggaggaaacaataggttgaaatattgacaagtctcatttcctacatcaattccatttcatttaaatttttatttaatgggagtaatttcaatgtggctggctctttttgcaacttaaagtggtcaaatttggctttccattgcattcttaccattttctccatatgggctgggaagtttttatttagtgtggttaatgcactggctggaatatttgccaatcacattcaaggccttcccaataaagcgagagatagagaatatgcaaccgcccaaagtgaaatcagtgtttggagaaaaagatttcacatctatcaaagctaaagcaagaaaatcctgtgactctgggtttatatctctgctcagagaaatatgcacaagtatgttattgccttattgttgtcgcataacaaaaacattattgtctggggtttcaaaatgcagaaatatttttaaagttgtgtaaagatgcacaccagtttcttaatagtatttaactctgaaggggagatgtaagaaccaggatctgtagcatagaatttatttaaattgctgaattttgaaaaaaaagaacatattaagatatttgttgttatagtcaaagttaattttaaaataacacattaaaatgattttttacaccaggtgttccaaaattcccaaaagaaaaaattgaccctcttgaagtggaggagggagatccaattgtcctcccatgcaatcctcccaaaggcctcccacctttacacatttattggatgaatattggtaagtaatgctccgttccatcaaaaaagggggacattttaattctatccatcatatcaataacataatgaatccaaagacaaaataaaaaataaagatctcttaattttttcatatttgaagaggagatgctactaatatgataagatttgtctgtgaagacaatacttcctatatttcaaacagtgcacttacctttggaatatagatcatgtgaaagctgaggatggcatgggtttgtgttgctagcttcatctttctattttagtaatgctctacctgctaattgcagtcacctaccaggaaattagtattaacttttttgcttaattttctaaaaggtttgctgactctgatctgaaaatctagctttgtaaagtctacttctagcatatgccttagcagtgatctctacatgttttctcattgtgaaccatagagaaaaatgctatttgcacagcactcagaagaaagcaaatgaagctactcttaggtacagccaattgttccagacatcagttcccctagaaccttccaggctgcaaccagaacagggagattaatatcacggataaaacttttggagagctttttgttttttctttttaaatcatgttttaaataaacgtgattctcagaaaatacaagtgttaattaggtcattgtctgcattgatcagttttcagttcagccaattcagattcatagggcagaggtggagacaaagatggtaaacagagtttaccactgtttgtctactggtggacttctttggttaatggtaaaaagtatcctcccaagggttttgctgctgtttttgttttgttttgttttcctatttgctcattgttcctgtagtaagaccagacttgagaggaattaaagagcaaacaggaaaaaccaaatgaaataataatgtaaaagaaaatgaaaaaggaagatgaagcacagtaagggacaattgcccttttcaatggcaagatatctcttttcagaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttgtaagtccacataatttatcgtttcatcatgtatgctgaatgcaaatgtgtctgtaatttccttctggctgaagccatttaaagctgggttgatattttgcaccattgtgcagttcaactctggagacttcttccagatgaaatagacatctgcagctgcagattcacggtagctctgtctctcacagccaggaaatcacatctcaattcacaggacaaatgtatttcatctgacatctgcaggatcttgtcattttcagtggatgaaatatacaatgaaattccagggttttctaagcaaatcttgggcatcgattcactgtgatcttggataaactggcagactgaaaatgggggagaaaacaacagaggcaaaaagatggaaatttgtatcaccaaactggcaaacttacttgaatcaccctttcccgacttgattctgtggaggccagcctgggttcccaaatgggaagagtaattagagggaggaagaaccgtaagattcaaagggaagaaataatccccaacagtttgctgagcgaataattggccctggtatagttgaaagttggcattaccatttcattgtttaatttggtccatgattttttcatttttatgtgtagatatgccatgccagggcttcactataacattcttctagtagcctcagttctcttcagtggagctataacttgaatcttctccacctggattcaagattaaactcactataattattttctatgtaaaactatattcccaaaggcaatgttctagtgaagcatggttctacatcattttgtaatttttctaagacaaaaatatgacttttcattctttattgatatcagcatccaccattatgtttgtgttttttccttccgtttttttatttcagtaaagcatgctaatgactcaagttcatccacagaaattggttccaagggtaagttgaacccatgtggagtgttggcatttgtgtatagctcattgtcatctcagattttgaattttttctttaatatcctcttaagtttattacaatactgttattatgaaaaacatctgaacttagagggttctattgccccccatgccctcttaaatatatgcaaagggagtgatttttataaatatataactgtataaatataatgaaatacttatatataatgcattgaatagacagatagagatatttaatggagtaattattttgggtctcccaaaacgtctcttatggtatataaggttgatacttttgcagaaagaaaagaaatggttaagtgtcaaaagacgtagagaaaacactgcgtttaagaaagttaagtggatttttttcttgcaaggctttttgaaatatttgacatgcaactgtacattgtggctttctgagaaaaaaacagtttgtagcatttttcaagttcatgtgtctgcgtgatctttttatttaattctttcccccatagaacgtctaccagaacttgtgttctatggaaaatgcctgagtaaatctgagttgtatagcaggctagttctctataatgagaagagtcagttacataattgcagcaaatattctctataaaatgtggaccagtgataacttagataccttgcatacttgcaagttcagtggaggaggatgtaagctccttttgaagaaccgtcagttttaaggtggactgattcatccccaacatcatttcctttgagattaataactcacacatatatagtgctatattttcacagcactcaatgaaaaatcattgcacatagtacatattcaacaattatttttcaaaaaataaacacgaagtatagaagactgtctactgctaaagtccctttgaagatggaagtcttctaatttgccattgtatttgaaaaatattcttaagaaaataagaaatgggacacttcaatatgcaggtagtgaggatgcttactagtcatttcctaaaactgtgtttttctttaaggagctgagactacaggtagagttgccgaaagagcttgataaattcatagatgcctagtgtctaccacagccttcctcagtgagaatttctgagtgcaggagtgaggaagctgtttttagcagaaacctcgttaaattcttaggcaatttaaattaaataaaaacataaacataaagtcattgcacatgacatgattgaagtatagaatataaaatcatagattttcaattaaggacttctgtttgaccttctgagttagcagatatggtataaataataatatttataaaattttgcagtgctacgctcagtaaaaacatatgagggacaacccatgcttcatggtaagagagaagaggagtctatttaaatggaaatatgtgaaatgtgtatagaacacacacacacacacacacacactcgtgtgtcggattttttgttttaagaaagatgtggtgtcacagaattttatgtatattaatttgaaaaaattctgacttttcttttctattttgtagcaaattccatcaagcaaagaaaacccaaactgctgttgcctcccactgagagtggcagtgagtcttcaattaccatcctcaaaggggaaatcttgctgcttgagtgttttgctgaaggcttgtgagtaacctgactctcactcatgactttgtccatccagttctgtaaagaataagacatcaagcacattaagactgtgcttgcaaagatattttaaaattatttccttaaaaaaattaaattctgccgggcactgcagatattctgctcaggactgttattccaggtacttaagaggctgaagcaggaagattgcttgagcccaggagttggaggctgcagtgagctatgataatgccattgcactaaaacctggatgacagagaaagacctcatctaaaataaaatgaaattaaaattaataaaataaaataaataataaacataaattctgtcattatatctctggaggaagtaatttgtacttcactctacagacttcaggcagtaacaggctcataaaattagatctctctgtcaatttatgatattgtggatggaggggatgatgataacattctccttagttaagtttaagaagcctgaggttgttggtagtcagtccctcacttttggtgctgagttttctctctatgctatactacttgccccactcctgtttgctatgttacttactaaatctgctgctttgcaggttccaaggagccctatttatatctatttttactctgctgccctttgcacacatggaggtccagaccatgtaatttaagagagttttacatcaaaatctaattaagtgaactttctttacacctgaaaaagcaatccatttatttatttatttatttatttaattatttattcatttattcatttatttatttttttgagacagggtctcactctgtcacccatgctggagtgcagaggcgcgatctcagctcactgcaacctctgcctcctgggttcaagcgattctcctgcctcagcctcctgagtagctgaagctacaggtgtgtgccaccacacctggccagttttttgtatttttagtagagacagggtttcaacatgttagccaggaaggtctcgatctccggaccctgtgatccacctgagttggcctcccaaaatgctgggattataggcatgagccaccgggcccagcccgcaatgcacctttttaaatcctccaagaaaaccctaaaggacctcacttggtcacctcttaaaattgttccatttattaactactgttaagtacatgtaaacagggaccatcttatttaatatttaatcatacagggtctcctatttttaccactatccttccgaacttacggtccttccctaccattgaggataccttgggaaaatgcattccagcttcctagcacctgggattactcatttgaaatataatctgttcgtaagctaagggctttggggactctagttagtggactaggatttgaaattcaaaaaatcatattcattcataatttagagtacattctgaacgactggtttagaaatggagcagattttattggttttacagcccctaagctttgtaagtttctctttccaaccaccaaaaatatcaaagttgcttgtctgtcttcaactcccaatgtgtatttacataaattagttagaagtactatgacacagactctgtttggaatgtttggtctgtgtattattttagaagaggaaagtctcatattgagtttgaatcatgatggcaacaacctgctctactggttgtatttgtacatgtttacagtggtagaaattacattcttgcagagttcatcactgtattgagttgggcagggtgatcctttctgtaattcttttttcttatttcccacaaatgccttcactgacctcttggattgactagcaactgcgcagaatgtcttcaaaataatgaaatgctctcatgtgctttttagaaaatgaagagtcatgaaggaatatataaaaacagagtggatgaaaatatatgttgttgtgaggacatgaaaattcttgatgcgctgtcctaagacttttcacctgaagtagtttcttcttactcatactgattttgtgttgggtaatcctgtctgatctgggtcgtctctcagaagatgatacatttttaaaaagttttttgggtcctttaaaaaactctttctaagaagttttcaagccattaacctcctatagtaacaaaaataattataattaaagtattgtactattattttgtgtcaagcactatatttgggtctttgaaaactagtctaattgtctaatacattttacttgaaagaataaagtaaaatgattatctataagtgtcaggtgaacatgagatataatttatctcaagataggtctatatcttggcaagaatttccagctatattcttgcaaatgtttttcatttccttttgttttagatttaagggatatttaccaacagtatctgaacaaatgtgttttgagggaaaacttataaaatggccatagatggactcatgtgcactgctcaaatagtttttttttctgttttgtaaattcgtgggtttaaagtaggtataattctttcacaagatactactttataaatagagaaatatgcaaataaaagttggccagacaaggacctgaaaaaaattgagattatgaggtagtgtattttgtgtgcaaaaaggcattaagcaatatattttccctcaaaacacattgcttaaatgctgttagtaaatgttatttaaatttaaaaaaaggcaggaggtataaaaaaattggcaagaatagagctgaaaatttttgccatggtatagacctatcctgagattaaattatatctcattttcacataatactttagatcattattttactttattctttcaagtaaatggtattagaaaattagactagttttcaaagacccaaagactagggagtccgggagatcttgctgaaagtgagttacttgctctaataaaggatggactcttgaaaaaatcctgttttaggggaagtgagttccagagcagcctataacttggcaaattgtcattttgacagatggagtgaaaagccagcagttaggagacttgagctatgcatcctcttaggtggtgtgctcagaaagccagcagctaatatgctctcacagctgtctgcccaggcatcattaccatttcctacacaagcgtgccatgtgctcttagcctggtaaaatataagattattattccaggctgcacagcacgttagtgtttgaggcttgaaggaagaaggaaaagagtagatatatagagattaaagagccttcatctttacctccaattttttttgcataaataactgaattattttaaccacaaactatcaatacaaataatttgagaatattgacacacacgatttcaaggaattgctcaattattacatagtaactaatgggcaatttgacaggaagcatatattctaagactatagagttaggaaggacataggttgaaaagcacaaaataatagaacacactgataaaaaaggaacaagtttagagtagacaaatataagttggggtatatcatttattgctccagtgaccttaagaaattaatttattggagcttcagactccttactgttaaatgatcacaataatatgcccatctttagaactcaccaaataacctacagctactaataacaagaagaaatatggagaggaaaagtgttgcatcaataaaattagcaaagttgtttctcctactcacttatagaacctgactggggaagagaaagagacagtcatccttcatttagaaccaaccctttatgctttccacataatttttaaatcaaatgagtcacagaaggtatgacttctgcacttgtctgcttttcatgaggaggggtttttcttaatgtagctgccttgactccccagtccttttttcctccttactaaggtggggaaagttatcatgctggtgtgtaacaagttatcatgctggttttgttttgtctttactttcctgtttgttttgactgggtgagctaatcttttgaaagcgctaagcaagggaagatttggttcattcctcctttcctctgcttcccgacaagggcgagaacgtgatccaggaggcagtatctgtgctgcagattccagcttgccctggaataggctgttcatgggtctaatcgacatgtccagctttcacgcaggagccccattctccatgatcagcatcataggattaaaagggaaacttctctctgctgactgttaagtcccactttactgtgttttacacaaacagggaatagggctgttatcactggctgccccaaaccacccactgggagattttcacacttggaaaatatcttggtaatattatttcaatgagctccagctatttttccttcgctcagccacacctagtcagcacttacatgtagttagcccttgtaatagaggagagagaagacttccaaggagacagaccactggaggaactttcagtgaaagagacttgcttcaacaccagtgttcactattgttggtggtgggtgtgtctgtccactggtaaggatgacgtgattcagtggaatatgagcacatgtgtaaaagcaccctgataaaggatgtgtcctaaggttttctttgtattttactttccgcttttaaaaaaatgtttatttatttaactattttttgcaggccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaaggtacctttcccatgttggtctatttctctgcttttcaaaaaagtaactgtatacatgtagtaggccttgcttctaaatcatacatgttaaaacaggtcagcagtttcaacttttaattgtagtgcgggcattgaattatattacacttcaactaagcaggtttgtcatttacgccccaaaatgacatagaagggacaaatgacaagaaaagatctcatgttagggattaaacacagacagtttacatgatttattcaaatagtcattaaagctagtctcctaaattatttttattgtaatacacatatacatttcataatattaaatcataaaagcagcagtaaggattatgatgaaaggaagtattaaaatgagcctggaagaaagcttggatttaacttgctgtgccctttgccatttatttcactctccgtacctcaggctcttcaccaaagaagtgaaagaggcaggcaaattgttgtgtcagctctttcctgcatataacacttttgtaatccatatcttgggttcagatgataaattcagtatgttacttacaggcaaaaaagaatagactgtatgctataatattaattctctcaaaaagtgcaaaaacattatattcaagtcatcttctctctgtaaattcagagattttgatcaatcaaggttttattggtattagttacatttataggaataagtaggcaaagatgataccatttaaatgtggaatgtagttattagtgctgtgactggctgatgtgaagtttgtctagtcctctgaatgtgattgacacagactattttctgtggatccaatcacactgaggctttctatctacaatgtagttgaccgtattgatcaaattaatggaatgatgactgcatttgtacttatttagtgcagtgtaagcttagctactgaaaggaattattctttttagactacaatttagtgaactagtgctctaggcacccattaatattccagtaaagttcacctcttaaaactttagtttccacaaggaacacctaagtaatggcctgttgtttaaattaatggaaaaaaaaaaggactcagacacaaattctcctcccaagtaaatgttaacacagttgatttaggcaaacccctgtttggaataacactgcatttccaagccttctccataatgcatattattatttaaggtaggaagaatagaaaaccgaagttgagaattttattttctttgacttgacaaaagcaaaacttatatagatatgcattaacgtcaacatctgccaaacagtgatatattcctttgacattaaattattcacaaagaaattcaaggaagaagagtttgaaagatttatgttatgtatatttttagtcatcatttgatgtttctatataatttggctacatcgtgcaacaggggtatttttctgtaaccccctcctcccctccctggcacacacacacccacgaaccagacatatctaattgttagattctcctccaagttgctgactattagaaacacttccagatggctggaacatagctacggtagctgaatattttaacaatctggccacagttttcttgactataaaaccaaacctttcaaaagaattgcaagggttgcaaaaaacgaaatcaaagatgtaacattaattatgcaatttaaaatgttgactataggactccaaaggaatatagatttcctgaacaaattgttctcactactcataaaacagctattagcactattgagatgtaaatgatgtttttatgaagaacttttaatcctctctctttagtaagaaactattaaatgtaccttcagttgtatgtttttgaagtttctctttacctatacacatgaaaaacaaattgagcttaagaagtctttacttttttttctaaagtgtggaggtaataaataaaaactttgttaatcatctggatggatgagctcgtgtttattcaattttttctgccttcctgcaccctctccttttccttttttgtctcttttttagaagcccacattaaataataaggatttgccatgtgagaaaatagcaatgctattgtatattttgaaaatctactccattctgaaaacacccattgtgcttaagtaaaatcatggattcgattggattctttctgtatgtgcaatgtctttcctattaccaaacataatataatcaaatactatgagcttgtaatttaggttgcaacatcctaaatataaaatcagactgcacttcaaatcctataatatgtatgagcaaaagcagccaggatgtcttgactaggtacaactgtatattctaaatatctaagatatgattaattacacattcaataaaaagagatatattatagtgacatctaaaacagtctacatccagaaatcaaaatataatcacaatcacatttcaatagactatttaaaaataagctcccaccaataatttttatgttgtcaacttttgaattatttaaagcctttgaattttagtaagtgaaataggaaagcatttatatgtaattatagagccatagtataatccaaaatgtttttgcattttcaaaggttgtcataaaatcaaatgcaactcagtcattaatatacttgagaaatccttgttttcaaataacaaacctatttctaaaatgttgcgattaaatccaatttttgttgaacctaacaagttttgatttattaaaatatagattttaataagaacctgtgaagaaacagttttactaaaaataaccagtgttgtatgttctataggtaccaagtttgttttattttgtttttttcctagtgataaacatctctatttagcttgcttaatatatagtcccaatgttcagacatttgcatctgtttccagcaacatgagaaatatttatcatcttatttttgtatttacaattatgagaaaatgcataaagtttcaacataagcaattttcatctgttaccatatgtcttaggataatagataaaagaatgggtttctatgaggatggtatttttcctcagaatttttggttttaaggctcaagaagcagctgtttctgagcagaacaagcttgactcaagtccctcccaatattacatgattcaggaccagcttacttctataggagaaatggatgaaaagcattaaagtaaattttcaagcaattataaagaaagcttataaagaagggttaaggtaaagtatagtgaggaagcctagtgaatgctcagaacttcttgagtcagttgataaatattgggggagcttggatttggaagcataaattgggctggccttctttcctgtctttgatacaaattcataagataacactaaattagaaacaaaaaccacatgacttcagagtctaaatgctgctcatccatagttgctgtgtatttatctgtggaatggcgagaacaggaactggagcttcctttgctggtgggcctgggcaagttaggcaacttctccaaagctcagccctctgtctgtaagatgaaaggattggatgacgtgataatttggaacctctttcagtaatactaatattactaatagtcctaatagtaaatatcctaatggcaatagtaattattcaagaagatttacagaaatatcattattgcttgattttctttatttctgcatacgttgaaagcaatagttgtaattttctattataaatatgatatgccataatgttcatgttcatggaatatttttctctaacttacagatatttagttttatattggttgtattaaaataaccagaaaaaaagtaaggatatcattaaaaaaatgcaaaatagacaaaaataaaccttcacctcagaaaatgatcgcagtttataatttggactagtgtattttaaaccaagtgactaaacatttacaggtagtacagcttatgaatacagatatttaacttggaatttaacaattaagtccacaccctgtggagtaattacaaaggcacttatctcacttggacttgaacttgaacttgccaaggctagttgtgtacttttgtttcctctgatgaacttacagttctttcctttttacataatcctctttttcttcctttacttagaaaaattttaatgatattttttcattgtatacatacatatatctttgaagactttcgtttttagctaaaaatggaaatctaaaatatctttggggaaataaccaaactacacttgatgggagttgctacctgcaggttttgtgcaattttctctgaaatcaaattatccaaaccatcaacactttaatctaaaccttttagttacccctgacatagcaatattcatgaagttataaaacatagagttataaaaacatggaaatccagtaaaatgtgtcatctgtttctgacatactttgtagtattgttacactggagcattagggcatagaaagatacaggtaattttaaggtatattttgctgcattgttttgactgcagaaagctaaacactgcttttgggcttctctctctcccctcttacaaaaaaactctaggaaataatatttttcaagtagattatatgtataaatgctataagatcactaagaaatattcaaaataagcattaaatattttaattagttttatttttaaaattcttacaatataattcttgtgtatccacctttttagatgccatgctgcagcttgaaaataacctgtagtgagctctaaataaactcaccatctgcttattcttccctcattttttcctagtggggtagctacttgtatagctaaataaaatggttgtatataactattttcagtatgttgatgtatgatacatgctgagtccaaattaaacacaagcacacacacacacacacacacacacaccatacaacacaaaagcagctcccaccttgctttgcagagcaagtttaccaaaaagagctactatgaaaccctttgtggtgtctgccctctgctggtgcaaagtagaaatacaggccttaacatttttggactttttgacatagataacatctctcatgagctcttcactttacatccagagcctcctcgctggacaaagaagcctcagagtgctgtgtatagcaccggaagcaatggcatcttgttatgtgaggctgaaggagaacctcaacccacaatcaagtggagagtcaatggctccccagttgacagtaagtttaaaaaccaattgcaatgcaatgctgaaggccctggtttgacgggattaatgatggtcagacgtgtgtaaaatgaagttggtatgtggttggattagcaggacagatacaaccagcaaatcagagattgtttatttctaagcaatttggttgttaagacttgatattcatggaagagccataaataatatttatactgcctgtgccctcttataaattatatataagaataaagatttttaatttttaaaaagaaaattgaatgagaaagaggatgcatccaaggaaaaaagccaattattgttcctgtccctgagaagaaacagaacagtagcctagcagctgagggcacaggttcaaagtcaggacctcctttaggctcaggcaacagcaacacctgtcctgggctctgcccttttaagggacttgctctgatcaccctctggtcccgcttgtctccatgatttgaaagcatcctcagggaaaaggaggcatcccaagtctgaacatggtcccattactgcctatttgctaccaacctcaagcacaaagacctgaaaatccccatgcccggtccaccctgagcccactccaaatgggctgggcggggaaagacaggaatggcccagcactgagggccaactctccccatttcaccatgctcagcatagagctccaaggagtccccaaatcttccactggaacctagagctcagattattttggatgtccttgttcaggaagaaggatagaacatatttttacgtgtcaattgcttaattaagagcaggtacgatagtggcttccatttgtccttttgctctggggcctgcacaagtcaagggtgagccacttggtggataacagacctcgggtcccgtctaggatgtgcaccttgccagctgtttcatcttgaggtgttttctgaatctccccaagcttacgttttttaaactgcaaaatggagatagtggcggttggttgtgcttgaatgaaaaaaaatgtggccagctgcctagggcagtgattcatctgtagagcactgtgatggtttataaactctggagccagactgcctgggtttgcatactgactctaccacttactagctgcgtgacggggagtatcactgaccctcttcaaacccatttcttcatcagtaaattgggataaaaataacactgactcacggggttgttttgtggattaaaggaaacatcatgcagagaatgcttagcacggggactgccacaaaaacagccccccgtaaggtatggttggttggtattgttttcccataacagacactcaggaaaccttagtcctcattattaactatcttcagatttgggatttttctcttcatctctttagggaacagaataaaaaatgaaaaataataatgaggttttgggtagacgaagggaaatgaaagcaacttttgtttataatgaatgttcaggttacaaaagtaaggaacgcagattctccggaacacaaaatcataaaatattatatttggatggtatttggctgtttacaaaagacattcacaaattacttagaatcctcaaaagaactttataaaggaggtgctattattcatatttaactgattcgttcattcaataatatttatggggtactttctatgttcccggcactggacttcatgcttgagatatacaacagtgaataaaatggatggaatccttgctctcctgccattagacaaataacacatgagtgtgtgctatggtgtgataaagcagaaaatagctgggtaagggcagtgcctgaaagaggttcaggacccagagttgcaatcttaagatcataatagtaagacccctgtggtaatttacctttgagtggagatgggaaggaagtgaggaagtcagccacctaaatagcagggaaagtgctgtctcagtggagaggtgtgttgaggaggagaaaagaggtgagtgtgactgaagctgagggagtgcaaggggcagccctaggccaccagatccgccagcaggggaaggggccagagctcaggtaaagatgaacatcgaagtagggccttgggattttgagaatacactaggcagctcttggagaattttaagcagaagagtgacacaatctaatttacatttttacaaggtattttcctggcctttgaatggagaatggactgtgtgattgatactaggtaggaggccatctgagaggctctgcgctcagggctagattggtggcagtcatggttggcttctggatttattttgaaattgagccaataggtttgttaatggatgaggaggtcaaggctgaaaataaacttatgcgagaccacacagctgaataatggtagacttcaaaccaaagccaggtggctggaatccaagctcggtgttctgttcacagcttttggccctggctctacttgttgccctgcaaacaggtcgtaaacttttataggctgggatatttgatgacagagtgttggctagaggatttgaaacctctttaagcttattttagttttagaggttatatatcctttccccatgttatttcaaaattaaatcaaaatgattgctattattgattatcggactaacccttttcacatgctttgcatatgatatttctgaacctcgtagcagcttgaaaaatagattctattattctccattggcaactgagactcagagaggttacattacttactggagaatgcaacccaggtacatttaaaaccaggaactaaacccaggaaggattaactccagagctgaagtttcgtccattttattgcatgatttctcacagggttgaccaaagacaaaactgagaaagaatttctgaagtatgtcaggactagtgtgttttataaagacttggccttcttgaatcctgggagcttctgttagcctttgtcaatacacaacaatttccatacccatgccaacaggcagatttaagcaatgtttaattacttaaataaagtatcatttatatagtctaatttcttacttttgtaatgcagtgttaattcagagccatgcatggatcagacgggataaggagaactaaatgggaggatggcgttaactctgaaagtcttaggaccctgagtggggtgtggaagtgaagagtgggattagagactcagtgctttgcagcattcctaaagagtttagcctttaaaaacttggaagagctactcatcttgctaatttgcaagaaataagtgataaattgttcaacaggattgtattagttttctaacattgctgtaacaaattaaattaccataaacttagtgtcttaaaatagtgcatgtacactattttacatttctgtaaaagtccaacacgagtcttggctaaaatcaaaatgtcagcagtgccatgtcctggaagtgcttggagagcattccttcgtttgccttttccagcttttccaggctgcccacattcctggctcccttccgccattttgaaagccagctacactgcatctctctgaccatccttccatggtcacatttccctctgaccatagccaaggagggccttctgattttcaggagctttgtgattacattgagcccacttgggtcatccagatgtaggaaataattttcctacctcaatgtccttaatcttaatcacatctgcaagtcccttttttccatgtaaagtaacaaagtcatacattctgggacttagaacgtgtacatctttcaggggctattgttttgcctacttacaggggcctttcaggaataaaggttacccaacctaacattttaagtcattccaataagtatttactggctggattttctctggtagctgctctttgggcagtggggacacactgcacaacctcacactcaggtcctgcccttagagagctcacagtcaagtgaaaaaaatcttcatttgtgactcctaggcagaaaaagatgtgtaagtcttttatttcaatatgtagtattcatgttttctagaacctaaagcttagtatagtcattatctcgtataatggagagacaatcagaaaagtagaattcgattgattattaatcttgtaatgtcctttaaactaaaaatttttgcatttgtgcccttcccttgacatttccagctaacatgttttccttcccactggatttatatatataaaatatatgttatatatatatatattatatacggatattatatataatataataatatatatttatatctatatatatactatagatatagataaagatatacacatacatagtatcatagcaagggcagggcttttagagtcagaaaagtggccaaatgttgtgggatgtgtcatccaacttctctgtaatccagtcccctcacctttaaaatggccatgtaaatgctgatccatcgagttctgagcagtgtcagtgagatcatgcatgtgccacatccagtagagtttttggtccttaaatgcatcagaaatgttaggtattcttttttttcttccttttctttttcttcacttttattttaaagtctctctccatcacccagtctggagtgcagtggcgagatcttggctcactgtaacctccacctcctgggttcaagtgattctcctgcctagcctcccaactagctggggttacaggagtgcaccaccacacctggctgatttttgtatttttagtggagacagggttttgccgtgttggctaggctggtcttgaactcctgacttcaagtgatccatctgcctcagcctcccaaagtgctgggattacaggtatgagccaccatgcccagcctcatgttaggtattctcatttccaaaagatattcccagaattatacttggatcaggagtggggaaggttttattgccccaaagtagaaaatctggccctttttctcaagaagagtttagtcttcctgggaaaatgaaatatacaagcaatgtacatgaagtggttaaatagtgaagcaaggcaaatgaaatcaatggtgcagatcagaaaactgtagagaggcagagaactgaaacgggaacaaaagcgtcaagggggaaaatagcagccagtactggtagctagggagatcgtgatgtgttgaccatgtgacttgtgccaggcagcatcagtgtctaaattcagaagagtaacagagtgtcacttcatcataggtcttgaatgcctaaaggataatccagaatagtgccatgagtataggtatggaaattctgggaggtccagatgagcagatattttgttgctaaatattaacttgaaagataattgaaaattcacatggatctggaaagaaaagtccatagttgatgttcagaaaacctaaagaattggcttcaatgaactattagtcaccctaaactggtttgaaaatataaatactgtgtgacacatttaataaatggtgtataaatattttatgtcctgttccttatcaaactgacattctttaatctctttcagatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtgggtgagtgtgcctgggagctgacttaacatgctattttcctaaggaaagtggtcaaggtcatgttcagaagtgtattaactcttgacacataatatatggagggaaaaatcaaactacttttcaccatacatttgagttttagacttcacactgaaattgtactttcttttttttttttattatactttaagttttagggtacatgtgcacaatgtgcaggttagttacatatgtatacatgtgccatgctggtgcgctgcacccactaactcgtcatctagcattaggtatatctcccgatgctatcccgccccccctccccccaccccacaacagtccccagagtgtgatgttccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatagatggacatttgggttggttccaagtctttgctattgtgaataatgccgcaaaaaacatacgtgtgcaggtgtctttatagcagcatgatttatctttgacaaacctgagaaaaacaagcaatggggaaaggaatccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccagaagcaatggcaacaaaagacaaaattgacaaatgggatctaattaaaccaaagagcttctgcacagcaaaggaaactaccatcagagtgaacaggcaacctacaaaatgggagaaaatttttgcaacctactcatctgacaaagggctaatatccagaatctacaatgaactcaaacaaatttacaagaaattgtactttcaaaaatgtattgaattgggatacttctataattcaaaacagacaccataatattctgctgttttctgtttgtattcgtatgactaggacatagaaaaatttaatttgcatatctttcttccacaaaagtttaaaactgcgtttatgttattttcaaatagatgtccgtccattgatacaaaccaaagatggagaaaattacgctacagtggttgggtacagtgctttcttacattgcgagttctttgcttcacctgaggcagtcgtgtcctggtaagccggtggctcatggttttcttaagagaatgtcaattgtagatttgaccttgtttcttcatccgtcatttgacaggctgtattgtgtctatattgttacatgtacccagtacctctgagacataaggtaacaaacttaccggtccaggaaattagctctactgaaagcattggctagatttctaggattttctcacatagagacatacagagagccacttgtgttcataaagaaaagcagagaattgaagagattacagagacaattttaaaggtagttttggtttttcattatgaggtaccacaaggtcatgttttactctattgttgttgttttgggattatctaaatgattatctaagctcgaatttaattccaaatgcatgtgcttaagacttttccagcattcattttgattttaatttcaatgaattaattggtatcataagtccaaagacattatcaatatggatctaccttattagttgctttactgaaaaagcttggttaaatagttcttgaataattttgtcattggtctgtagggcagtgtgagatgagtgaccccaggtcataaatttatagggtcagatattgcctttattttaaatcatgatacgtattttgttcatcgtgggttttttgcattattgtgatttttcaaaatactagattgaaatattatttaccttgcttactgagatgtttggcaccctgttaaattttgcatctggggcaagcctcccacttgcctcagcctagtccctgtcctgtatgatcctacatggaccgcatccacagcttatccttaaaaaaaaaaaagaaactcaagcagtcgcttattgtcaaatgtacagggtaaatcaagctgtagcagcaagggcttggaaatggctgaatgttggaggaaatggctctggggttgatagggtaaatgtaatccatgtccacaggacaggcaagactccccagcttataatatttctgaatgaccaatgttctcccaggacagcaggaggtttgaaaggttcattatctctttcaattactagctttcccatttagtaccctggagcaatcattaactaaagagttcaccatcaataagccagaaaatatttattaagctctgaggacacatgcaaaccggtgctggtggctatgacaaatacagcagaagcactgagcatggacttggattttctatagccacagtctatttgggtagataagatatacaatcttggtccattttgagaaaaatatgaaacccactggaacatttcatgaggttttctgagctattgaaaggggattagcctgaatgacgtcactgactagtattaaaaagcgtatacaattttgccctacctcagatggatgtacgctttctttgtccataggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaagtatttttatttcactgttactttgcatgaattgtcacatgggttcagtctgtcttcatttgcccaaatggaataataccatttaagttggagtaccagataaagttctttgaaccgtttttcaaaattcctagaatgggtttcatctaaaagattattgcaagaactacagggtatgcccatgatatgtgcacagcttcatcctattttaagaggcagccaggtgtctgtagtgacagatggctgtcaatatttaaaaattacctattaaccatactacaccatatttctgtaactatattttatttccaaagctaactcaaggtaatggtaacagtaatcaagtttttgagctaaagatttcacaaactcataactttataatgactgaggcatgacagaatgaggagggtttttgatcctctttttgagtcataaacagctttgtattattccttctcacttcagggcacagtcctgggagctgttaatagtttcttgggcttcactgatattttgattttaatattgctcagagaatcttcaagaaaacacaaaatggaaaggatcttcggtattaataaggagcatttttgtttcttctgtcgtgtccatatcccagcctgcttctcacttccacctagataagggagagcatatttgtttgatcatctgttttcactgatgccacttttcctcatacatatctgctgttgtatccactgatgtcttgacatttctttctctcttcccatatatatccttccttccttcttttttcatcctgttttccttttcttttgctgtacatccttttcttattttatagcatttgtctctttctgtgccctgagtaaatcagtgtgccagccccacagactatatttttaaagcactcaaatactctcccacaatatctacttatctctgatgtcttttacattttcaagtgtcatgtacacttttcaagatgccctcatgaagtcactgaagatggtgatgattgtttttatacttcaaaaagtaaacctatatcaaggttaagcaactcagctaggtgtaaggagcgtgaagcctcgaatccaaatggaactttgcactcctattgcccaatacagtgcttggcccaaaatggacctcaaaactgctagtggccagagagatggacaagtttagaaagtttcaatatgctgtagtgtctattttatatgttaaaaatatatacgaatcgtatcaatggaggattaaggacacttttttttttacatatacaaaaggcatgttgagaatggagttaagtgagagcctatatagtatagtgattgagagcatgagctttagtctcaggcagatttgggttcaaatcctggttcagcccattcccggttaggaaaccttgtcttatggctcaatttcattttagccttaaattattttctctgtaaggtgggagtattaatattcataaagttgttataattataaaatgccacaatgaatatgcattacttagcagagccctgatagagaagtgtttattaaattgtatctattattattaaatgaatttctggctttaaatttagaattagaagtaggatgtcaaataattcacttaaaattaattcaatttaatagtctcttcaagttttgtgcctggaataacaattaattttattaatactttccatttttagccagttccttgagaaaaatgtacatagccaatatcagagtataattatagaattggaggtcagcttgtgcagttggtctctgggaggtccccaaaatgccaaatgccacattaagagtatacttacttttaatagggcattaaagagtaaggattgcacgttttgaaacaatcataatgaaccaaacattttcttaaggcagccataaaccaatctttgagtttcataatgttgataactacaaatttatttttgtttcaaactatcactccctgtaattcattcaaaaggagacttaacactatgtattgaatgcctacggtgtacaggctcccttctaggctctggagacactgcagtgtcatgaaacagtcacaggccctacttccctgaggcttgctttctagttccccaccttcatgttaatagttcatccattcatgggcttaaacatttaccctcaggtttctgaattaataataaacaccctaacagaaaatcaaatatctttcccttttcctttacagtgctttgattatatatccagaagcacttgaaggagaaattatgttattttcaacttctagagacatttgtttgcttatactttgcttactcccttccccaagaaataatgagggaaattcctaaactattagttgatatttccacttaaattttgtcagatgtccaagcctggatggaaagaaaataataatgacatacaatgttaggaaattacagtgggacaaaccctgcatgaggattggacagttatggtgacaatttgggttacttaacttgcaggcacttaataacaaagtaagttacgcttagttctaactaatatctttgtttggtaaaaacagatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggtaggtaaactattatgatatgtcataatatttgcttggggtaaacaacttgcatttgatttaaaaagttctaggtcgggcatgctgactcacgcttgtaatcccagcactttgggagaccgaggcgagtggatcacttgaggtcaggagttcgagactagcctgaccaacacggtgaaaccccgtctccactaaaaatacaaaaattagccgggcatgatggcacgtgcctgtgatcccagctactcgagaggctggtgcacaagaatcacttgaactcaggaggcggaggttgtggtgagctgagatcacaccactgtactccagcctgggggacagagagagactctgtctcaaaaaaaaaaaaaaagttcttaaagcattcatacagaaacaaaaacaaaaactgagtaatatttctgtcttcaagtcacttcactctgctatcatatgtttatcatcctgtttttgctactgacttttcatgtaacatgtaccattctattagtgtgtgaaatggaaaccactctaagtaaccgaggaagaattgcatgggcttggatggttgcaaaaaaaaaaaaaaaaaactggaggagctaggcctagaagaggctgcatactagtcttctaggttcttgatcacaaagcactgcagctgcaatccaggtgtctggaaactgctgccatcttcatggccacctcaccccattggtactactcgtgagtcctgccactgccacctctcatgtctgccagaaccactgtctgctcccactggcccagagaagatggcatccattttccttctacttttcaatctcacatgagtttatttaactcactagcaaaacctaaatcatatctgggattcttcctgccagagagtactgagaagtacacctttgagtcttccaaactctgtatagagaatatagacaaaatataaaagagaacatatagaggaaagtgtgaatggatgcttaatagcactagatgatattaagtacatcaaagaaataaaaagtcagcatttgctgaatgtctactctcttttgaaaatatgagaaagtcagcttcgcgtccttttgcattgttactaagtaagggttaaaacttaaccatcttggagccaaatctcccctctcattaattttgtaatttattaccctgtaaaactacaaatctgaaaatgtttagataggacatgtgctgcttgcatgagacagcaacactgccatgggtaagatcatgaactctgaagctcaatggctcagattcaaatctcagctcagtcacttattagatctttgaacttagacaagctgcttaacatctttgtgctttagttttaaatcccataacatagtttgaattaaaagtattaaaaaggtactttcattatagggttaacaataccaagtacttagaaaacattaacatacagagcacttagaaaataccaactgcacagtccatttttgcttttgtgatttgtactgctaatttcttcatttttttccttatgacaaatttctttttttaatttttgtttttctttacatcttcattaaaaaatgggatacatgaacagaacatgcagatttgttacataggtatacatgtgccatgatggtttgctgcacctattgacctgtcctctaagttccctccccttgccctccacaccccaaaagtccctggtatgtgtgattcacctctctgtgtccatatgttctcattgttcttctcccacatgtttgctgatgatgatggcttccagcttcatccatgtccctgaaaaggacatgatctcattcctttttatggctgtatagtattccatggtgtatctgtaccacattttctttatccagcctaccactgatgggccttggtatcggtttcatgtctttactattgtaaatagtgctgcaataaacatatatgtgtatgtgtctttatagtagaatgatatatattctgttgggtatataccaagtaatgtgattgctgggtcaaatggtatttctggttctagatccttgaggaatcaccacactgtcttccacaacggttgaactaatttacattcccaccaacagtgtaaaagtgttcctttttctctgcagcctcaccagcatctgttgtttcttgactttttaataattgccattctgactggcatgagatggtatctcattgtggttttcatttgcatctctctgatgatcggtcatgttgagctttttttcatatgtttgttggccatgtaaatgtcttcttttgagaagtgtctgttcatatcctttgcccatgtttgatggggttgtttgtttcttataaatatgtttaagttccttttaaattaagaatattagacctttgtcagatgggtagttgtaaaaattttctgtcattctgtaggttgcctgttcgctctgatgatagtttcttttgctgtgcagaagtgctttagtttgattagatcccatttgtaaattctggcttttgtttcaattgcttttgccattttcatcatgaagtctttgcccatgcctatgtactgaatggtactgcctaggttttcttctagggtttttaatggttttgggttttatatttaagtctttaattcatcttgaattaatttttgtttaatgtgtaaggaaggggtttactttcagttgtttgcacatggctagccagttttcccagcaccatttgttgaataggagatcctttccccagcgcttcgatttgtcagttttgtcaaagatcagatgattatagatgtgtggtgttatttttgaggtctctgttctgctccatttgtctatatgtctgttttcataccagtaccatgctgttttggttactgtcgccttgtagtgtagtttgaagtcaggtagcgtgatgcctccagctttgttctttttgcttaggattgttttgtctatatggggtcttctttgattccatatgaaatttaaagtagttttttttctaattctgtgtagaatgtcaatggtagtttgatgggaatagcattgaatctataaattactttgggcagtgtggccattttcgtgatatttattctttgtatccatgaggatgggatttttttttttcatttgtttatgtccttttttatttccttgagcagtggtttgtagttctccttgaagaggtcctttgcatcccttgttagctgtattcctaggtatttgattctctttgtagcaattgtgaatgggagttcatttatgatttggctctctgctggtctattgctggtgtaaaggaatgcttgtgatttttgcacattgattttgtatcctgagacattgctaaaattgcttatcagttcaaggagttttggggcttagacaacggggttttctaaatataaaatcatgtcatctgcaaacagacaatttgacttcctctcttcctatatgaataccctttatttttttcttttgcctgatggccctggccagaacttccaatactatgttgaataggagtggtgagagagggcatccttgtcttgtactagtttgccaagggaatgcttccagcttttgccaattcaatatgatattggctgtgggtttatcataaatagctcttattattttgagatgtgttccatcaataactagttaattgacagtttttaacatgaaggaatgatgaattttatcaaaggccttttctgcatctattgagataatcatgtggattttgtctttggttctgtttatgtgatgaattacatttattgatctgaatatgttgaatcagccttgaatcccagagatgaagctgacttgttcatggtggataagttttttgatgtgctgctggatttggtctgccagtattttattgaggatttttgcatcaatgttcatcagtgatgttggcctgaatgttcctttttttgtgtgtctcttcctggttttggtatcaggatgatgctggcttcacaaaattatttagggacgagtcccttcttttcaattgtgtggaatagttttagaaggaatggtatcagctcctctttgtacttctggtagaattcggctgtcaatccatctggtcctgggctttattggctggtagactattaattactgcctcaatttcagaatttgttattgctctattcagggattcaacttcttctggatttagtattgggagggtgtatgtgtccaagaatatgtccatttcttctagattttctagtttatttgcatagaggtgtttatagtattctttgatggtagtttgcatttctgtggggtcagtggtgatgtcccctttatcattttttattgtgtctatttgatacttctctcttttcttctttatcagtctagctagtcatctatctattttgttaattttttcaaaaaaaaaaaaccagctcctggattcatttatttttttggagggtttttcatatctctgtctccttcaattctgctctgattttagttgtttctcttgtcttctgctagctcttggattagtttgctcttgcctctctggttcttttaattgtgatgttagcatgtgaatttgagatctttctagctttctgatgtgggcatttagtgctataaatttccctcttaacactgctttagctgtgtcccacagactctgatacattgtgtctttgttctcattggtttcaaacttcttaatttctgccttaatttcattatttacctaggagtcattcaggagcaagtttatcaatttccatgtagttgtgtggttttgcgtgagtttcttaatcctgagttctaatttgattgcattgtggtctgagagacggtttgttataatttacggttttttgtatttgctgaggagtgttttacttcaaattatgtggtgggttttagaataagggtgatgtggtgctgagaagaatgtatattctgttgatttggggtggagagttctgtagatgtctattaggtctgcttggtccagagctgggttcaagttctgaatatctttgttaattttctgtctcattgatctgtctaatattgacagtgggttgttaaagtctcccactattattgtgtgggagtctcagtgtctttgtatgtgtctctaagaacttgttttatgaatctgggtgctcctgtattggatgcatatatatttagaatagttaactcttctggttgaattgttccctttaccactatgtaatgcccttctttgtcttttctgatctttgttggttttaagtttgttttgtcagagactaggattgcaatccctgctttgttttgctttccatttgcttggtaaattttcctccatccctttattttgaatctatgtgtgtctttgcatgtgagatgggtctcctgaatacagcacacagatgagtcttgtctccttatctgatttgccagtctgtgacttttaatttggctactcagtgcatttacatttaaggttagtattgttatgtgtgaatttgatcctgtcatcatgatgctgtttggtcattttgctcattagttggtgaagtttcttcatcatgtcattggtctttatattttggtgtgtttttgcatgactggttctggtttttcctttccatatttagtgctttttttcgggagatcttgcaaggcaggcctggtggtaatgaaatctctcagcatttgcttgtctggaaaggattttatttctccttcacttgtgaagcttagtttgacaggatatgaaattctgggctgaaaattcttttctttaagaatattgaatattggcctccactctcttctggcttgtagagtttcttctgagaggtccaccgttagtctgatgggtttccctttgtaggtgacctggcctttctctctggctgccctgagcattttttccttcatttcagccttagagaatctgatgattatgtgtcttagggttaatcttctcatggagtatcttagtggtgtactctgtatttccttaatttgcatgttggcctgtcttgctaggtttgggaagttctcctggataatatccggaagtgtgtttttcagcttgtttccattctacccatctccttcaggtactccaaccagttgcaggttcagtctttttatgaagtcccgtatttcttgaaggctttgttcattcctttgcattcttttttctctagtcttgtctgcacactgtatttcagcaaagtggtcttcaaaatctcatgtcctttcttccacttggtagctttggctactgatacttgtgtatgcttcatgaagttctcctgctgtgtttttcagctccatcaggtcatttatattcctctctgaaatggttattctagttagcagctcctgtgaccttttatcaaggttcttagcttccttgcattgggttagaacattctcctttaggtcagcatagttttttattacccatcctctgaagcctactcctgtcaattcatctgcctcatcctccatccagttctgcgcccttggtggagagacattgtgatcactgggaggagaggggtttttagcattttttttgttgattctttctcatcttcataaatttgtcttccttctatctttgaggctgctgacacttggatggggttttttgtgggagattttgttgttgatgctgttgttgttgctttcttttctttcttttttttttttctttcaatggtcaggtctaccttctgtagggctgctgcagtttgctgggggtccacttcagtccctattcatctggttcacgcctatgcctggagatgtcactcaaggaggctggagaacagccaagatgggtgcctgctccttcttgtgggatctcagacctcaaaggtcaccaacctgttggcagtaggatcactcctatatagggtgtctgacaagccctcttggagggtctcacccagttgggtggcacggggaataggacccatctaataaagcactttgtcccttggtggaggggatgtgcttcactagggggaaaccgacttgtctgggctgcctggattcctcagaactaccaggaggagacgctaagtctgctggtctgcagagaccatggccacccctccccctaggggctcaggcccagggagatctggattctgtccctgagcctctggctggagttattggagttcctgcagggaagccccacccaaggaggaatgatgggtcagggtcaggcctgaaaaggcactcagggtcaggcctgaagaggcattgattctgccacagtgggtgtgttgggctgtgggggacgtgtcttgggaccaagccatccagcctccctggctccagcaggggagaaagcacagcctggagctacagatatgaatgttgcctctcccccacccagggagcttagcgtgttaggcagttgtgattcccagtgctggctgctgcccctcttctaaggagctcaaatggcttaggaagcaggcagctgcagctgtggggctggccgcccctccaccaggagctcggtaggcttaagcagattccagctgaaaggctgttgagaatctgtggggcttcggggttgtgatgctagacccagtggctggagtttgtgagtggggtcttccaatccatgggtttcacagttctgtggaaaaagctgggtagcacattcactcaccgcctcccttggctggggggaagggtctcccctgccccgtgcggctctcaggtggaccactgcaccacactgttcttccctcctctccgcggatcatgccagcctcctagtcagttcttctaagagaaacctggataccttggttgccagggaaggattcacacacttactatagttcttttccatgggagcctccgaacacagctgtttctagttcgctatcttggtcctgctccctgcctccgcctcccccagcccccaccgccccactgccttcatttcttcatctgcttgtctcatttctgttgcttgcttggtctatgttggtatttatgtgtgagccgcctctatgcaaaggcattggtctcagccttggttcttgatttattctctcccctccttccgatatatacaaaggtttgcagaaaggcagtgtatgtattacaaccagttctcattgaaacacgagattaattatatacctctaaaggctacgctttgcaatacagatctccagcctcaggttaggtctccgctgatctgccaactgctcagatatgcctaaattctgcctcttttgttactactgcctgactatccggggtcttccatgtgacctctgggctacagccaagaagggaatcagagacccatggctggtgggtaatatgacatggacatttaggctttgaccccagaagccctaagcaaccttttcatgtgacccagttttacagttcctgcaggatcccagagctgacactgaaatgaacctctggctatctgagtggactgagcaagtgacacagatgttctgccaatttccctaaacaagtaacagggataaaggacaataaccttagctcagaagaggccccaggagcaaggaagcctgggagtaactgctgctggctggccttgactgctgccaagggcatgcacggtgatatagcagggagtagaagtcacaggtatctgctaattttctacaaagccatatcagtaacctcatacttcttaccttctgctgagacaccttctccttattactatgcagaagaccggaagctttaacctaaagggaggttaaacttctaatcaaatatacatggtgaacaatgagaagtgaaaattccttcttctcttctcgcttgtcccctttcttgtgtagggatgcagtaagtgctgggaactgccactctgaaccattagacctacggggcttcatgttatgttagtacttcccatacatgctttctctctttaggcctcccaataatactattaggtagattgaaatgcccccccaggaattttctgtggatttcctacctgcaggtggccatagaccatacaggctatagaccatacactatggttatgaaaaatgaaatggagcatggctatgaaaccatttttagaatttatatcgtgcttaacaaaggtaatggggactgttcatgactgtaggcaaagggagggacctagtcctgtgggagagaccactgtagcatgaaaagtgggatatactgataactaggagggcgtgggaggaaagggcattgagaatccagtgggagggtttttccttggcaccaaataggagctgcttttttccccctccagaaatagtggcaaattaatgagggaaggggagaagttgaagatgcaaagatgaagatgcagtcatagtgaaaggtctctttctaacaaattaggaaataaggtaatttgttcaagcagagaggcaggagaaatgggagttggggacattaaaacaccaaccatgagaaatgtgattagcaataagccaaaaatgaatgaaatcaacttgattaatattattagtaacactctctgagcacatactctgccaggctgtatgcactaatcactttatgtgctttacctcatttaattctcctaaagagaaagaaaatattgttatccccatttttcagataagatgaattaggctcaatgttttgttcaaggttgtacaaataataattgatggaactgagccgcaaacacaggtctccaaagagagaatcgttttgtcatagtgccttcagggaaacacggatattactcagctgaacagggtaagacaacaatggctgctgacatggattagggactagcagactggataccgcagatgaaggagtcgagtggttttagtggatagatttctcaggcaaggtaattaagcagatgaaggcaaacagaggaaaagattggggcacgaagatgtgaagaggtttttagcttcttctaagagttcaagtgttatgagagtagaaatgatacaactttttaaagcagaatcccagctgacctatgatgggaacataatgtgagggaggaataagtgactgttttcttgggcatggggaatttggagctgtctgttactgcagcacaccatagtgtgaccccgtgtgtgattttctgtgtgaccctatgtgtgacaactatttgtgattttgacatgtgacagaattatccaggcttcatgttcaaatgcaatggcccttgccccatctccaaatgtactgatttggaacctggactgaggctggaacacgacatttttaataagttctttaggtataccatacctaccacatttcgaggactagtgaggcacccaacgttgattaattggaggcacctaagatacatttgtgagactggaaacaaggcatagtgcaaccatgacttgccaaaaaaattggtagctttcttctctggcctgaaacaccccgtgccagggtataaatcttggcaagatttcagctactatgggccctcgtgcagggcacagaagtcctatttcaagaggttattaaagtatattctttcatctaagaaggtacatttttcaaaaattgtcaggatatgcagtattctaatattgtatcaaatggacacctgagtaacatgacctgacatgttaattcatgtcaaagttttattatgtctagaattatggtgagattcttgattaacaattcaaggtaatattggttggcaaatctttctattattggtgtaggaataagggctgattctgtctataatcaaaataactatgtttcattacactgcaatttaaagtaggtttatataattcaaaattctcagcattttatatgaaatgtacataaaaatattaattatgtgagcctcctttcctcctcacaaggatgacactatttaagttatttcaacaaaatgctaattattatgaatacattttaaattttacggaacttgaaaaatactttaatagttatctcaacaatggtacggggtaaaaggtgaagtttataaagaagcagttttctcatagtaaacctgatcacaaattggtaaaaacaaatgataaaaagtgaggtgaaatgatttgcaaaaagaagtactacactgccatcttctgttcaaataagtcatatgcttcaattgctatctgatcttaatgtgcattgtacttgggagtggaggggcggagaaaagagaaacttgtgaaaaactgagattatccgactccttctcaggtattctggttctgtggaatggagatggaattcaggaatctgcctttgtaggaagcactccaatcgagcctatataggtgattccctaaacataccttaagaattactcaaatatatcttggccattgtgaggtatgatgcactctttaaacatgccaggcaacatacagttccatcactgacccatgcaaacagatggttagatttcataatttttaatgtgattttgtttatggctatgtagacagttgtgtatgctagaataattctttatctccaggtttcaactgtggcattctctaatcaaatttgcattgcataaagtcatctttcactcttagattgttttcgataaggaatatgcatttttaaaagaattgggtttctatcatttctattgttttccttctcatcatgtactcactttttttctgataggataattattgatggagctaatttgaccatatctaatgtaactttagaggaccaaggtatttactgctgttcagctcatactgctctagacagtgctgccgatataactcaagtaactgttcttggtaagtgcactaactaatgagaaatctgttcatttcttcatttctgattaaatcccatcgttcctggccaataaagctaatgattctttgagcccctgcacatatattgttagtttcaaatttttgtttaaaaagcaacacaacttcaaatcctttctccttttttcatataaaagaaattaattaatgcttaattttttttccctacatgtgttaatttgccaatagcagtgggaggtaagtgatgctatccgcagaaagaaaaataaagcacgcttgagttcctagcactcttgagctactctttcctggtgtacaaagaaatggggctgaggaatggaggtgggctagactggaggatctcgataggggtcaagaggtggatgcacggtggtcatctctaaaccaaaggcacagactgagttcccagggttccaggaaggatggagaggaacttccagcattctacaaaggaatgtctttgatttttgtcgttgttgttgttgatgaaagtactaatcaggaaacagtgtgcacacttcactagtataatcaatgcaattactcctgaaatcaccaatgtttaaagctcttagaccatctgctggatgttttccaaaatttcccttccagattcactctctaccagctctttgacctagaaaggttgcttttaaggacaacatcagcaaaccactttccttccagctattatttggttcagcaagtggagggccgtttggagtgttgtactgattctccctactccatccctgtggactggctgtgtcccactgccaaagtcatggcttctgcagacagggtctcctcacaccattccttctgatgaggctctagcagctgcatcccaccaccaatatttcaagtctctctcacacccaacctactgaacatcctgcccacatctttttaaagacgttttattaaaacattttggaactatcgtaaatttgtgtgagttattcattgattttctgcagggaccctaacagctacagacatttgttctgtttcggtggccaccatgtagtctttcttttagtttgcagacattccttaaaagtgttggttttgcctacccttctttatcatatgtctacattaatcactgttatcaacagacctttgtgtctttagcactccagctgttggggccacctgttaggttccaaacaagggaggtggtggtacagaccaagggagaaagttcagtctcttctgagagactgataaaaaaatgggtcaacaggctggatcccttcaagtaaagcaaatggccaacctgtctcgggcgaaacaaatggccatcaaggttgggttctaaaataaaagaacagtttccacttacagaaggtatggacttgtagagttgtcgagtcggctcagtagaattgtacctttaggcagaatgtttggccattgggtatttgagcattttcaggtctttacaagcagaaaggtttaatcccctaggatgatttcaacaataattcatcagataaagtagtcgagcttcagataaactggaattcatcccaggcctagtgagtagaggggtaagtgtcaggctccgtgcgctttgtccctaagtattttgagcagtctcagccaccaaaaggaccgggtctcctactgcttggtgctccccttctcaatttccttacaaaatttaaaagttcattcttgcgattaggctgccatttttggaactattaatttttttaattctacataaattttacctacgattatatgtactggttatatacgcagtaatctaccagtgtttacagaataaaaataaaaataaattttggagaatattatgtttaaaatttacattcttttattttttagacaaacttctgatttaccaaagcatctctcgacaattgacaataaaaaaataattatatagacacatacgaggtttctaaaagactatgttttaccccctggaaaacaattttttaaagtacatacttgaccccctttaatcaaaagttatttttaaaagccttgacataaacatgctttcaggatatcattttttaaaagtttcagttgcaagttcatcagttctagctccatacgattctcagaagagccagattttaatatcagatgcaatacacagccttagtttattccaggaagcttcagaaatcagtggactcagtaaatactgaagagaaaccaaagtcctctgagctcagagattctgaaacctgttgaagaattaactttttatttatggctttaatgtttggacacagtcatgaaccacattttttaaaaaacatgttctctcttctgaattggaaacgatgctttttgtcaatgtaaatttctaacaattagcaaatattcaggaggagcaatggacggtgctttccacttggagaagaaagagcccattgaaaggctacattagataatatcttccttttctcttctgctaaaagataaaagtcctccaatgcttgagagaattcaaacccaattttcagagtaaataccattagaaataagatttctttttactgttgctttattttcaaagtaccagaaattttcattttctttagtactcaaaaatttgtgatcatttacttacttaattttccagtttctgtcacaacatttaacaatgccaaatctccctgttctgatataaactgccttcctactctttttgagaactccaggttaagacggtatcaaagttgctataatgaaaattcattgttatcaataatgataaaaatccaacacagttgcagaaaagaaagcagagctcatgatctctttttctataaccataagacctaatgtttattgctttaatataataattatacacatgattgaagtaataatatctttttcactgatttatttagttataaaacatttatgtgtgaggcactgtgggcaatgcaaagcttaataaaatatgacccctattcttggagatgaatcaggcatataaacaaatatgtactggacaaacagaaatgattcatttgagatacatcatgtttcccagacttgggtatacctaatccccatccaaggaacttgtttgcaaatgcagattcctgggcccaccttcctcagtaagccagaaatagggcctaggaattttcattgttattaactactcctaaaagaattctgatgtccctggtcaaggataaccccttgagactgtaatcagagaagagggaggtaatatggtccattggggaggacatgtggagatgctgcattttacaaagaaccccagaccccagagcctgatgcgattgaacacagtggagacatgggcccagaaaagaagggtttttatggaaccaaactggggtccaccaacccagtgcagtaagaccaggtatctatactgaggtttgcagtgggagaaaggaagacacttatctgcagggcaccaaacaagaactggtcagctcatgcttaagtcccaacctccccagtggcttgcaggtgaaggtatttaaaagcaggagtaaatttcaggagagcaaatgctataggcaaaatagtaaattagtacattgaggttacacattgctttatgcctaaaagggtgaggtatcttgaactggagttggggcatggcttacaggtcataggtggattcaaagattttctgatttgcaattggttaaggaagagaagctttgtttaaaaattgggagtcagccaaaaagaatattagctctggctcatggatgtggctccctttaggccctcaggaagaaatttacaaaaaatgatggtcagaactcagacttcagtttccccttatctgaggtctccatgccagcaaagttatttggtgagagtctgggttccagaaaaacaacttagagacatatattaagatgttatcttcagtttctataggagaaccaaacatccctgtgattccagcttccttggctattgtttaaagctactattacctccgttcttatcaagttgtttatttacttcttagggctagctaggtgcctgaattacccttgaaactccacctttcccttccatatgtggggtggggggcgggggtgcttcccaggtccctaagagggtggtacctcctctgtctccgggtagctggcaatgtgtctgaggaagggaatcaggtaaacaaaggcaattatctacattttcccttcctttattaattagatgttccggatccaccagaaaaccttcacttgtctgaaagacagaacaggagtgttcggctgacctgggaagctggagctgaccacaacagcaatattagcggtaggaagacttgggataactgttttcattactctagatagtcaaaattaatagcgaagtcactttttaaccactcttactggtttattcttcttataacatccttttgaacttttaatattgagtataaattttggtataacttatccatactccatacattctaatattttttccctgtttatactaccagagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcaggtatgcaggttctcacatcaggtttctaacaaaatatttgtttgtccccatctttgaacatctaaaaaaaaaagattgatagagtaatgtaggattttagatttctccaaatagtgttaacagttctctaaacagcacacaaaatattcaaagcacacaagtttcagaagtgttacatacgagttcgataaaagcaggaaattaggggagtgacatatgaaaaaaaaacattactttcagtaattttgtgatggctaaatatcaagtttaaccagatatcatcaagtaagttctaaattaaaattcaatatgtatgcatctaacattattaatttttatgcattcagtgtcttttcttgtgtctcaacatcaatctaaatttccaagatgcgtttgaaaaaatctcaaggatgactgctaaaatttgtattactgaattgttattgatcatcaatgtggtcatagcatgatattttatttttccttggctaaaataaatactctaggacataatttcctttttggactgagaaaaagcaagtgaaggttataactggatcagatagaaattaacacttgtgtgattttagtgcatgtcaacctttgcactaaactccacatttagctatttctaataaaacgaatccatctaaaaatattcatgactactgtacaggttttattcattttgatgtccttaaaacttggctgctgatattaatacatggtgtttactttattcttctacaggcaaatattcacaacatatgtttctaatgacaattctaatagaaaaaatagagcaggcttaaattaaaatttttttttaaaaaagcaggttcagaattttaaaaagcagttttaaaaattttaaaagcagattcaaaattaagacacatatactaaaccatctactctccactggataataattatttcactccaagaagactgttttactcttttaaataaaatacatatttaaaatctaccttaaatctttttaggaactggaccagatataaattaataagtacaatcaaacttacttaattatctgtgtttttggggggcaggagttgtgatatgatgacttacctatgggttaaaaggaaaaataatgttaatgtttttaatttttcagctccagataggaatccacaaaacataagggttcaagcctctcaacccaaggaaatgattataaagtgggaggtgtgtatttcttaatacgttatgtatttctttgtgcttttctcttcctcttaggtctgcatgctaactacaatgatagcacaacatttttttaagaacaaagataagatttggaaatgaaattaacttgtgagtcatcatcacaaattttaaagatcattgtgattaaaatgatgttatgaaatcgagtttaacactggtcaacaatttagggaagattatacagattgatttagttgtaatacattaccgaagtttcaaattattaataatttaattaacaatattctagattctcttccattcaaaaaatactgaaaatctttaattaatttagtataatctactagatattatgcatatcaaactgatgaacccccataaagtattcactactcattaaacaccagtagacattttgtattctcctttctagtaattctgaggatggtcttgtgaagaaagcatcatgaacgccttattctagatctggagatggcatccaggattatgaatgtcttgcccatcaccacacaaccagaaatccgcaaagctaggatttatgtatgaggatctttggactccaaacctcactttttcctcctttacatatctcggttaaatgttattaaatagacttcaccatttgaattttgcataaaaatgcccatctacccagataattttaattattctagggtcatttccaaattttttctgtaacagtggggcattttattttctctctactacttggatgtatttaatgaccagtatattggcctacctaaaaggaaattatcattcaaccattctgatgagtaataggcctccaacattgaatttataaaattttgtgtaaacatagaacatttttaatgtatgctgaaatatactaatttatttccacaattcattccaggtataatttttgggagaattttagaatgcacaaagtttagtttgctttttatcctcatatgttggtctttgtactcattacacaatcacatggcccatacctgcaaaatatttagtcaatattttttagatcaaaattagatctttatttccacttcagtgaaattaagttttacaagtttaagatgtggaaaactttttttaaaatggtaatacatagaaatgaaatatattcaataatattatttctttccttgaatgtgtggttatagttactactacattgtcttgataattacttaatttatagtctaaaatgatgttagtcttttagggtgtatctgtattatcctcccttaagttccatagaaattttcataaagtagataatatagttggttagatatcagtaatactgtgtatttgccagtcagttcctcagagaagcacatcatgttccagtaacattagctcattaatcctcactactcctttgggagggctgtggtccatgatggtgtcagtcttatatgtcataaagagaaactgggaatctcagagtttaatgacctcacccagatgccatgggctgagtcatatggaaaaaaggccagaaatcttcagtctttttgactgctcctctcactcataagtcattttttattaccccaaagatacacaagattgattattaatgctctcttcttgtaagaatgggactgtactaagaaagcatctatggccaggtgctgtggctcatgcctgtaatcccagcactttgggaggccaaggcgggcagatcacaagatcaggagtttgagaccagcctggacaatatggtgaaactgcatctctactaaaaatataaaaattagccaggtgtggtggcacatacctgtaatccctgctacttgggaggctgaggcagaaaaatatcttgaacccgggaggtggaggttacagtgagttgagatcatgccactacgctccagcctgggtgacagagcgagactctgtctcaaaaaaaaaaaaaaaaaagcatttaaaattggtctttgaggagcaaacgacatgtcatttagtaattaattgactagaggaaggaagtagtcacaggatttggatctaggctgacagttacattcccaatatgtcccatggtgtctcctattatcttgatgtgtcagagatctaatcactactgacacagccagtgaagtttaagaacattcattcactgagtatggttctgtatggatcatcctgcggaaaggagttagactccaggtttttcccagtttcacaatcagatagtattgtgaatgaattaccagaccccctccagagatgtactagaaataattcctatctacatgataatggtcagagggacataatttgaaaaaaaaaaaaaaaaagctgatctttcccaaaagaattaacaatgaagatgagcagtaggaacagactggacatccctaatttttgtttatttgtttatgttttacatttaacattaaacatgattcaatttaaagtaacattacaatttaacttaatggtagaactaggctttttagttagcattaccttcagacattcacttctcatatattaagtcggtcatgactcactcatatattttgagtgttcgaacatcataatgttctacttgcaaaacaggacaaaagagtctactgcaaccttatcagttaaatacctgtatcaggataatttttgcttgagagtttccattgttcttaagcatatgtatgtgaatttttaactttgctcagcaaaataacacatttcaaacttaaaggacaccaaaagcaaaaccaaaagcccaaaaccccactaatgttgggaagcaggaacatctttaattacctggttatataatcgcatccaagatagttaactcctaatggatctaggttttattatttataatacaagtataataagaagacctactggctttaaaatgaaaataagtggaattaaatgaaatattgtataacataatgactatagtagataacaatgtattgtattcttgaaaattgttgagagactaggttttaagtgttctcatcataaaaaataagtatatgaagtaacatatattttgagtagctcaatttagccactccacaatgtatacatatttcaaaacatgttgtacataataagtagatacaatttttgtttctcaagaataaataaaaatgttcaacaattttttaaaaaatggaatcaaggcaggacggcagtctttctgttttctagattaatagttataaccttgcttgggtcatagatctctttgaaactatgttggacgtgcaagctctttttctagaaaattacacacaaaaagtcatactaacaatatcattggtttctcagatcctctaaaggatacacatgtaccccatctagagattcctacaccccacgttaagaacctcttttctaaagactccttcctcgtgggctccttcacgagaggcagagggaagggaaggctggtggcctcttcctgcttactctgccctggctccttttgttctttcttgaagagattatttgggaaatgtctgaggctcagtaggcattgccttcaagtcaaatacaaagcattcaggctgtttatttgggttcccaggtactaaaaaggccgctaatatagctaaaatatttttgtttaaagtgttatggtttattatttatttatttaaaatttgtcagagaactttattaaatttaactcctttctttggagcaaaatgtgtaaaatgaataatattatttgcacacacttattgtcagcagagactgaagaaaactatcattccagattgcagtacggcactacaagcccatggcctaattcactgggacaatgctaaagcccctggtgaatttatatccatttcacactctaaaatatcttggagcaaaactttccaatgaatccaagtattaacaaggtctgcagaaaatctcagaaagttttcattttgttttgattttttttttccctcagttagtttagtttattcaccttggaataggaatacacttaaaattattttgctgatatgtcactaccctttcaacttaattccaagcaatgcctctaataagtgttttagtaaattagattaagttgagaaggattacagattctgtaagaacactatgtatgacattgttgactcactcacatatccagagaaaattactgtttatataagtgaaccttaaatttaggattaaaatcgtattttaaacttattttatataactgattcatttcaatgcacaatcccattatctttgaaagctaaacaggcagtttaaaccacattattgtttttaaattaaagtgttgctcaattaaaaactaaagtggaaataaacaatttcccatactagaaattattcctccaggctgggtgctgtggcccatgcctataatcccagcactctgggaggccgaggcaggcggatcacctgaggttgggagttcaagaccagcctgaccaacatggagaaaccctgtctctactaaaaatacaaaattagccgggcgtggtggtgcatgcctgtaatcccagctactcaggaggctgaggaaagagaatcgcttgcacccgggagatggaggttgccgtgagccgagatcacaccactgcaatccagcctgggcagcaagagtgaaactccgtctcaagaaaaaaaaaaaaaaaaagaaacgaaaaaaaaagttattcctccaaatatttctatggagaaaaataaagtgggtaagggtgacattttttcttaaagaaaaataaagaatggtcaaggagctgggaaattataagaaagaggagctactgtttttttgtattaaaatatgaacattcatattctccaaaaatatttacatgatctctctcttcttatagaagaaaaatggagaaggatagaaccaggtgcaagaaagagttctcttcaaaaagccatgggagaatcccattcacaaccaaagaattcgtggccatattattttttatttcagcctgttctttgaaaatgaaaaggcggaatgtagtggaaagcataagcaaaaagctaaaacactttgtggaatttctttgtaacttccttcgtgtgtaaaaacttaagactttaccatgaggacataatccaggcatctgattgtaggcttctcgttacttggggagttaagggattaattttcatacttaagctcatatgatgacaaaactttttcacaactgtctctaaaccaagaagggggatttaagatctctcaacaaatgaccatttcattacattgttccttattccacttagggtggttcaccatcatctctgagtcaacacatctgtgatcagactaaatgagtcttgccttctgttttagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactgtaagtgatgcacctaaaactgctaagcacgtcagtaactgttgctttcaaatatattgtacttcaatcaacaaatatttgtgaacaactactgcatgcaaagaggatgtactagccgtgggagataaaaacaaatataacacatgacttctatcttaggattgattgtaggacagttgatcgtatagagtaccaaggaagtatgttgaaagttttcattttattcagtttcctataaagctctttctacattgaaaattgaagacctggaattatcactgcaatcatttaaagcagcataactgtcataagattttcaagtacatctgccctttgcccttacttgtcaaggatcccctaagagccacttgctctcatgccctgggcttcagtggcatgtctggagctttcctaatactgatgagatatatacccagatttatatgtagaattatatgcacacacaccttctgatgccatagtaactgctgcaaataggttattggaagaagaaaaaaacactgcattctgtattgctaatactgtgaataatattaggggttattctcattgcctttccagcatctaaaggaataatttgatccaaaaatagaaaaggttcagaatgagaaatagccaactcattactcacctgccgtctaaattcttctacccaaataaaagcacacaaaacacatatcacaagtgaattaagatagtattagccttgactgctctgtatttggcttattactctgtagtaagaactcctgtagaacagagataataatatcctcttcacagggttgtatgaaccaatttaggtaagtcccttagaacagtgcctgacacatagcatatgctcaaatgttagctgttattaatatttgattaacaaaattcctgaccaattttatttatattactagtttaattcacttgcttccaaaggcaagatgcccacagaatagtttctggttttatttatccacattgtatctatctggagggctttgtttctcagtgtgatacagtctgtcctcttctttgggaaatctatttgggctgataaacttatctatcatgagaaactcttttggttccatttggagtgaatttcacaaaagtgctttctccagaagaaacattatgaaaatttttgaaaaggatcctaacaatcacatttgcaggttattgaaaactaatcaatcttctatgattaacagatcctgatacagctccagtgatccatggggtggacgttataaacagtacattagttaaagttacctggtcaacagttccaaaggacagagtacatggacgtctgaaaggctatcaggtttttatcatcatggtttttcctcttcttgttgaattggtatctttcctgagaataaagaagaattgatttcagaagaagtcaaagagaatctgcgaccacaatggatatactaaaagattttggttttcattgcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggaggtgagaggataatgatgtagagtcatgtcaaaaatggaggtgatccatggccatattaaacattcttccttatggccaggcacagtggctcatgcctgtaaatcccagcactttgggaggccaaggcagatggatcacttgaagtcaggagttccaaaccagcttggccaacatgatgaaatcctgtctctatcaaaaatacaaaaattagccagatgtagtagtgcatgcctgtagtcccagctactcgggaggctgaggcaggagaatcacttgaacccgggaggcggaggttgcaatgagccaagattgggctactgcattccatctagcctgggccacgtgagactctgtctcaaaaaaataaataaataaacattattccttattagtagttaattaatatttacttcagatgagtttgcttgtcaatttctataaaatttataatataataaggcttttttgaatttttctaattgatgtgagtttatttttggtcttgtgttttctagtacctgaacagccaacttttctaaaggtcatcaaagttgataaagacactgccactttatcttggggactacctaagaaattaaatggaaacttaactggctatcttttgcaatatcagataagtaagtagaaatttgaattggagttaacttgttaatgtttcattttttggttgaatattctctgtgctatgttgggagtctaatgatcacttaaggccatggtttgtaagctgccgttcttccttgtagcccaggggtctgtaaactggcttgcaggccaaattcagcctgctgcctgtttttaggaataaagttttatgacgacatggccatgtccacttatttatatatgtctacagctactttctccctggagtggcaaagttgagtcatctcaatggagactacacagcctacaaaggctaaatgtttaccgtctggccctttaatgaaaggtttgcttacctgttttagaaaaaaagcagtgtgctgatgggtacacaaaacacgtgtttaatgtttatatataagatgtttggagaagtaggaaacatgtgaaagagttattgagtgatgtgatggagattcaaagcataggtaccttccacgctacctcttctgcctcagatatatgctcccagactcaatcctaaatatgcttgtgtttatccaatgtctatgggttgctcactgtttcatggagatgatattgcaaggactaaataattgtctttggatcatgactcagaatgggctctgcccagatgctgctgtgcgactagagtaacgtgaatgtgtttagatgagatcaggtcgtttttaatagcagcgcgttccctctgaaacagtcgtcaagtttaagcatcatctcaaaatggaaattcggggattgacattatagaaaattttatcaacaacccatcatgaaaattttaggctttcaagacatcaattcccaaaacaccagaaatacagagacccagcacacactgcttactagtcaacttgatcatagtcctgttgtgctactttcacatcagctcaagacttccagcaatccaggtcacgtatttgctttagtttctgatggtttctgctgaaattagcacgtatgtttaaatacatacaggcataatcccaacggaagtagactttagcacttttacgtgcttgctaagtagcaggatcaatactaagtgtatctctttgcattgtgccattaaaataagaaatctattagaaatgtactatcactattttatgaatgagggaattgatgtacatcagagtcaagtagtaaaataagtgttaagtgggaggccgaggctggtggatcacgaggtcaggagatcgagaccatcctggctaacacggtgaaaccccgtctctattaaaaatacaaaaaattatccaggcgtggtggtgggcccctgtagtcccagctactcgggcggctgaggcaggagaatggcgtgaacccgggaggcagagcttgcggtgagctgagatggagccactgcactccagcctgggcgacagagccagactccgtctcaaaaaaaaaaaaaaagtgttaagaatgcaaagcaagatcagtccaattctagatgttgagctcttaaccttatattagtcgatgaactggttttcaaaaaaattgtaagaactgcagaaatattttaagattcttttaaatgtcaatttgtttggtaaagatataacttctccttatcctaacaataggaaactcaactaattaaattcccaccttcatattgatccgtatgtgacatttacgtttatttaaaaacaagttcttagaatatagaagttgaaatattaacaattgtaatgattattgaactgcttgatatgtgtattttaaaataaaataatatataattattttgctttctattaatattaattgatcaagacattttaggtagtttacctttttcttattgcttttagatattttaaattgttgcaatttatatgtatgagagctctatgtatactctcctgaattcttatattgattgtagtcgtttttcaattgactttgtggtcattcacaattatgtgttcaaaaaatctaaaaaagtgatgatttcacctccttctttccaatgtttgaatgcctagtttgtttgttttttcttttcattgatttgaattgcatttttatggaccaaggaaggcatttttatgtcaataataaatgcatttttttaacctctatggtatcttggactgggagtcaagaggatttattctacattccttcttgccactaacagctgcactatcttgggtgtatttcatctcttggactattgttacagtaatcttataatactccatactcttacacaaatctcatgtctttgctgggttccaaattctttgaaagaagctgtctatctgattcagctttttacagtgagcactttacatagtacttagtacacagtagatattcttaaatatttaatatattccttcatttattgattctatgtatactgagtagctatttggtgccacatgttaaactagaaaccatagaagacacaaataaattatcatctcaattattcttccaaaaggaaattataatacttaagtcaaagatacaatgaaaatatagcaatggggaaaattcattattattaatgcgtattatgaagctggagcagctggctccaatatagcacagggattaaagacgtttctctggggtcaaaaggccatggtttggattcaaatcccagtctgcaaatttagagacccaagatgggagcaaagggcttattcttgcgagacctcagttttgtcatatatgatatagtcatagtagttgtatgtacctcataggattaaatgagttgatggttatgaatcattaatgtatctttacgtaccacaagcataaggagaaatgaaaataatgaagaatgcaacttgaatggttaaatacatttgagctgttgttcatgtttatttttttagtaaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaagtacatgaggcttctctttttaatagaggctttaaaaagagactgcatctttttaaacagctgcactgaaaggaaagcaccgtgccagtcattgtaaattagaaatgattgtgatcccactctgtctgaccttctgttttccactgacatagaggcagaatttattaatctgtttggaaagttcacactgactcaatttatggatttctgcgcaataccaatcaaattatagcttagtgtatacaaggtcaggaactataattttacttaattaaagtagcaggacataaggtcacaaagctattcaaaaggttagtaaaggtacgtttttcttttagaaatgtttccatacagaaaaatatttggctcttccattggtagacattacagatctaatacatctcactttcatgccttcactctatatacattgattcatatgtcaattttgttttactgtctgatgatggatgccaagcaactgtctgggaaatggcttataaatgtatggtttcacttgtaacacaattatcctaattcaattacacttttctgtttttttctacctttaaccatttcctttcccaaattgcatctccagttatgattttagtgaggttcttgctaagctttctatgatagcaacaggacctttgcagagaaatcaggtcagaggaactgatgtacacacgaagtgaaacagagagagatttatgtagggcttaggctgttcaggcatggaaggatattggagaaagaaaagaaggatgtagaagatggcagaaagggaaatagagttgtttatttatcatgtattaagtgtggtgcaaaagtaattgtggcccttccattaaaagtagtaatggcaaaggccgcacttacttttgcaccaatctaatactatgtgtcagactgtgttctggatgcttttccaagttgtagattagaaaaacggtagaatcaatgaaagaaacatcacagaggggaaaaatagtagagaaaatgcagttgcctattatttattgaagatgtatattaaaatatattcaagcttgtgagtgactgtaaatcaccgtgtttgtgtgtgaatggttatgctctgacctttaatattggtttgtttttacatcttattgtgcctactatatctaactaataacaagcttacgtttttctcagattccttaaacatttaaaagccctttatgtgggaaaattgtataatccaaataattacttccctaaaactcacaaagtattcccagggatgaattgaacaccaagtgaaatgaagaactaatttcactgactttacctactcataaaagttagacttaaagatggggattggaaacttcccagtaactaaaaggttcttatgtctgaagcattggaactgacatcaagtgtccaatacaaagagaagtcagagtggtagtagtccaaacatgcaactgccatatttttaaaaacagaatttaaggcatggagttggttgctattttgatataaccaagaccataatgtgcatgtgaaatgctgatcccattcttaccaattggaagcacatgagaaaaaatattcacagaattgcctgacaagtgttacacattctagtatatatgttgcgaaatttgggcttggttgcattcgtgcttgagaaattgtttttggaggatgaaagtgctgttcatgtgattttacaggtgatgtggcatcttttctttaaactaaaaatgtaactaatgtgctgcatgtcttaaagaacatttcttcactgtcgtatgtgtcaggaatttaaaaatgtttcttactggtgtgtttgtgctctttttcaggaatccacattttcagtattccagctaactgcccccttcccgagttgacactgatttctattctataggcatgtcttgctataagtacagggaaaaaaattacaatctctttttctactagagttcaacatgatctttgaaaaaaatatatatttccaatgaggagagatacatcttgttatcagtcagcactctaaaaatgatcacttgtgcaaataggaacctactgctatgcatctttcttcttgctctgcctatatagctcatttcaaggtcatttggcatttgttcaaaaaataggatttgattgacaagtatttttctctgattgttttcactctgatttccaagtaaatcatattccataatctaagaggggaaaagatggagttaatcagaaatattatttttgtgtcattagcggtttgaataaatcacttgctttactctatttttcaaaagcttgcactacttaatgttatactaatatctctgtttttcaaggtcaaaattaattgcactctgtttcaatgacgcttaatcttgaaggctttgctcatataattggccttatttctctcatggtgtcatttttaataaaacctttttgttatttagtaactatataattaatttttattttatagtgaaaatacataatgaaatattgatctgtaacatatacccacttaaaatagcatttcataaccccttgtagtctcagtaagaaacatattttatatcattgttaacattttctgggttatgtttattatattgagttgattcccagcaaagctgtggatcacatgcaaaaatatttaagatatttggtggtaagacaagaagttaacatatttttgttcaacttgattcattttatcttctactatgagattctactattaacatattgacatattaatattttttgaaaagtattaacttctcacaccactttcaaaatgtcagtaaaaccattccattggtatgtacctgcaagcctgcatttcacgtagtttggacttctataaatttcaaatatttaatatatgaccatattttaatgctatttcatcagtgtttatggagaagaccaaagcaaaaaaaagcaatatatagttagttacgattataaggttatgtgctgtcaattataagtcaaaaggccatattcagtttcgcattaggtttgcgaaaatccaaattgcacaaaattatattgtataatttttttaagtctgtggttttgaaccattcatgtgaccaggcagatttacagtaccatttcatcttaaatggccatgcattgagttcatttcatttactcaatttcattatattaaaaaagaaagttgaaatgttgattttcttgatctcctggtaattcaaaaactatctgagaaaatatggtataagtgactttcttattcacctctaacaacaatatttttttatgtcctgtttttccatgattacaattcacatgatttaactgtgtacatttcttaggtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagaggtgagaaatgagattatatttggggaagtcttagtcaatctatgtcctgtagaatacttagtgttgcctgtgtcctatattaaacataaaaacactgagtgtattaattatgaaaatcgtaatttcaatttgttttgacatatttttaaattatcaaaatgaaaaatgtttcacagtagtccaccatcctttattttgtttttactagagttgttgcctaaaaatatctcctgctaattaacatatcttaataacacaaactaaaaagaaaaagcaaaacaaaacaaaaaccaccggtctccatggtcatctgcttctaaccaaggcagcttgcgcttttgtttgctccttgctgcttctgagtttaacttcatctgccttcattatccttctttggtttttcatcctcggaatcaaacacaactcgaagaagtccctttttaaataaagaaggaaagatttaccagtattctcccattaacatgtccttcaaattgcattccttctggggtcattaaaaaaactgatactatttggtatgtttaaaaatgatgtctaattttccccaatgttacagaatacaaaagactgtttctagtttacaatgctgtgacttctctttctaccacagaatatgctggtttatatgatgacatctccactcaaggctggtttattggactgatgtgtgcgattgctcttctcacactactattattaactgtttgctttgtgaagaggaatagaggtggaaagtactcaggtaaaattgtttcttaatgtgattttcaacttattaaaaagcattttctgggaagcattcttcagagacaactttttttaaaaatacacattcaagtcaaatttatattagcaagttagatgtacaatgcactgacaggaaaaacgtattgctaaattaaccaaagaaaatatgtatgttctagtttctagcacttaaaatgggctctaactgccgggcgcagtggctcacgcctgtaattccagcagtttgggaggccgaggtgggcggatcatgaggtcaggagatcgagaccatcctggccaacatgatgaaaccccgtctctactaaaaatacaaaaattagccgggcatggtggcagctgcctgtaatcccagctactcggaaggctgagacaggagaatcacttgaacccgggaggtggagtttgcagtgagctgagatcatgccactgtacttcagcttgggcgacaagagcaaaaactccatctcaaaaaaataaaaaataaaaaataggctctaacaaggttgataacacttccaagcttctattgtctatctgtaaaatatcagcgtcgttgagagacatatcactaggtcacatatatgctttagtgttttaagaagtgacccatgtatagcacgcctctctctatgcatgacatacatgactcatatttttcgcactagtgcattctaatattactggctccactggtcaattttgttggtgttaatcattactaggaatgcatttcttattaccatggcatgtagtagacacactgcctcttgaattaatgatacataagatatacatgaaaaccatcatagttggtaatatgacgtttgcctttaatttcattcaactcccgaatttgttttgtctttttcagatatacatattgtatcaagatgatgattattactagtattgcttagtattcatgatgcttttataaagggacaaagatttaggttacactgctatttgtttcatgatgttcagatatatgagaagttcattactggcttatgatttatctagcaaatatttattgggaacccgtcatctacatagaaacattgagagcataatttctaggtttttgtaaaatgacatgcataatttatggagttatgcgtttcacttttttctctgaagactgaatgattatgaattaagttcacaatgactaataaatgttctgagtaattaattggaaacgttaaagagttatagcattctccttatccccaacagataatcatttgtgtattgtggtgctatccagattccaaagatgtttcttcaaatcatgccctaaaaagaaaaaaaaaattagcatttcatattgtagagcaactaagagaatctactaggtctctgcatgtagtcgtaaaatgttccaggaagaacaatttgtatttgagggctttttttttttttttaagtaaagggaacaagagctttttggtcttatattccactaataagagaaatcagccaggcatagtggtggctgcctgaaatcctaactactcgggaggctgaggcaggagaatcccttgaacctgggaggcagaggttgcagtgagccgagatcacgcctctgcactccagcctgggcgacagagtgagactgtctcaaaaaaagtaataataaaataaaatgtcagtggagacctgaatattcagattgttgcaacaattttgagtaagagtgatgtataacaaccaaatgactgcctttttttttttttttttttgagacaaggtcttgttctgttgcccaggctggagtgcagtggttctatctcatctctttgcaacttctgcctcccaggctcaggtgatcctccaacctcagctcctcgtgtagctgggactacaggtgtatgctaccatgcctggctaatttctgtgtttttaatagagacagggtcttgctttgttgcccaggctggtttcaaactcctgatataaagtgttctgcccaccttggcctcccaaagtgccgggattacaggcatgagccaccacatccagccttgattgactttttaaattcaatttagtttaatgacacagatctaataggtgtctatgacatcttcaaaaagttcagatagtaaaataaatatttagtaatttggtcttcactgagaaatcaaactcagttgggctcttccaataagacttctcgttcacataaaattgagtagtcacgtgaaaatatgcaacatgctgcaggtgtgacgacaagtagaaccccccaaaatcccctctcttttttgtttaaacaaagaagcaactgatgggctgtaggtatagccagaaaaaaatattgcctcactggtatcaaaacatttgagcaatgctgttcttactgactattaactattccacagcactggtaaaatgtcttttaaatggtcactgtattacttttcccactttttttctcttttttagttaaagaaaaggaagatttgcatccagacccagaaattcagtcagtaaaagatgaaacctttggtgaatacaggtaaacataaggttctgttgtaaaataaaacacatattcatcatgttgaaagcttaagtgaacaaaaaggtgtttattcttaataaaaaggttacataactacaatgtaatgaccctataaagaatactttgtacaaatagggcccacttaagtgctagcaaccaaatttctgtgtgtgtgatgagggtgtataaataattaccgtctaggcagaaatgtcaggtaggacacttttcttgaagctctgtgcctaacacaaagaatatctatttggggtagctaaaacatctatagcatggccattatgaactcgggttcaatccaatttgcatccacacacgcatatctgtatacctacagcgttgcacctgcaaaggtaagtaagttacaaaccctgtcctctagatgaacctgatcagcagagaaaaatatcctatatatgcaaatgactgtaatgaattaaatagaataaaagagcacaaaagagagtaactgtttctgcccaggtaggattttggaaaaagaatcatccataagagataagctaagccttaaaggataaaaagtattgtgttactgttaaccactggacagaggatgaccaaatgagtgagggtgtgtcgggcaagggaggaatggcaagaagtctactctgagctaggtaggaatctttcggggacgtgttaaactgtctcattctccttttatctttctccaccttcccctttctgctactctctcaacttcttagttcttttttgttgtaatgtcatcatttttctcaggtctcctgtatatttcagccaacagacatattgtaagttccaggtttgtattgattttagcacatgggaaaccagagtttatattaaagaagaaatctgattgatcctgattctctcatctctggattcattactctagcaagggatatggagtattttcattagctaattggtagacatttgggcttacctgtacctccattttgtggtatacttatttttctgtattctacttagtcaataccctttttatatttttatatttcttaataaatgactttaaattctttccagaataaagaacaataaagagaaagaaagaaagagagaaaaagaaaaaggaagaaagaattttggaacttcacgaattgtgatcattactattgtattagttagcagttgcctcataacaataaccaccaatactcaacagcttaaaacaataaacatttattatttcaatgtcctcataattcaggaatccagacatggcttagatgggtacttctggctcaggacctctcatgaggttgcagcaaggttttgaccagggctatggtttcatctaaagtttcagccaaagcacaaatcattcctaggccattcgtgtggctgttggcaggatatagttccatacaggctgttgaactaagggcttctgttcttcacaggccagaggtcattcctaactccataccacgtagatatctccatggggccattcacaacatggcagctggcttccttcagaatgtgtgagccagggagcaagagagagcacccaagttggaagccacagtccttttgtaacctaatattggaagtgatatcccatcacttttgttgtattctataggaacaaatcattaagtttagctcacaactcaaaggaagaggattatacaagatacaaattccatgaggcaatgatcattaaggacctgcaacaacttttcaaaagctgaggcaggagaatttcttgaactcaggaggcggaggttgcagtaagctgagattgtgccactgcactccagcctgggcaacatagcgagactccatctcaacaacaaaacaaaaacacaaacaaacaaacaagcaaaaaaaaattttgaaagacaatattagctcaattttacaggcaagaaaacaaaaacaatgccttgtctaaaaacccatttccccacaccctgctgctcctttataaagatagctaacatcttcctgtgcattatttcctatgacatccctttatagtagctgatgtgttttccaacctctttcccccaaactacatatttatcaggataattgtctactttccacattatcccaggagacacttttataagatgctgtgcccttgcataagtcctcattcttctagcttctgataatcatcccttttgttatttttctttattctttgttcctgattcctcagccgatgcctcattgtttttcttgatttgttcttgtaactgcaatatcctaattcaagagccaattatcgtatcagtcaggggagcctgtgttatgctgctgtcaaaacaactccaaaagcattttctttctcaagttatgtgtcccacagagattgcccttttcatcttaatcacttaggagcactggctggtggacgagcatccaggctccccacagcagggaaaatagaatgtaataaactgagcactggctttaaatctttggctcggaagagacacatgtcacctttgctcactttttttttaaaccaaagaaaattccatggtggcatataacacagagtaggcaaagaagtgccatcctgctttattcctagaaacctgacatacttgatgaacagctctgacaaataccacaaattataaagtgatatgtacatccaaattatattttttccaaatgcttcattgatcaaatttgataaaatcattttatatggtgtatagcttcataatgtaatactaattggtacttaaaaaaatcttgatccaaaatttagaagatcataccatttgataagcatttcactaatggatttgcttctgttcatgaataaaacacctaccataaatatagtatacttatttatgttcttaaaataccagccatttctttctgtcttaaaatgtaacaaacttgaattgttaactatattaaagaaagttatttggtttcaaaaacagaatgtgattgatttttaaaaaagaacattttatcaggatataagagaatcaaaaggatcagaagtaaaggcagaagatcaagacttggaggccaggagctccaaaagttcatgacagcaagggaaattgcatttgttctctgtctgagtccattagggctactataacaaaataccataagctgggtggcttataaaagaacagaaacttaattcccacagttcaggattctgagaagcctaagagcaaagtgccagcattttcaatgtctggtgaacgctcactttctgggtgacagatggcaccttctctttgtgtcctcacatcgtgaaaggggtagggcagctctctggggcctcttctctaagggcactaatatcattcactagggttccacccttatggcctaatcacttcccaaagactccacctctaacaccctcacattggttatcaggttttaacataggaagcttgggaggacacagatattcagaccatagcagccactgtggacatcaacaggttgaatcccacatgtcctacagaagctaagctgctcaattttaaagagaagcacaaatgttgtgaataatgaaaaattgtttggtggaaattgcttatgactttgtagacatgtgtttacagacttcgtaaacttggtaaacatttgtggtagtatcatgtgggctttactatctgtcttcaatgctaacacaaatgtcctgaaaattataaaatcttttatcacttatgactgtgttgctttacatgaatattaatattagattttgttgagctatttttgtttgtttgttttctagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaa

SEQ ID NO: 2081 - DNA, 50958 bp, Homo sapiens
cgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccggcggcggagggcaggtgtgcgtcggcagggctgggtggcccggcagagagggcgccccaggttcagcccctcctcgaagggcgccggcgtccagtcccgctcgtgggagccgcggagcagccccagggccggcgagcggctgccctgccaggcgcgtgcgcgagggcgcgctcccgcgggaacgcgccgtgcgcggggagatttgcgcgtgcgcgtggcgatggtaactggtgggccccccgggctcgctctaggcggaggctcccgggacgcccacgtggcttcgaattccagctccaccatcactgtgatgcgtcactctggactaggcatttaactacgtgcctcagtttccctttctcaataatacggagattatcgataccctctatactgggttgttgcaagactggaatgagatgatacaagtaatttaacaccatagatttttaaatttaacaccatatgcatatttgatgcataataagcactcaaaagttattgtcgttgatgccattactgttagttaatcctcagtttaattacatatggtgcattttcatttctctgcattttcattgaagtaaaaattctgcgttttctaattttggagaataatcttaattaaaatatgaatatttgtactgcacagtccaactcctacgaagctctgccttgcagcagattggaagagagaaactgatcaactgccgatgaagttggcttttcagtatattgatggagagagaagcttaggaagctctttggggaaacttttggtgacaagaaaataaaaagtttatcccagagtttttcttttgtaaatctttgtgttttctctttcacctgcagatgttgcagttgggtttgtcttaatttcagtctctttgtgagggaccaccatttggctttcataatttaacgtggttacagagcctatgtataccctggctttccattttatggccttaagtgctgcagtggatttacctttagtaatggcagaacgtagtgtataatcattccttgcaagctcctgaatattgtgagcaaatcaatggagacaaatagttattactggatgggtgtgagtactggctatggcaactcattaaaatctctttcagggtatgtttgtacccacttcactgcagcacaagactatgatgatgaatatatgtttcccagattgttatctgttgcatgtagacttacggatccttttcttcaaagaaacggctatagatatttattgattcctcatggttatataggtcctccaacctatctgctgataagtacactgtacacttcgtgggcctagctgtaggtctaagaggagttgattttgcacatactatacttattgcatttaagttaattcatctcattacatgaattggttttaaataaatttttaaaatcatttgattattaaaatataggcatttcttggtgaacttgaggcaagtaaagcctgacagatgtcaccatcacaaagatccttagtgacctttacaaaatagagctcacccagaaaaacatttgctagatagaaacctgattttatagttgcttctgaaatctttgaagataggaggttatttgccccaaaattgctttgttgaaataatttagcctgattcgcttttatagaaaaataagggtaacgatcaagactgatttaagattcttgtatttttaaccgataaaagaaaattaagtaatagttggggaactactggtgtcagatttgaaggaatgattgtcaggaaatactgagagtattacttcaggtagcagtgtttggctttgcaagacaaccctctcatcctcactgtgaatatgtcatctttaaaaggtaccttgaggaattagtgtgacagcttctctgaaattcatgtgatcatttacatattgtttcccaggagctttggcattaaatgtttcatttattggaaattattttgccctttaatttatgacagccaacagtgcaatagagtctaatgtattttagaaacaataaaattagcttttcaccattttctattttccctaaaaatctagcagcaatgcacttggaatgcttaagttagtccagagacaaatggtaagagtaggaaaacatgacagattgggaggtgttgagttctgaatttggggacctaattgaaatgcaaaggtataatcaagagaatgaacttgtctctgtactgaggttgttttcagtgatgtactatattatctgattcagtcaacgttccttgttattttttcaaaccaagattgagaatactatattttcaattatgaacattttgattacagtttcattctgactaattcagtcggaagagaatgcaattattatggtcatttacatacaatatgctaagttaacacagctaatgagtgaaagcataatattctttctgtttgttcctggaaaaatattgtgctaagcattctttcaaagaaagattacattattcgctatcattttatgtctatctacaagtagaattggcattgagccttttctctgctattaaagtgaaatctcttatattttggtgatcacatgcctttcctctcaccccttgggggagactggaaacaattctcaatttaattagatatgctgctttcttttttctgtacatctttatctgaggaaagattgtattttctaatttgggaggctgcttaacaccttaaacattactaattactgcagtttattttatgtgtgtcgcaatagtgtagttagttaattatagctttctcattagcaccacgtagagaataatgaattaacacatccctttgatcaaaaaggatttaagtttatcttctgagaataaaagtgttattgtgttactgaaagtcactataattttcccaagaaacaaattggttggaattctgtatcactgggttaggaagctcaatgaatgagttggattgatcacaaagtagagtagagctgtggttgcttggcaacctgacattattctgccatttctggtatatttatccagtaaactagaaaattctgtttcgttaacgaatgttttaagtcagtgcacaaatagaccataactaattgagattttatgtgttgtgggtaaaaaatgatcctgcttaccttctcattgtgtttagatcataaaaatacaaagggacatattccgttttcaattttaaggcattttcctgaaatgttgacttcactttcacataatttattcctagtgaagaatacaacttgtgtatctctttggaagttaaattattagaagtgtgtgtgagtgtatatgtgtatgtgtgtgtgcgtgtgtgtgatgcttatatacataatttcaataagaatcacaactagagtttgaggtgagatgaattctcaaaattcatagtttgctaattgaactgacagtttggtacatttagggtgggtataaatatctgaatcaaatgatgctggcagatgatgataagaatgataaatgcattgaacttggtcaatatataattatattttatgctttgaccagggtttcttctcctggtagtcttataacattctcccttctaatgtttgtttgcatcttatttcccctatagttgtggaggtaggagctctgttgcccatcttctgattcacctcttcctaactccagggactacaattgtgccattttcctatacaacctatgaattttagtgtgcatcacaatttccttttcagactgtaaactccttgagggtatacatttccttttatgcatctcataaactcttaaagtgtctggcacagcaggaagcgaactgttgtggtggttacatgcactggctataaaagtcaggctgccagggttcaaaatctaagtctgtcagcttgcaggtgtgtggcattggcttagtcatgttgacctctctaagactagtttcttctttagaaacggggaaatagccatacttagctcacatgtcacatgtgttcttgtggacattgtatggggcaatctatgcagacagattagtagcacggttttttattgtagtgataattatccttctatatcatgttcagtatgtgaatgaacaaagatagagggacagagcgtatgtgtgtgtgtatccctgtgtatgtgaataactgtgagccatgatcaatggtggtgtcaaatggcaaactgttgattcctacattaattatatgcacatataccaataatgattgcttcacatatttaaaaggttttcgcaatagttgttcttaggcttggctgaaattagaatcgtctggagagttctgtaaagctaccaacccaaatcaattcaattacagtctctgtggatggtgactagaaatctggatttttgaaaacttctagtgcgattctaacacgccctaatgtaccaatattggttaagaaccatcaccttagatttgcgtacgccgtccacaagattgtgttgggctaaggcattggttcacagtcaccctggtgtcatgaaatgtggctgaaagagaaaaaatgctctggcaaacttctgaggtttttcttactaatcttcttggtttaaatagcactttattctctgaagatctcaaatgtgcttttcatttactgtgtataatttcgtttttcaaccaaatgtctctgtgaagatggtaggaaagaagtaattatcctgatttgcagatgaatgtgaatggagtgagctacactgaaattaagtgatttgactagattcatacatttagaacaggcccagataacaagattcctgtgactttggggttttgaatatttctctgttttgcctgcagacttccaatgaggtagggagagttattgtttttggactaaagtactgtgtcagaaaaagctttaaaaatgagactttcatcctttttttggttataattgtgcagtgtaaagaaaaacagatttttattttctttctaagaagaggcaccatagtctatataggagccaaaccaatgtcccttggactttgaacaccgcttgtataaatatttcatttggcccaaagaatgtttaagacaaatttcagccaacatttaaatactggagatttcatgtaaaattcatatttctggcttatcttaaaaggattgatgttctcacagtattggacctgaatgcccaggtggcagaatgccacaggttagaacccagtggtttgtccccttgatgttcttgaaagacatatcttcgctgggtaaaacatggcttcctctcaccttcactttgttcctttcttttatatagatcctactccaaagaggtaattaagggaccttaaagacgggcccacatctctttggatgggattaggggaagcccacaagggctgctgaagcacatctggagctgttactgccccttgtcctgaagggataatgggaaggtgaagttcctggaaggaggtgggagcagtagctctggaagagggctgtcacgtgggacctatggcttttggtagaggaacataactactgtcaaatcacaagacagtgctctgcttctaccccaagatttccagttgcttcttcagcaaggcagtaagacggcaagggagcctattgtagtggtttgtggaggtcagttctcccagagcagagcaggatggaggaaggcagaaaagggatctgaatctgggaagtacgtgaggaatacctagcacatcttgaaggctttacatttgtggaacgtgagtagtggggaaggggaaagctagaattgacaaaaacagtacaaaatagggaatcattaagtttgtattcaggagaatcttcaccactttttctttgtcattcctttcttctttctttcattgcccgaagtgggcatgctcatattcagtggtgtgtttcagttgggactcttaaacttcaaaacaaatttgtccatttcattgcattatctatgctttctaagatgagagctgacatagcagagagaataatgtaaaagatgtattccagcttctatggtaatggttggcatttttagcagaggttcctccctaacaaaagcttttgctgtaagtggtgattctcctgggagggattgtagttatgatgcctgggaaagcggagatacactcaaatgtcagtctggcagctgaaactcatgtaacctggatgcctggatctttggaggaagtatccttcttctttgttatagttgtatcagaacaaggacgatgaaggaatagaccagaatgcactggttgcatcttaatgtgaggaatttttatttccagggactaagagatgtatttcccagagtaatagaatgtaagtggataaaaggaatgtggggattttgatgatctgttgcggttagagttgttggaagttcggttttttattgcattgaaaaccttgctaaaaactgtaaagtgacagaatattagcttattatgggatgccttacatattggttatgttcaaaagaaataacacgtctcatgtgcaaaaggttcagggggaagataaatactgaccttttccaagactgatactggatgctgcatttccatcctttcagaagattgcctctgaagatttctattttaaaaaaaaatcataatgtcttgcattatttgtgtgctttatgctttttagaaaatttttccatgtcatctcatctgacttttacaataacatagtgaacaaaaagaaacaggttgttagcccattttatagatgaaaaaaactaatgcaaggtcaagtagttagctttaccactattccaccacactgcctacagtagtgaaaattagaattaaatcatcttagatatcctaatttgtaacccagttcatagcccactctattgctttcaggttttctttttcctttttctttctttctttctttttttttttttttggagatagggtctggctctgttgcccaggctggagcgctggagtacagtggtatggtcatcgctcactgcaacctcgaactcctgggctcaagttattctctcacctcagcctcccaaagtgctgggactacagacgggcaccatcatgtctggctaatttttaaaatcttttttgtaaaggtgaggtttcactatgttgtccaggctggtttcaaactcctggccttaggtgattctcccacctgcccctctcaaagtactgggattacaggcatgagccaccttacacagcccagatttccttttttggaagaaaagagcaacattgtataactgatagtgaattgttttttaaggaaatctagagtcaccgtataaactgagagctgtctaggggaaaaattgaaaatgttaccagttatattttgagagttgaacgtagtcctggccaaagatagggagatagacttttccaaagcatcctgaattctataatacatgttcttatgtttgtgtgtgtctgtgtgtgtgtgtgtgtgcgcgcgcacgtgtatgtgtgggtcctatgaggcattgtgaccagtcattataaaaagcttttattgatcgccactttgtgctagagacaggaatgaaactgtgccaggcagatacttaaatagccaccattgatcatttatcaagtgtttattatgtgttttgcaatctccacatcagtgatttgaggaaagtactattataacacccaatgtaagctgggcgatgcagacacagaagggtccttgtccaatgtcacacaatatgtcttgcagtaccagagtcagaattcaaactcagaagtgtctgatttccagccccagcagtgccccctcgattagcaggattctccagctatggtcttcactatggactaacactctttcctgttgtccatccaaacttacctgttctgtgtcccattatccatttgtggaaaagtagacataaaggaatcctactgaggtattagatgataatgcatacctattccaggaatggtggcattaaatatgaggttttaaaacctgccagaggtggtggtgcaagcctgtaatcccagcactttgggaggctgagacgggtggatcacttgaggtcaggagtttgaggccagcctggccaacatggtgaaacttcgtctctactaaaaatacaaaaattagctgggcatgatggcatgcctgtaatcccagctactcaggaggctgaggcaggagaatcacttgaacccaggaggcggaggttgcagtgagcctagatcgcaccactgcactccagcctgggtgacagagcgagactgtcttaaaaaaaaatcttaatgcaactttgggaggctgaggctggaggatcacttgaggccaggagttcaagaccagcaacacagcaagactccatgtctacaaaaaatatataaataaataaaaataaaaattagccaggtgtggtcgggcatgcctatagccccagctacttgggaggctgaggtgggaggatcatttgagcccaggagttggaggttacagggaggagacatttgtgttctctccaaaatcaagtcatataagcgtctaatggtctgactcttcctgtaccagaccctgggcatcattatatgtacaaatgaaacttcactctcattatcattgtttatttcttggcagaaatgtttctgatactctatgatatgaatacgcatggatttccctcacttctgggtattatatgtaaccaattgcatttcgcggttggcatttccacaaaggtgtgagtatctgctattccagattaaaatagaaatcgttggcaatggcagatgccatatctcagcattgctgttcttgaaaacggcttgaaaatgacaccgatcataatgatggcactgtctttattagcagccgtcaataaagataaggctttagaagaaaaaaaggcaactctatttcaggcacagccaatatatttgggagttttaagagatttttgagttttttgtttgggatatttacaagcaaatgttcatgtatttttaagatatgcataatataaatagcattctcagatgctgagtggctccaaaaggctcctttttgtgtactagaaagtggcaagaataagtttgtttcctgctttggctagacaggagatcccacttccttggattatacacaatggcttttctataaagcttttgtttgacccatacctgcttctctggaatacacagcttggcttctcaagaagtaagtttatttctgtgttgtaaattcaaggatttttctaacttgttctgtaaaatgcatctgatgacatagtggagaattcatgcatttgattaaaatttaaagatgtaaagaatgcttaaggcatcatacaatggcaaaaaactgaaaacactgcccacaagggtaaacatataggcaataacaattttaacatctatcacctatatctgcatgaataataggctatattgcgttatttgttattgttcactaatttgagacatatactattttccataaagaagatctgagtgaatggataaagatagccaaaacaagcctgtttaaatttgaccttgaccccattttcttcgtgacctctagcaattctcagaggagcaaacttcaaagggtttcaacagtctgctcttcccatgcatacaagtttctgcttgtaattgatttgggctgaatagattttgaacacaattgatttgcttgaaataacattaaaggaccaagcactgagcaattcaggtgcaactcatgcacacttctgagtcaagttcaaataaattggatttgaccttaaccactgtcccctcaaaaaaagggctggcagtcatcagaatgaatgccatccaatcaagtataaaaactggtatgagtggtttggatcagaaattgatctccatacacaagaccttcttttgaaaacttgtaatgagcttctgttttcctgttttaccagctgtaaactgaggaaagaaacattgactgctgcctcccagtggcagttggaggattaatgagctaatatttataaagtgctttgaagataaaggtgccagctattattattactaataaaccattttttctgcagtgtaattttggacagcaggccttaaaaacccattactgtatttaacagtaaaacaatctgccacagcctagtatttactgcctcaattaagcatgcattccacttcctttgcccctccaaattcagaactggtgaggagagacagaaaggagtgtgtcatcatttcccaagttcattgaaatattaggtttgggttgtttgattgtctcggcagaaagctagactatatcctcagtgggagactagttgagctacacttttgtttctgtgccttatgaagggagtggaaggcttggttctaggcctttattcaaccagatttacattgtggtttattatctttgaagattgcattccagtatccgttttggttatttgaatatggtaccattaatgaaactggtttatttgggtggttttatgtgtgtacctgcgtgagggtggggttcacaactaactcctaaaaccgaagtggaaaatggaggtaattctgcagctatcccatgtccaaaagtattaaaaaataaaactggagaccttgaattatacaggatagtttcttagttagtaattactgttatcattatatgatattaaatcctttcaatctgatttattttgatctatatagatgtcctaaaatatcagatggtacagggtagtgtaaatatttctcacgtattgccaaaacaatgcttattttcctctgatgctatttcagtactgcaaataaaagtaaaaaaatataaagttaataaatgactataatgagatgtctcagctttcaacagctacttcaggtattcaaatgctaggccaatatctaaaagttgaacaaaagaagcctcaaagcaacctagatctctttcttggcaaaaattcactaaaatgtaaacacttgattatggaaagatcttcctaattcagtgactatttgctcttaatttagaaccattctaatatgcataattatattatttcagcagatgacaaagtataaactgcaagttggagcagatgagggaaattttgcaaattcattctaagacaaaataagttacatttaatatatttcttccgcaagagagagggatagaaagactagaaaaagacaactcagaaatgactatatgggtgatcttgagtcattaagaaattattttaaaataaaaaataaattgacataccacctataggagttcagatcatttatctgaaaatcttatggaaccaatccttcctagtggtctagttgttcaataatgttaaatacaaattcttaacagaaccctaatcttttttttgtcattattatacttcaagttttagggtacatgtgcacaacgtgcaggtttgttacatatgtatacatgtgccatgttggtgtgctgcacccattaactcgtcgtttacattaagtacatctcctaatgttagctcccctccgctgccaccccacgacaggccccgtgtgtgatgttccccaccctgtgtccaagtgttctcattgaacagaacccaaatcttttaaacggtttcttttacaagcaatgcactaataatgatccaaggtaggtgccgttgtttacagataggattttgtattgcccattccaagtttgccacagagtatactttttattactatcacttagggagactgtttggtaaataccatcaccattccattgacttttgaagttgagctcatgctattttcatcatttgttttgtttaattgtgtatggggaattcaccatatggcttaaaactgtttaagacctcaatagatatgtgttttgcatatgagattcttggggtatctgtagggatatacacaagctgtttgttattaggaagaaaagtacctgaaagcttgtgtgtagctaaggggagaaatgatgaaaaatattctgaatgtagcaaagtaacaatttgtgtaaaatgtgaaggcacatttttccacttacctatcactgaatgacaaactaactcatacctttaaacagtaacttcaaacaacagacattttatgaaatctcatgaattgtaggtgaggaatttaggcagggctccgctgggtgatttcttctgccccatttggtgacaactgaggtaatatggtggtatctcagagagtggctggggtgggctggtggccccaggatggcttccctcacatgacccatgcaatggcaaggagggctgagctcagctgggcccctctttctgtccaagtagtcacagggcctctctcctggtccttccagaaatgtcactggacttttcacacagtgactcagggctttaaaaatctaacttggaaacttaaaggctagtcctcagaccgttcagattcaaaggaaactctcatccaacttctagcagacaaggtagcaagaaatacaaattaagaaagacatgctaattaacagaattattaaacccattgtgatacaccattcactcaccatgtgactgcttacaaagagggaaaaaatatggagccctctgttccaagggaacactcctttccccctcccgacacttcctagagatcttagacccacatgactgtgagaaagaagagtgatgtgagagtgaactttggcaaggctgaagtgccctggttttgtctggagcgagaataaaagtgagaggaaggaggcgtccagttggctgagaatactgttggctaagattctttagcagggtgggcttttcggatgcttttctcctctgatctatttaggtttatccttactcttttccatttatctgggaagtgacttgggtttaagagaaccaggagtatcttagcagagtcaaaagggccacggtgaaccccaaatgtcaggaaacaaggaactgactagattactcaaggcttcactcttgaggagggagagaaaagagctcctgcatttccttctatttattgattacagccacaaatggaaaaggaagcaggctttctgccctgaaataatgatgatacatcgggctgcagagctcctatacctataactctcaaaagcaaatggaaaggagactagcgtgtggctagtaccattattctcacatcttcctgcagtgttatgagagcacagagtaggatgcagggtgaggatagacagcagtagagctttcttgagctgcttattcctctccaaattctctctgaaagtggatgaagaactgctgccatgtctggtgtgggttcaatttgtgctctcattgcttctacttctctgtttctccagatcctaccatcacgttcttccttctgtggcttagccatttttctctccacgcttaggaaccatacatactatcattcttctacctctgaagcattatcccatccttctgacaaacatgagtagatgttttcccctcacagtcttgccaaaaagcacttataaagtattgcaccgtagttttcatatttcaaaaacacttcaacaggcaaaatgcgatatacacaaccccaaaatgctgtgctatgatgaatttagttctgtattggtaatactataaattgcttttgaatgaaagatacaatgtctatatattatttaatttgatacttgcagtaactagctatttaagcaagataggtatcagtcctctttagcgaagttcagtggaaccaatggaacaaacgtgtgggagtggaactggaactcggatgtctgattttgtcttaagttattttaatgacaagtcatttagccaccgataaaaagttacttattcagaaaattcaatcttctggacaagttttatttttacatgacataacctaaaatgttatatatgttaaattctgccgttttagatttcaggaaaacaaatgcagagtggtagaggctggtggtgagaatgagctgagaagggtggtaataaactgaggtttctacaacgagtttgcattaaaaaaaacttgttgggggttctggaacccaatcaattctcagatgtttccatagtctatttttatatagcataatacatttttattatgatcaggcaataaagcaagactgttcaccagtcttgctttagccatttaccatttcctatactctatgtatgtcctttgtctgcttttacactaccataaagcctgcttcaactttcccctcaatacactgagatttatttcttcactcaccattctggaaaattccttgttcagccttctaatcactagacacctgcaacctttccttcactggatttctgcctcgaacagtcactcttctccactaagatctacatgtcaccgctaaaatcccctttcttgcttgtcactttgaccatgatgtcacttacttcctgaaaatttcccctggctccctactgctttgcaggccaagtaactgtcacatttcgtttccactttcagctggagtcagccttcattattcccctctccgtccctgtatccttagagaccctctcctttgactcaacagctcactgctcttgtcttctcaaagctcctgtcttttcacacacagttcctgctgtcttttcttcttaaaacaaccagccattcgacagtctccaattctctgagaagacattcccctaaactcaccatcttcaatacttgtgtcatatctttgtgccaaattctaattcacttaagattttaactggcttactaacaaaatatactaacttaaaatgaaggttttatttattaccttaaatgaaacaccagtgtcaacggcaaacaatgaaaagtaagagcaaacgttactatgatgaaagcaacttgaagtcattgcattttaggtagatatttgtgcctgccccagactctgggcttgaaccctgctctgtcttataaaatagggagattagaaaagttaaattgttattaatgttctattaacacctacttgagactttcaactttttatagtaagaagaattgaaaaataattcacagagaattgattcccatgatgcgttcacctatgtcctgctcagaacacatctaggatcatttcagcgctgatagactgttcaaggagatgcagcctaactcaagaaaaattcatcatgctcctcctctttccttctccagttttgttcccacatatgaacattaaatgaaaatttatgaagttcctgctgagtgaaaatcactgctggataggtgaattccaagatgaaatagatagactttctggcctgaagttgcttactgttaccactgaatatatgcccataaaatattaaaatagacctaaatgccttttctgaggtctggaactctcaaagtgttgtgagcctccaatctaattaaagaactcactcaagtataatgcaaaatagaggatgaaaaatgccatacgaatgtatagataatgttttatgggagattagaatagagaaagattatttccagcttgtgcactgttaaaagtcattaggaaagaggtagaatttggaaagcaaagaagagattgcattgcaaagaagacattcaattgcaatgattatttctctgaagcaaaataagtgttcaagcccaatttaatgagcaattaatttttagcaatattttccacatgttcataatctagtaccatttgaaaaaactttctgatgtgaaaaaaatgtgatttaaatacctgtctcaagttctgaaaggcttcctcacatattataaaacaggagccctccctaatttgagtcaggttagagaaagccaaacataggtggaatatggatacctttactacaactacatttggggagtcaacctaatgcttgcttaatcgcttcacagaaagattgaggaaggcagtgatatccagtatcatcatagggctctttggtgccaataatctattgaggtgcttttcgattgtgagacgaccaagaaattagctgatcccagcagaaaaacagagctccttccttacttttcagctgcgttaatttcttctctacgtttcagagtactgctaattccatccactgatcccttctagggcctggttttcagtcctaggcactcaggtaaggctattctctagacacaatatgcatgtgaaacaaaaaaagagaaaagtaataatgacttcaaatattaggatctgactatgaaatatcagatcttttaactcttgtattcatgtaaccttcctacatttttcaagtgaaaatatttcctacattttttaagagacatcagtgttacgtgctacgttatcaatattattttcttattggccatggaaatgcttaaataattgacttgacttgttaaatctattttatacattgcattttaattacatttataattttaagaaacttcactttttagaaagatatagacatgaatacccttggtattaattagtagtagatgtccttacttctgatagcccttacataatgtatccctctctatgagtgctgtagatttttcacttatatctacaaatacagaagatataacttattaaaagttcaataggaataagtcctcatgttatgagagagtataaagcaatagttagagtgatgtgaaatattataactctgtcttctggaattattccttgaaaagattaattatgtatgcctaatgagataacagtgacaaggtataatttagagattataaagctgagaattgaaatgcctagcatgtgcacgtgcacacacacacacacacacacacacacgtaactgctcttttgcaaatcttcatcacatcaattgtgttgaatccattctcttaggctatacattctcatgctagcaaaatgaaaacttgaaagtaatatgttgaagagatactatgttgaagagattcccatgttgattgcagcattatttacaatagccaagatatagaatcaacctaagtgtccatcaacagatgaataaagaaaatgtggtgtatatatacacaattgaatagtactcagccataataagaatgaaatcctgtcattgtggtaacatggatgaatctagaggacaatatgctaagtgaaataagcaaggcacagaaagactaatatcccacgttctcactcatttgtggagtctgaaaaagctgatgtcacaaaagtacagagttattagtgactccggaatgtatcaaggaggggaggataggaagagattggtcaatgacataaaattacaattagacaggagaaataagttctggtgttctatagcatagttgggtgactatagtaaacagtattatagtttgtatttccaaataactagaagagaggatcctgagttctcaccacaaagaaataatgtttcaggagacggatatgcgaaagccaatgtacacatgtatccaatcattatgatgtactccatagatgtgtgtacttattgtgtatcaattaaaaacacaattcaaaaattgtcatgggtttgctctttttttttgcattacaaagtgacatctatttcttgactacatgctaggtgattaattataaaatggctctgtgcattgaagcatctctttcaagagctttacaacctgacttttgggaaagatacattgtatcttttgaatgattcaatagtgaaatttatttctgagtttaccattttgtgatttctgaattttttcactttcagcatttccactagtgttttatttactggttccacaaatcagtcagtttcatcaaatttgccaactgcaagcctaaaccattggaaattggcataatgaatgttctgagtgagaatatatatgttattaggaatattttaaatataagaaaatgtgatacaaacctggctgccaaaatatggcaaaaatgtaaacaaaaattgatgtgtaaaaaataccactgtatttaaaagggataaaactaatcagatagtattttaaagctgatgtcttgatggcacaattttaaattgaagtgctatgggggatattgtcttactggtatttgcagtttgggctcaaaaaaccagaaactatatctttaagggtgtttaacagaataattctaaatattatagttttctctttcctttttgttgtcctgtgattttaactttgacattcttatgtgacaattgaaaaagtctcttcacttttgtgtattctttctaatgtgatcaggagaattaaaatgaacattttctttcataaagctgagagttaattctgaaacgttgtaccagaatacttttatgaatgaaagactagcctttgaaccctaggagagtcaactctacaccaaccctgtctattaaaaaaagtctgtgcttacagatgtcttgtgtgagatgtggctttaccaaaagtatctgaacttcaaatttctcctatcactgccaactacccatgggtattggcaatatatttggtagacttatttcttctgtaggcatatgatgccatggccaaagtgaactctacatttttaagagaggctgctaaatatggccaatcacaacagaaaactagcatttctccaatttggcagtggtttctggatggcacacccagacttacttccttaagcaatgctgatatatggaaatgccatgatagaggctcagaagctaacactgaattcagcagtgcagaaaaactccaaatcatgtggttcttctttgtcaatattttcactaaggcagcataagatattaaatcacctggaattagttatgtgccatttcagcaaccttttgtgctcagtctgctacaagctgcttgtgctgattagcagtttaaaagtctgcaggggaaggaaattttcagtagcttgattttcccccaccctttggtcctgtgtgcattggggaagaaattaccttctgtgcaattcctgaataatttggtttgattattaatagattcatgctgaaaaaagaacaataacagaaaaaaaattacccatggggttgcagctgtgctcccagatacaaaacagggaaagaaaacaggtctctccaagcaaagggtatatgtgtatacgtgtgtgtgcatgtgtagctctgattctaagaagccattggttcatttattcatgcatcaaatatttattgagctgcgaacaaatcccaggcactgtgaggaagacagatttcctgccctcccagagttgccattactaagaatgttagccaataaataaatctttacgggaaagaaacaaaggactgtgatagaaaaaaatgggaggagaaacttactttagaaaggattatctgagaaggtgcctttcacgctgagccagaaagggaagaaggcaaacaggaaaagagccagaagagcagagttcccagcagaggggaagcaagtggagaggcggtgtggaggaatcaatttggccccatctggaatggacagaaggctagaacctgcagtgcagtgagtgtgggagaaaccagctggcacaaggtgagcttagggcagatcacataaggccttgtaggtcatggacaacaatatggatttaagtgcagtataggaacttcaaaggaattccaacagttaagctagttgatgtaatttgtgtctatatgtatatatatttatatatacaaacaaaacaaaccttggctgttgcatgcagagtagattgcaatggagaggaggaccagttggtattccgcaagggagataagaacagcttaggcttgaatgaggatgtgataaaggggattttatgagcaaggctgttttattattttatttattgtacttctattaagatgatatgggtgctttgggggctgttgtaaattataacccacagcccctgcacaggaaacctccacaggaaacaatcaaagaataagtggttgtgagatgacaaggtttacgatacgtgttttcaggcttcttaatagcagagtgattgggtgatttccaaaagacctcagggctgggatgggtgaaattttgtgagcttctggattggatgagggtgtgctcttgcagaaagaattcctgaatactttctgcactgacagaacctgcttattaattcttacagcagttatgttttagaagatgaaagaccctttccattcaattattgatcataagcatgatgtgtgttgattaaaatggcatgataatggtatcaaatggagtttggatatctttttccttaatatacttttgtgtatcatatttaagtttcctcaagtcagtagagaagatgttacccacatcctcttttccaaagaaggaatcatttgatcattgaaaggtttactgaatagaaaataaattatgttgactttagcacaaattcctgccctaagttttagcccatatattgatgatgtcaagtgctgctaaatgtgttcttcttctataaaaattaaagtttaagctttggatgctaactttcaaatctatgtgaaatgatatgatttattgtgatataaagaatgacataaagaacaaaataatacttttttaaatttatgaggaaaaagacaacagaaaggaaaaatgggcaaagaaagagaacacgtttcatgcaaatcaaaaccacaatgagataccatttcgcaccggtcagaatggttataattgaaaagtcaaaaagtaggccgggcgcactggctcacacctgtaatcccagcactttgggaggccaagacgggcggatcacgaggtcaggagatcgagaccgtcctggctaacacggtgaaaccccgtcagtaaataaaaaatacaaaaaaattagctgggcatggtggcgggcacctgtagtcccagctactccagaggctgaggcaggagaatggcatgaacccgggaggtggagcttgcagtgagccgagatcatgccactgcactccagcctgggcgacagagtgagactctgtcaaaaaaaaaaaggtcaaaaaataaaagatgcaggtgaggttgtgtggagaaaaaggaagagaaagtacactgttagcgggggtgtaaattaggtcaaccgttgtagaagacagtgtggtgactcctcaaagacctgaagacagaaataccattcaatcctgcaatcccattactatatatattcccaaaggaatataaatttttacattatgttaaaaagacacattcatatgtatgttcattgcagcactattcacaatagcaaagacataaaatcaacctaaatgcccatcaatgacatcaataacagactggataaaggaaatgtagtacatatgcaccatggactattatgcagccattaaaaaagaatgagatcatgtcctttgcatggacatggatggagctggaggctattatccttagcaaactaatgcaggacctaatgcaggaaaaccaaatactgcatgttctcacttataagtggaagctaagtgatgagaaaacatgaacacttagaggagaacaacacacactggggcctacttgaaggtggagggtgggaggagggagaggatcagaaaaattaactaatgggaactaggcttaatgaaatagtctgtacaacaaacccacatgacacaggtttacctgtgtaacaaactggcacatgtacccctgaacttaaaatgaaagttttttaaaaaagagaacacatttcagaaaaaaactcaaatggccaaaatacatactaagatagacaacctcatgaatagtcaggggaatgcacattgaaatcacagtgaaacaattgttcatctacatcattgaataatacttagtatctaaaagggatggactactgatatatgcaacaaaataaatgactcttaaaagcattatgctaggtgaaagaaagttacatactgtgggatttcatttatacgatattttggaaaaggtgaaattgaagggatagcaatagaatcattgtttttaaagactggggagggtggttgacgactgacatgatgggaatactgtgtgctgattgtggtggtattaataccccatctacctttgtcaatattcattgaattgtacctttacaaatttggttattgtgatgtatgtaaattaaaccttcaatgatctgattttaaacattacagtgaagtcaggagtggtggtatgcacctgtagttccagctactcaggaggctgaggtggaaggatctcttgagcctggaaattcgaggctgtagcatgggtgtccaaccttttgactaccctgggccacattggaagaagaagaattgtcttgagccacacataaaatacactaacactaacgatagctgatgagttgttttttttttaaaaaaaggtccatgcataatttttgtgatatctgtcatgccaccacagatatcaaagaagtcctcacattcaaaggattttacacctatgcatgtagaatgctataattgcacctgtgagtagccactgcactccagcttgggcaacatagtgagatcccatcacaaaaaagactcacaatgagaaaatgttatcatttattagactacaacaatgaaaatatgtagtacagaatcttgtgaaggtgttaggaaatgagaacgctcatgctctgttggtgtgagtggacagtggcataacctccttttagaggaggaatttcacatcagctagtaaagttgaacatgttttaacccacaccttcgaaagtctgataaacatttacaatcaattgtctctgaagcctactacctggaggcctcatctggatagaaccttggtctccacaaccatccttatcttaaccaagacactcccttctatcgattccaggtctttagataaactccttggactagttgccaattagaaaatctttgaatccacctatgacctgaaatcccacactcacccactttgagttgtctcacctttccagaatgaaccaatgtacatgtttcatgcatttattgatgtcttatttctccttaaaatggataaaaccaagctgtagcccgaccaccttgggcacgtgttctcaggatctcctgaagctgtgtcatgggccatggtcactcgtgtggctcggaataaatctcatcaaatattttacagaatttgactcttttcattgacactaatcatcattgtaaaattaagactatagtaatcagtgcattttgagccctcagttgttcaagtactatcacagaagatcgatatcaacttttgtttcagctccagattaaaaggtgagcctattagagtgtttatgtgtagcagaccctacacttattcaaagaatcatttgcttagatctaagagaaatctcatcccttttacttttaatatcatggtccttgtgaaagaccagacaaaaagtcaacccagttagttccttaaaagaggaaaagtagagggaattcgcatgagcaacacctcagtacttaacagtcattcaaggacttatgcatcaacagtacttggcatttcatgtaatccttccaatgttcttatcagttctgtgtgttcttaccattgaaatatagatgtgcacaccattgaaaagtttaaatcattaatttagtattaagttaacaagaacatagatgctacacctaaacttatccaagatattaatccattgtgccttagtactttattgactcaatttataaaaatattgtatgtgttcagtaaaaatataactacatttaagacataagtttgattttatgacttaggtttctgtaagaagcagcatacttttaactcaggcttatgaatataatatcacttcatctccttacaaagtaattagaataaaggcagcatatattttgtatgaactaaaaagaagtacaaaatattggtccccaaaattaaaatgtaagttcttaactacacatttctatgctatattacttgtattagtttcccattatggtaataaccaagttcctcaaatttagtggcttaaaccaacatacctttttctgttagagatctgaagtttagaagtcctaaaatcaaggtggcagcagggctgtacctttctagaagctctaggggagaatctgtttacttgccttttttttagcttctagaggccacttgcactctagctcacggtcctgttggagctcaggggaagctgccctcttgcccttggatggtttgctgaaaaatgaagccacaataaggcatgttaataagaagaaagcataaaatttatttacccatatgcatgtggagaatcacagagtgattacctaattacccaatcaaacccaaacacttatataacctcctttcagaagagcgggggtagatgggaaatataggtaattcctttgacggacattacatgattactagggaaaagtaaatggatccttgggaaaacgaatagatggacttgtaaatgatttggaagttgaatgaacttcagagacaggcactattttgtagaaaggctgtgccagttctgaatacattctttcactcctgtcttgaaatagataatgagataacagggaagggaaggaaaaacaattttttttttggtggatccatcctatttttatgaagatggggaaaagtctcttctaacgcatattgatttctaagggattttaattcaaagtattcattacttccagggaatcatattttggggtgaaattctctgtgtttttttagtgccatccttcatttttatagccagcagtatagcatcttccaattttcctttctttctgggctctgtcctcaaaacatcttttcagattctgaccctccagcttctcttgtgtaaagacacttgttatacattggcccacccacataatccaggacaatatctccctctcaaaatcctgaatcaccttacatttgcaaagtcctatttccaatgtaaggtaatattctcaggtcctagcaactaggacacgaacatctttggggttattattttaatcagttgctccaccctttaaactcttttctggttgatatatccataaaattaagtgacattcgggtgaagtgtcatcacccatcactatccctatctgatataaaacaatgatacttaagtgaagtgttataggaatacaaatttgcactatgaagttaatattagaagataaacatcctctaaatattatcttatggaggtaagatgacttttgtgtgaggactataccatcttttattcttggagtaatttactattcagaatgtggtcagttttggcacgttgtcagaactgcaactgtgtaaggaataaagaataagacctatctcagaaggttgttgcaattattaaataaattattattttggcatatagacttgctatgtatttactgcagttgttaatattagatccatgtgaactatcaaaaattgtattataattgtccaacaggttcttcttgcccactgcatggatagggcaaattcactgagacagcggtattacagtagagaaagagtttaataattgcaggcccagtgaagcagaaggactggatttattattactcagatcagcatctctgaaagctcagaggctaaggtttttccaggatagtttggtaggcagggggctagggaatgggaaatgctgataggttggggcagggatgaaatcataggggtcaaagctgtcttcttacatgaagtcacttcttgggtgggagctccaggactggttgaattagttccttggtatgagtcacagatcctggtggagtcagctggcctgcccaaatgcaagagtctgaaaaatacctcaaagactaatcttaggttttcacaataatgatgttacctataggagcaattgggaaggttacaaatcttgtaacctctggcacaatggctggttattgtttaactgtacctacatcctaatagagttcaggcccctcccataatcctagtcttgtggccttttattacttttacaaaggtggttttggtccctgaacaaggagggagtagtttggggaagggctatttttatccttgttttaaagttaaactataaactaaatttctcccaaagatagcttggcctatgtcgaggaatgaccaaggacagcttggagttgagaagcaagatggagtcagctatgtcagatttctctttgatatagtttgaatatatatctccgccaaatctaatgttgaaatgtaatccccagtgttcgagattaggcctggtaggagaggtgtttgggtcatgggaacagatcccgtatggcctggtgctgtcctcgtgatatagagtgagtactcatgagatctggttgtttaaaagtaggtggctcctccccaactaagtctctctctagcttctccttccaccatatggtgtgcctgctccaactttgccttctaccacgagtaaaaactccctaatgctcacccagaagccaagcagatgccagtgccatgcttgtacagcttgaagaagcatgagccagtgaaaactcttttctttacaaattacccggtctcaggtatttctttatagcaatgcaagaatggcctaatacatttattgtcataattttgcaaacgtagcttccctgttggctacatcaaattgagggtttgctaggatagaaaagtggaaaatatcaattaaacaactcagagccgggtgcagtggctcacgcctgtaatcccagctactcaggaggctgaggcgtgcagatcacctaaggtcgagagttcaagaccagcctggccaacatggtgacaccccatctctactaaaaacagaaaaattagccaggtgtggtggctcacgcctgtaatcccagctactcaggaggccgggcgggagaacacttgaactcaggaggcagaggctgcagtaagccaagatctcgccactgcactccagcctgagtgacagagtgagactctatctcaaaaagaactcaaaaagattgtgttaggtacttacagactagaagattatgttaatgaatcttttattcattcaacatataattattgcccactgagtatgtaacacgttttctgttatgtttagaaataattatgagcaactcagaatgatctccaccctcagagagtgtacagtctacctcagtatgtagatgattaatagacaaacaataagtgttgaatgttgcacaaactgtcctttatttgatccttagagttatatagcatatttaaacattttgaagtttgaaaatgcatacaaattagagagacatccaataaggtaggacttgggttaatgtttactttcctcaagcacgagaatagtatgtgagaattaagaattaattgttaaaacacatctttatatttctttatgagacaactcttgaagcaaaagtgaaagctggctcaaacacagttcaattacacagacgtatacacacacttatagtcacacacacacacaaaaccaccactgtccaggaactaaacaataattgtactcttctagatatgtaaaatcaagcgaggaacagttaagaataggttatggccaagcgtggtggctcacgcctgtaatcccagcactttgggaggctgaggtgggcagatcacgaggtcaggagattgaggccatcctggctaactctgtgaaaacccgtctctactaaaaattcaaaaaattagccaggtgtggtggcaggcacctgtagtcccagctactcggggggctgaggcaggagaatcacttgaacctgggaggcggagcttgcagtgagccgagatagcaccagtgcacttcagcccgggagacagaatgagactctgtctaaaaaaaagagacacgttaatcttaactttttttgagagagtctcgttccgtcgcccaggagagagtgcggaggcacgatctcagctcactgcaacctccaccgtcaggttcaagtgattctcgtgcctcagcctcctgagtagctgggactacaggcatgcaccactatgcccagctaattttttatatttttagtagagacggggttttaccatgttggccacgctaatgttgagctcctggtgtcatgtgatccgcctgcttcggcctcccaaagtgcggatcccaaagtaggattacaggcatgagccaccatgccaggctgaaaattctgtattctattatatattatataatagaatattttatatatatatacttatatattatataatatataattatacacacatatatattttttaattttattattattattattttttctgagacggagttttgctctgtcgcccaggctggggtgcaatggcgtgatctggggtcactgcatcaccgcaacctccaactcccggattcaatcgattctcctgcttcagcctcccgagtggctgggattacaagcgcacaccacgcccagctaattcttgtatttttagtagagacagggtttcaccatgttggccagactgttcttgaactcctgacctcagcagatccacctgccttgacctcccaaagtgctgagattacaggcgtaagccaccgcgcccgacctgtagtacctatattttttatttttctccaatcttttaatcttttaatcattctccaaaatgttgcctttcttctcaatgcttagcagacaatttgataaacaaggatccttttctaagtagacttcatataggagagttttcaaaacagaataagaagggcatattattccttgtcaaaatattttcttgttgaaaatggaaagtttttgctaaaagctgaaatgcatggcagattaatttatgcctattacttcaggtaaataatttcaccaggagtcttcataggtaaaatgaatgtttatgcttgataaaaaagtagcagttgttgatttcaacaggtttaagaagcgtaaatgttgtccacctcttctttccatcccatgcacatcttacttttactctagtaactaccacccatgaatgtccatctattaaacccaagcagagagtagtttttaaaatattcctttcctgttttctgttgaactattttatagacaagctatataaaaaagaaacacaaggaacaaaaaatgatatcttattctagtgaaggaaatccaaagttggggtctagaatacaaatacacctgtgtgcaagctccagtgatgccagttcctagtactggagagcattgtgactctgagcaaaagagggaagacaaacatatgaacagaaaacctcgtcttttctcaaacatcctcaatgactgttacatgaaaatgaggactatcaggctcatatcattttcaaagacaataggtgatatgcatgtggagaacaaatacaaaaggcatgcatagaaatcaaaagtgattaaaaatagtctgaattctggagacaatagcatgtgtggacggacagatgctacagatttaatgctgacatatcagagatgaaatgtcagctttctttattaccagtagctctcagcttttcaggcaaatcgttctttgtactctacgttctttctccttatggagttccttcttgatgcctcttcctacttcttcacatctttctactccttgagatacctgcactcattgcttgcacttctgttagtgattttgttacagtattgtgctgtgtgtttccaggagtggagccaaagtgaaggaagcccagaaatgcctgtcaagggagactatgagatgataacagcactcgtctttttccttgtgcttcttgcagttaacacccacatctatctatccatctatttgtgtatctctgtgtctgtctgtctgactatcgatctatccatcacccattcatctactcatttattttggcatacagcttttcgatagaggcaaacactgcctaatggaattgatctacaacaagaccatagctggagtgaaagaaccaggactcagaagttaaaaccaaagttaatgttattggaatgtatagtcttaaaaacaatatgttttttaaggacaattttaattcaattaagtgtgcaatgaaaacacaggggaatgtttgaagaatcttttatcttttacccaggtgatgtgcttttcgacaggattacatttagtctaagaggtagaaaaacgtcaccaacgacaccttaaaggcttaccccaaccaccagaaaaatatttgtactatttccttcttaaactttgcacaactttttatgtagatattaagtgttcaaggggatccctgcacatggatgaagtcatgtttgcatacactcagtgtaaatatgtgtacacacacacacacacacacacacagcaggggaaatatttctcaaatgactacacttaggttactttccatctctatttattttcttctgtggaataatgcagactagaactaacataaattgaatgctcatgagaccacacatcttcacatggtatagagtgtgttatcgcagcaattttataatggctcattaacccctgtgagaggccagtaatatgggatagcaacggatttctatcaactccatgagggagataagtaaggtggcatcttatgtagatttctaaatcctctactttgaaatcagctcaatggcatattttaaactcaaaatagaatgtcttctggttcctaatggttgatttaatggtggatttgaccatatgtgtatcagatgtaaaaagtattgtccactaagtggagtaaaaaatgatcttttacagaaggaaaaaaaaactgatttaaatctttagattctcatgggatctcattaaggttctctttctttaatacattgtgcagcctaatagttatcagcagccctgcggtgtgcattgctgataggttagtttacacaggattaattgtgtaattttgcaagcaaccagcacagtgaacactgatttttgcattagccccatgtgttgtttccaaggggactctgctttctattttaaggtggtgttacatttcacttcttattaattataatttctgctagcatgttttatgcccaatatgatttattaaaaatccttcataatgtttttttcctaattgttatgtccttcggtaacttcattaattttgagcactgatgtgtaaaaaatggcaggagaaaatggcattcacagaaggttctctgaccagccagtttccccatgcccccgttgataagttgccacaaatcttttgctaaaatacagacacaaattcagttgcagccactccaggtatgcgaagtgaataatcagtgcaggcaacaacctgacaatactacattcctcaaaccaaaagaatgcgaatgttcaaagaagtgttggctaagcagaactcagtccattttccacaatacgtagcttagtattttccagaaatacttgtgtattcggaagaattagaggaaggaaacttttgtttgaattttccacataatagcttagttcaatactcagctactacattttatcgactcttggtgggattatgaaatgcctattgaggtttcagtggaatctttatagctggacttgatattcttttacatggttttgaaaaaacaaaacaaaacaaaatgttgactgtgcacagtttagaacttaatctttaaattctttttgccttgaacttgaaaatcaattatctgtctgtgccccaccacctcttccctcatctcagccttcacgagataaaatttctctccctccggagcacatggtctctcaaaggggaagagtcacatctccttgtctgtgcagctgttgcttcgttttgtttagggtggatcttctctccttatccccgtgagtttctatagtattataaaggcccaataaggttctgtacaaagtgggtacttaaaatgtgtcctgagtgacaaactggcccccactggaagaactctttaaaacactctgttaccagagcttcaaaaagggcttgtttctgaaggatcaaaggatctcttgtataataaattctgagcattcagtacataatgaagagaagaaaacatgtcttttaagctcctatatgatgcctggattatgtgaagagatgaaggaagtggtgactctttctggcttttgtgtcattcacattaaacaggaatagatgaaagcaaaggcttaacactgacaaaatcccaagtaggcaggctctgcatccacagcctgttcacacattcataacaaaccaccagctgatgacttgaaaaaaatatgattttctttctagtgaaagactgactttgttttgtgttttgtgccttttttaaacatctaccttcagaaagtataaaccttttttttttttgacagagtgattgggttacaatattgttacagaaggactagaattagaatcacaatacttgggtgccacacttgacctttgtcacttgttatgtatgacactaaggaagtaatttagtctgtaaattaattttatttttcatcatttataaataaacctagtaaaatgaacatgaatagttgtttcaagggtttaatttaaaaatcatttttgtattgtggtaaaatgtagactcttatattcttataggcagattgcaataaaactctactaagcaattacactagattttatttctctaaattaaggctgaacaatctcttttttcagttccactttgtctgagtagtttgaatggcccagatcagagatgatttttgagactgttgttattgtgtttgatagattgtgctcatgaaggcacgtgcatatttatggagaaagaatccttagctttccccagatgctcacatgtgtttgtgatcctaatggggttaagaacccttaacctgataatctcaaccaattttcctttcacattaagtgggagtcctactattttagtattaagtaccagaagggtgaattttatatgttactttatatttactatcggttttgtctaacaggaattttgtgcagtaaaatatctacctttcaaattccctgggaggagaaagacaatgcatactggagatatgaacacttttccacaatacttataaaaaataaaaataattaccttggtgatttcccataattaaggcagatttttttccttcctccttcctctcctctcttttttacgttaacaccaccaccctcatcattaccactgccacttttctctcttccccttgaacagagtagataattgcatatgtacaatttcctagagaactgaagcaggcttagcccatagttgaactaagtttcaaagtttgcaaagtaagactggattaactatattttctgctaagtgttggttttaataaaaaaagaagtttatattcattgaaattttcagttgggagtacatgttttaaaaccttatttcttccttttttttttttttttttttgagatggagtctcattctgtcacccaggctggagtgcagtggcacaatcctggtttattgcaacttctgcctcctggttcaagcaattctcctgcctcagcctcctgagtagctgggattacaggtgcctgccaccatgcctggctaatttttgtatttttagtagagacggggtttcaccatgttggctaggctggtctcaaactcctgacctctggtgatccaccctccttggcctctcaaagtgctgggattacaggcatgaactaccacacccagcctagaccttatttcttaatctctgaatgtgtttggtgtgacactcaactatactttcagcttacctagcccaatataaattttattttaatgaatggtttccaacattttgactctcctcatgttaaaaaatctctggatttccttatatttgatttctgtacttatcagtatttggcaggaagacaagtcatggcaacaactgatggctgacgagacgttatgcttggaattcgtatattcatctccttaactgagaaggttttggtgtctaccattactgacctcactgtgaggaggcaccggagaatcatgatctcattctgtgtattggcatgtcattacacattattaatttggtcttttgagtgacacaactgtttttgtatatcggtgtgtttgtgcactgtccctggagctctttgtactaagttatttttatttcattttcattaacaatattttgggaattgtcattgaatttgtaccttttctaccttgcactttacaataattagcatattattatagtaaattagaagtttaataattaaggtaacatttagatcctgtcaataactatagcctactttattttttgaacgttttactatgcccctttgtaacagttttaggttttttaaagagtcattagagtcacttatttatgctctgctgattagctatttattttcacagttttacaagttagatgttcgtacttagatattttttacagatcgaagtttctatttgctcatgagtagctataaaataataattatcattaggttagatattttctgtgttacagtttgccatttatatattctcattgccaccctgtgagtgaaatgaatcagaggttgttagctccagttaaaaaaaaaatgaagaaagagaccttcagagaggttggctaaatggcttgctagtaagtgcctgagatggtgctgttctgttcatttaactttacattttagtctagaattttctctgttactccacttccttttctactcaaagacctttttataaaagaaaccagggagcacttaaaatttgttctctaagtttagagctggactcaaaccattactggcaaaatcaatctggtcctttctttcctccttttttttttttctttctctcataatgaatcaagacatccagcatccttgaaaccttaaaggtatctgaggatacaaagataccaaactggagttatcttcctgacacataaatctgatcttgtcatttcttactacaaatccacgatggtcttttacaagataaagtttaattatctgagcatgacacctagggctcttcacattctgtgcgatccaacttttcagcctcgtctctttttattatctattgcttgcccttatacacctcatcttcagcctccaaaatttcatgtatcttcttgactgtgccctgctcttttaggtttctgagttgcctctcttgcttttctataccagcccccaaccccaacaggaatgccattctttcatttgtagcttgctaaactgggtcacttacctaaccaaataactatgtggctttggagaaaatactgtttttatttcttagcttgtttattttgatgtaaaaaaatgtaacgcatgatcattaaaaatatatctattacattaagtcatcttcaatttctgcttaccactttcttcccataaacaatggtagcaagttgatgtttttctttctaatgttatttctcatgtagacattgatacatagtatttttcataagagcaaaattaagctcacattctataaaaaattttgtagtgctttatttcacctaatattatacaaagtctcagcattcaatattctttaaaaacacaactttttaaaattataaacttttctaatacataactatattctacatatttaattatttctctattattgggcacttaggttgtcacccaaattttattgttataaattacactcagtaaagatttttccattggtagttggtgatatattaatatgtttaatccaaacttagttagatttctagatctgggcatactggccaaatgaacataaaaatctatgttagaatatttaaagaagtcaaaatgctcataatattatgtagagataaatagcatatcatttttacgtatgtaatgtattcatacacatatctgtatgtgtgtatatgagtgtagctatagcactgggtgaatattaatatatcaattgaggaaggaaatacactaaaatattattttacagatgatgtccattttattaggtatatgtgtgtgtgtgtatatatatatatatgtatatatgtatgtatgtatacatatatatttgtattttaccaaatatctagagtgagaatttgttacttttagaataaaacaaaactcccacaattatccaccttaaccaattgctgtctcctacaaatcctttccaaccagacttcatgggtagaaagcgagtttctgctggtgaaagggtgaaactacttgaaaattatttattgtctcccaaggttcactgcagcatgagacgttacgtagttatcaagactaaaatacaaagacagccctgaaaatagctggggagtgtgaaaattagtaatatttaaagtactgaaaattagtgatatttaaaggaaaacagaaagtttagctcttggtttgctttgggagaggacgggactctgaagcccccatgctggtgaggcacggatcttggagggtggtcagaggttgaaagccacttgagcaaatactcagtccaaagcagcaggtgcaatggctcaagcaggaaacagagtaatatcctgagattggctatgtttagacaagttcctattttggggacacagggctccccattcatgggtgtgccttgagtgcagtgccagacacagaatagtcaagtaatatgttcttggatgaataaacaaagaccctttgtacaatgctctgggacagaaatgcttcataatagtgatgttaacatcttttcacacctaaataagcctaaaagacttccaggcagttttcacatgtatttcagtgtgacttaatgatttataattctttttttattactattattattattattatttgtaattatactttaagttttagggtacatgtgcacattgtgcaggttagttacatatgtatacatgtgccatgctggtgcgctcacccactaactcgtcatctagcattaggtatatctcccaatgctatccctcccccctctttctaaacattattaaaaatatttgtgtcactaatcttgcggccataaagaacaagagtttgctttaaaggtgtactgatgctgcgataacacctatggcaatatttaaggttatcaaaattataaagctccatcctggagaaatggtcatgtgacattaggcaatatgtaacttcttcatgccttagtttggtcattgttaaatgaaggacattaaaaaaaaagcaaaaccgtatctacctcatgggttgtaaggataaaatgagttaataaaatgtaaagcacttaagagagtgcctggcctgtagttagccctgtataaatgtatcccattatcattaccaaagaagcttgacattggtattaacttgcccacaattaactggtgtgatcaggcattagttcaaggtggtatctgaggttactatcagatacattttggactatataggaaaacatagtgcttctctataaattgtttgcagaattactaccacaaattttaatggccttctacttccaggggaggccatctctatttgcattagaaagtaatataaagtcagaactgggtcctatttgagatctaaaagattatctatttgacttattcttaacttacaacattgacatttttgcttattgctttcaagactgtttcaaacatgatttctttcggtatactatctttgacagtagtgagaaaacaagagatgcctctgccgtcatactccaaggtgggaaacagaggactagcacctccagaagagggcctctggcttctgggaggtggggcttttaagtttcatgatttggtattggtgctgggatctgagttttcaggtttgactatgcaacatgcttgaaacatggcctcaaggattgtttggctgcctcagcattcatggtgggaagaccagcgtctgaatgataagagatttggaccttgtgtggcagcatttggtctcaggccctgctccgcctgcttgatattctactgtgatgaattggctatagctggtttcccaggagctttgtcatatccacattcgactgcagaaaaaaaacaggagttaactaactttcccaaagtgacacagctagtaagtggcagagcttattcattcactcaagaaaatatttagtgatgacctgttttgtgctacatgctggagctggatgaaaaccccaaagtgtctgagtgttactgatatcatcaatcagccccaggtccttctaggtcagccttctatagggaagggaagtgttcttgagaatgtgtcttggttctccatgatgttcttggacagtagcaatgaaatgcatatcctcatttctatgaataaactatgcctgcactggccaaaaatgtgtctctccgtttttggaagctatttatttctttaacatatatgatctattatagtaatataattctattgtgtacgatttgccctcaatttatttctggaggatttcctgtcttccaagttgtaacaggccaaggttgtagaaaacattatactgacattttctgtggcccttaacattttatttcagtctatctattctttgtattcatctttccacactaaagatttctaatgtttctaatcttcctctgtgtgaatcccatggccccagcctcttaaataatgtagtgcctttctctgtacctccttcagtcccattattagagagtttttaaaaaataatcatagacttttagggcaaaaaaaaaaaccttgtaaatagcattcagttgaaattctcatgtcgtggataaggattctgaggccccagttagttaggaaacacgtcattaatagggagtgttactgacatagcaaggaatcaaactcgttaggacctctgacttgccttggaatgttctttgctgatatctctctattacgctgttggcttctaatatggtttggctctgtgttctcacctaaatcttatctcaaattgtaatccccatgtgttgggggaaggacctggtgggaggtgattggattatgggggtggtttcccccatgctgttctcatgatagtgagtgaggtctcacaagatctgatggtttaaaagtgtgtggaagttccccactcactctgtctctctgctgccaccatgcaagatgtcccttgcttccccttcaccttctgccatgattgtaagtctcctgaggcttcccaagccatgcagaactgtgagtcaattaaacctcttttctttataaattacccagtctcaggaagttctttgtagcactgtgaaaacaggctaaaatacagcctcctttagacagttgaatatagcttaaaaatagtaaaagactgaggtataatcagtatggagtccttttctcaaagtattttagatgagtgatgcaataagaaagagggtctactgtagataaaggcacaggccttgaggttacacacattaggttcgtatcttggtgttgacatttattgtcattgtaactttgtaaatcatacctaacttaattgaattcgtttaatcttatgtaaaattaaagttagtggtacccacattaaaggtacttgtattacgtgagattatactaaattattaaatatgacatctgacatataatctgtcttcaactgatattagaaaaaaatcacatatgatgtttagtggagagtcaatatctgtgatttagtaaagaaatggtaaaactcgtgatcagaaataggggctatttctatttagaatgctctttcagaagtattcttagaaaaagttgaacatcttcacattgcctatataaggttttgctgataaataattcccaaaagccaacattaacaaagtatcgtattttttctagttcttactttattgtacatcattttatgttagacatattgaagaatttctgtctgtgtgttcatttttgcagtactagtagcttataacctagggaatattatgtgcctcatgtatcattttcctttttaaaagatacagtcattcaaatttgtattgagtattttggcacacattttgagggtctgggcctccatgatttgaatcaagaactgattcctttcgggtaaatgttagctgatgaccaaaaaagaggtattttcaatcccagtttcttaagaatattgacctaaatattgactaaaagctgaggtgctcacagccttttctagcaatttaaaaaatcactcaaaacctccagtgtttaaagatcaattgagatcagatacattttttaaaggaaaaaaaataaaaaaaatagccagttttgatctcaaatgcatacacatctatgtagaataggcattttttgtcaacatatgtgtattaagcaaccaatatttggcaatctgacagcaattgtgcttgagtactaggaaggcaaaaattaataagatcatttttccccgacctggacttaaggaactcaaaatcttgcataaaacattgtaaagaaacccttttctggccaggtacagtggctcacgcctataatcccagcactttgggaggccgaggtgggtggatcacctgaggtcaggagttcgagaccagcctagctaacatggtgaaaccccgtctctactaaaaatacaaaaaaaaaaaaaatagctggatgtggtggcgggtgtctgtaatcccagctactcaggaggctgaggcaggagaattgcttgaacccaggaagcagaggttgcagtgagccaaaatcgcgccattgcactccagcctgggtgacaagagcaagacttctaaaacaacaaacaaacaaaacaaaacaaaaaatcttttttttttgtcttgtgagaataaggcatgtagctgctcacacatgtagcttatatagcagctgtcaaggttcatatgctaccacgtggggtactgtgtgatttcctcctgatggctgagttgagtggggactgtcaagtagggggaacccggagactgatctcaagtgtccctcccggcttcactggacatcatcaatcagaacagtgatgtggctgctgctaccgcagctgccccttgcttatcacagagcaccggctagatctcagcctagtgctaagcaatttttgcatgttagtaccattcctccaagccattctgcaaaacagatactattatcccttatttaccaatgagacaactagagttctaaaaggctacttgattagcttacgatcgcacaacaagtaagtgcacacttgctccgttttcagtctgtctgtcccttttttctctgctgcagcatctcttttgacagacactgtggtggtaatgtgctccctcctgctccatgaagctatgacattcatacttgtgactgtaaggtgaaggaactatgaatactactattaattgatatgtgtagctttaatgcattcattctttaattcatctaaacagtatatatataaaatatatatattttaaaattattttttcataggcttttgggaaacgggtggtatttggttgcgtaagttcttttatgctgatttgtgagattttggtgcactcattacccaagcagtatacaatgaacccaatttgtagtcttttatccctcaccccactcccaccctttcccccaagtccccaaagtcattcttatgcctttgcatcctcatagcttagctcccacttaagagtgagaacataggatttttggttttccattcctcagttacttcacttagaataatcgtctccagctccatccagggtgctgtgaatgcggttaatttcctcctttcatggctgagtagtattccatcatatatatttaccacaatttctttatccacttgttgattgatggacatttgggctggttccacatttttgcgattgcgaattgtgctgctataaacatgcatgtgcaagtaccttttctgtgtaatgacttcttttcctctgggtagatacccagtagtgggattgctgaatcaaatggtagagctacttttagttctgtaaggaatctccgtactgttttccatagtggttgtgctagttgacattctcaccagcagtgtagaagtgctccctttccattgcatccacaccaacatccactattttttaaatttttttcattatggccattcttgcaggagtcaggtggtacagagatgtagttttgatttgcatttccctgatcattagtgatgttgagcattttttttcttatgtttgttggccatatgtatatcttcttttgagaattgtctattcatgtccttagcccactttatgatgggattttttgtttttttcttgctaatttgtttgagttccttgtagattctggatgtcagtcctttgttggatgtatagattgtgaagattttctcccactctgtgggttgtctatttattctgctgactgttcattttgctgagcagaagctctttaattaagtcccacctatttatctttgtttttgttgcatttgcttttgaattcttggtcttgaagcctttgcctaagccaatgtctagaagagtttttctgacgttatcttctagaatttttataggtatcgggtcttatatttaagtccatgatccctcttgagttgatttttgtataaggtaggagatgaggatccagtttcattctcctacatgtggcttgcgaattatcgcagcatcatttgttaaatagggtgttctttcccccactttatgtttttgtttgctttgtagaagatcagttggctgtaagtatttgggtttatttctgggttctctattctgttccattggtctatgtgcctagttttatacaagtaccatgctgttttggtgattatggccttatccaaagagtatatattatgttttattatggtgccaggcagtgacattggtacaactaatatatgcccttatggaactcaagatttcttatgttaaatacagaataaaggaagtaggaatatttatagctgttaggcctttagttaattttgtctagatggagtttcaaattacttatgatttgttgtcagttcagtgcataaggagaaatttatcttataaatagcttagaaaggagtcatgtcataaaatgacatgtctcaaaatgtcttgtgaagccaagttttcttccagcatggcaagcaatcaccatttctcttgctgagcatctaatgaagtcataggtttgatgtagagggtatgttgtgtgaaaagtactactttgaaatattagataacttcagagtcacaacatgctcatattcagaaaacaagtgaccctgacttccgctgatccgcagctctcatattacaccagccatgggtaggttgtttgctgagtgtaccctcataacccagtttttactgtatcttgctcttcagcaagtgctgtttctccttccagtatacttctctctggtttttttttttactttgcctcaagtcagtagagtttaatttaactagtttttttgtgcatatactatattttctttcagtcatactttttaaatcttagttacaaagcacacaaccaataaggacccaaatgttgtttcgccttaaattactttctttttaatattttctttttaatattcctctccattcttgttttacatttggtgggtatatttatttgtatctcttaagtaaaagaaactaagggactttgaaaaaaaaacaacttttcactaataacagagaataagtaagacgttagtatctatgtcaatggtggtgagggaaagggtaaatgctttctagagtaaataaattcaaaggattgtatgtcatgttaatataacaaaaacaaaattagaaagacgttttcttagattatagtagtgtattgtgtatatacccttatctaatagtgtttgagtctatccctccactatatgtatatcctaaattgtacagagacactagtatgctaaaatttatcataagaaaagattaaaaggagagaaatgtttaaaaatgagatgaaaaaccataagtacatgtgtgtgtatgtatatatatatgtgtgtgtatatatttccatatttcttgtttcattctaaaggatggtctgtgcatctctttccagagatcatgcacctacaacatgaaggaatgaaagaaaacctaataatacagagactggctgagcgcggtggctcacgcctgtaatcccagcactttgggaggctgaggggggcagatcacgaggtcaggagatcgagaccatcctggctaacacggtgaaaccccgtctctactaaaaatacaaaaaattatcccggcgtggtggtgggcgcctgtagtcccagctacctgggaggctgaggcaggagaatggcttgaaccagggaggcagagcttgcagtgagccgagattgtgccactgcactccagcctgggtaacagagtgggactccatctcaaaataaataaataaaataaaataaaataaaataatacagagataattcttcatttacaataaacactaagaacacatgcacacaaacacacacacacacacagagagagagagagattagattagtagcaaggaacttacatacatgattaatgtgaatgccttctgaaccaaagctgaaggaagcagatgagagctctgtgggcgtaggctgctgctgtgagcatacaaataagtttgatcatagctacagtctccatgcctaatgtcaaacaactgtcttgaaaatcctaagtgagagtggggtgggtaattcagcacaagtactgatctctgttgtcatgaatgtccttgacagtggtaagaagtggggacccattgggaagagccacctgaggtggcttcatgacatgatggattttgaagagatgtcttagacagatctaatgttagaacaataaaagtggtaccatggctgtaggagatcctgaatgcatgacattctttatcactgggataaagaacattctagattaagtcatgtaacattcacctcagcaaatggaacagcagggtcagcaaatctcattttgagtcaacaaatgcaaacattgcattatttcttttccccactgagagactgtcgtaacacacataggatgctggacacagcaacatgggagccaggttctgtactcttctacttaggtaaacttctgtcagcccgcagaagtcagtgaacacaattatattaaaacaatgtgtaccatggacccattggtcagaagccatattaaatgcagtttcatgcatggttagtcatccataaacatttctgcttgtaataataatgcggtcagaagtaggccttgtggggctgaaaagaggttactaaacaaaagtattaaggacacagtctgtgcagtgtgtcacttggtcaactggaaagcagtgacgacttttcttatacttgccagggtggaattcttctcagtgtattggtgtgaggttctctccggaggcattgcaatctgtttctaactacttggcaacagcttttggaataaggccaaaaagattgtcaaataatacacagagtggaaatgagctgtttgaatttttcagccatccttccttttcttagggccaaagatgtagttttataaatctccttaattagtaatttctaccagaatgagttagaattattacatggaatttagctcttctgaatgatgttcagtcattaagttatgacagctggtatgcaaaaaaatgttgacttattccaatcgttctgatgcctaatagaaagtagagttttttaaaagcatgttcatgggatggcattcaaaaacaagcttaagcaatctttctgagattgggagccaatccttgagacacctgggaatgaacagtaaaaggattggatatattggttgaatcagtctcctcatttcacatgttgatgttttaagagataggcggcttggcaaaccatggtgagagatgacctcttgagttgaaggcttatgttcactctgtagttcagaggtctgatctttcaatgcttcctgacgaagctctcctcgttttggtccatatcgttttattttgaaagattagtcacagcatcagacagatgcaagtagctattgtgccagacaggtcaggagaaccgctatgtagaaatgcttacagttgtggtctgttgcaaaatacgtgaattcatgagagaagacacatcgataatgttttcaatgagaagtgtaattacgtggctgctttttgcatgcctgccctctctcctccttttgttccttgacagaaattcgcaggaccccttttttagcaacagagcaatactatagcttaggtatttgagtggaaattttgaggggtgtggggagaaagaaaaattaaatccatttttttaaacagaaaatgtaagaattaatttaaaagtgactcaaatgataattgtttccaaaattacaactttctaatctatccctaggtgctgtaaactgcaaaccataatcctgtcttaatactgcaaacaaatcatagtggaactaaggggaacttaatttactggtaagagtattttccttaatcagttgttttatgcatttttgattgtatttaattattgcagtacatagggcaggagtcacaaaagataaggataaggagacgttgcagaacttttgtcttcactacggtcttagcgtagatatggaccagatatatcatatagtgaaggttttttttgttttttgagttccattaaattgctggtttatttttgaaagagcaaaacccttaccttaaagttatttttcttgttggctgacctgttggcatatttgaaagtggcatatttataatatttatcaaaatgtcatttttaatagaaaaaaatagtttcaccactgagatttgagaaggttgacttctaaggaggcttgaagtttcagtgagaaaacctgtattttcagggggttaacagagctcacgcttcatagtctgaacgacttacagcttcagtcactgttccttgaatttgaatccgtttgaaatctgacctgaatccttgattggagttttttcaaattctttgtgcaacaccaagctgaattataactaatttcaaagagtttggaacaataagaaaagttcacattggaaggagggccaaacacacagtgatgtagttctaggtaagctgtttagctattttgatgacccattttgtaaatcataaaactggaataatagttgtaactgcctacaggtgcagcctaaattagattattacgataatgaatattagcactgggtttggtccatagcattgtgtttggttcagtaagtgccaataattagtatcacgactagtttttaaagacaaaataattggaggaaaaacaaaaacgagtaatttttttctcaatgatgaaagaatggttttcttactttctcaggagcacattatgtcaccaagagaatatgcactccagaagaaataagatattacttggtgcatgaagaatttttttctatgcatttgttgcaaatgggaccttaatacaaatataaaataatgaagaccatgtggaaagagatagaaaatcttggctttatgggttactgttagcatacctggttcctggtaacccccagcggccttctaaatgaatgcaggccataccaagaataagtctatgaagaaactctctgtgctttgaaaaacatttgatctcttctctcatccactggagtggttttgccctccactatttttagatcttcacttgggaactttctccaagaggggttctccatacagactttctaaccacagggcatctgaaagtctcttgtaacattaaaaatggtttgaagtatattctaatatccttagagaaaactcttcccaaaacctgattaatcaattcctttgatgatgattgtgtgggatacatttattccattaaaacacttttatgatttcactttaaatgaatttctagttcataagaaacataggtaaatcttctgagatagtaatgaacaaaatacaatacccagggtattaaattttaaaaaagagattatcatactactatgagaaactgtaattgtggttgtgtcatgatgatgtattaataattatttctcttgacattatgaaaatggatggtaacccgcaaaacacccttcttgctcgtagccctgcattctttcctgtattttattgaattatgtttatttcttgtgttcctcttggtgattgatgaaatcattatttaattctacaaaataagttcccttaccgtcagttttcattgtgctagggaaatcagccatcaggttccaggaagggtttgtggaatcgtagtcataaaacacccatacccacacccacacacaaacacgcatttacctaatcttcatttttcttttcagaatctcttgtttggaaatttcctcccagaatacccaacctctcaagaattttaaaacgatggagtaaaataatcttcaagctctgattagattacaacatatgaatgctaattttgtttttacaggtttcaacacccaaatttatctgaacttagggcacaataagcagtttaactgttagaaatcttatgagattgagtttgtgcctatcagatgaatacatatttgtatataacatttcaattattgctacatttatgtataatttatccaaaagcgatgttatccatgcatcttaacagaaggcttaagtagttgaatgacagggactacatttttgctgcagaagatcatgataaaacatgtgctgtgtggtcaccttgggtaatgtgccgagactgcttgatggtacttatctctacacactgcatctcatactgatttatggatttggatgacttattttatgtcaaagacataaagagagtagagaagagagaatagtattttcatttcagtcttaaaaaagttctatcctatgagatgttaacagctgccttctcttggtggtctgtgaagtttttataaagatattgattattttccaatgacacacaaatctactgctagagaccattcaaatgcttagttacaccagggcttggctcctgtaccctgaggaggacacgattaaccaaatcctcctttttaaatgttctcaggacaatgagctgcacatacggcacaaatgcaatttgcttgaccaatcttgcctctgtctccttctatctccgtttacatgcttcatgctcagttgaaattaattctctacacattggtctcatgaacacatctttgagagcagagttcaagttaaatttttattttcatcattacctctgagaacacaatctggggcatattagacgctttgtaagtgtagaggtggggagaaagaagaagaaagagaggaacagaaggagggaaagattttcctgatagatcactttctggacactttctgtgctgagaagttctgagattgcctctctggatcctgctatcttggcagtcttgctaagagtttccatttacacttaaacatggttactgatgcgtcttaatgttgccttaactatcaggtttctgatagccccacatagccaagtgggaccctggtcaagaagttcacctctgttaaataaatatgcatagattttcaacatctcttcacatgcattcagaggtgatgaaagattccactggatgctagaacattgtgcataaataatcgaagttgtatgctcttcagcaatgatgctaccccatatcctttttttttctttcccatgatatgaggatatgagtgcagcagaactagctccatgcccttgtcccagaattaatcattcctatccatatttgatgtctttaccttttaaatatttatgggctgttatgttcctttcttgttgttcacccactctggggacattcagaagcctcacatttcttccttagccaaacaccccattcccttcatcctctctcagctgttctttggattacctccaaattgcatacataattttggtattgaggtgccaaaaatgcatttgtttcaactggagttttattgaagttgcttttactcaaatcaagtacacaaataaatttgatttccaaggcatgaaaattcagttaggtctccgaagggaagctgaggtatacttatatttcattataatgctacaggtagattttaagtcactaggaaaatgacatctcaaaatcaaaagattatagaatgagcactatatgaagaattacattttaaagcataggtctgtgatcattttgtaggtttttgttgttactgtcagtctattggtttttattaataattttattgaggtataactgatacacaaacgacatatttaatgtgtacaatttgatgagtttggacatatccgaggactcatgagactgtcactgcaatcaaggtaataaatgtatttattacttccaa

SEQ ID NO: 2082 - DNA, 89733 bp, Homo sapiens
gtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcaggtaaagttaaaacattcagtgcctattaatggaatttcatatttgcattttgatttttaagtagaatacttatggattgaggatgtgacttttctaccatatttctatatattctttagcaatctgtcatgagaattcatatctatctttttcgttttgtgggtggctgatacatgactgctgtaattattttgcaacccaggcttttagttccttatgcaaacttagaacataacaagaatagtaacctatagataagctagtatttttccatatgtcttggattatctgcaatattaccaacaacttcacttttgtatacttaggttagttaatcaagattcagaaattactggcattcaacaaattatgtcgaaaaggaattggatgaactttgtattctttttcaaaatgattatatttaagaatgaaaacaatgaattagcaaaacaataagccattttacaagtaaaagtataagatgatatgaactctcaaaatttacggcattatatagtgtgaattcatattaagaggttaaacagtagtctgatggaaatatataaatatatattctaacatatattggtaaaatggatgcagatttttagccattataaatcagtttgaacgaaccatggtaattaatagttaaaaaaatagatcagcatcagcaggacatggtgacacatgactgtagtcccacctatttaggagtctgaggcaggaggattgcctgagcccaggagttcaagactatagtgtgcaatgatcacacctgcgaatagacattgcacgccaacctggacaatatagtgagactttgtttttttaaaaaaataaaaactaaaaaaatctgcaaacagaacatatgtaatagtatatcaagtctgccatgtatagatcttgcagatttttcttgtattacatgcatatgggttctaaaagacccacgagaggttattaagacatttttatccgtatcattcaggaataatctctattgcatcttctgtatataatttggagggttattatattagaggtgttggttgtttattagaattttagcattgcaggtgatatttgtggattttctaaattctagagaaataatcttgagctcataaaatttaatacatcttagaaaagtgttgggacttaactaaaacgttgcttttgaagtgctcagacagactgaatgtcaatagaaaggaaacaactctctgactatctataatataatgtatttaaaaactattctaagggccaccttaaattacttgatgtacctattttatattatgcactttggaaagaactgaaattgtagttccatccccccaggtagaaatcccttctctattatttttaacagataagtaagctctgttttgacatttccatttcttaagaaattccacttatctgacctacaaatatacagacttaaagtctgctttacatttggctgaaatctttcggcctacacaatgtattagatttcttcactgaccagcctttttgtagaaattctggtcgggagtctaaagtaccttcatctttagtgaattcttttgctttgagtatgcagtagcaagttaagagcaagcttcttggtaatcctgtggaaaaatgttaataatttcacattgtcttccgaatagcaacgaagatgccactgagattactgattcagatttttgaccataatctctggcatacacatttattcttcatcatttcttactttgtcagtggtgaaggatgtgaaattttgtattaattcctggcccacatttttattctggttgtctcagttacttatgcattttcatgctgtaaggtccttagacaacaattgttataaaatattaatggcatattttcagaacatctgaatattattcatttatttcagggctctagagcactcacaaataaatgcaactaaggcagatatccaatttgaatgtcaaggagtctggtgtctctgtaattggcttaattatagaggaaaggatttataatgtagaatatatattcttataaacacccaaaggttattagctccgttccccaaataattagttattgctgagcctttacaaccttagcaaatttaggaaagaataatgttctaataaacaagttgttcacaagttattagctgatatctaagggactgtggccactgtgtatcatccctcaccgtttataactgcaataaaatttaaataatatgaatttgcaataagctcaagtcctgctctacacagaaatagtagtagtcagaaacaaagtaaatgtgaatgaaaatacagacattttgcatgttggtttatgaatatccagtagataaacactgaacttgagctaatatccataacctggtaaaactcacttatcagatttatcgggcaataatgaaaaattaaaaaaatagaattaatagaaaaaaattagagtttggaaaggcatttagtttttattctactctggctgtcaatgctcaaaatgtggtttccagaattcttggggtcccagggacacatccagatggtctgtgagattaaactgtttttatcataaacctaagacgccattttttcattttcactgcgttgtcatttgctctgatgatacaaaagtaatgagggctgggcgtggtgtctcatgcctgtaattgcggcactttgggaggcttgaggtcaggagttcaagaccagcctggcaaatgtaatgagacctcatctctaaattatatatatatataaaatatatatatatatatatatatataattatatatatatatataaaacgaatagctgggtgtggtggcttatacctgtagtcctagctacttgggaggctgaggcagtaggatcatttgagcccaggaggttgaggctgcagtgagccatgatcatgccactacattccagcctggcactggcatcaaatttactggtagtcaggtgatatttaatgtccatatactcagagtaaaaaactctcaaaacaaagcaaaacaaaaacagttttgcttatgattataattgttgaagcacttaaaaattattaatgttattaattatctaccttggaatacatactttctaacattctagtgaactgggaagtagatataaaataattctgctatgcgtcaaagtattatgacaatctctatttcttaattgcatcattgcttgagtcctgagctggacatcatctttactttaaagttatgactgacaaattatggttgttcagatagatataggtcagatattttcctgaaagtgaaccaagtgagcccattcatttcaagataaacaactgaccatatataaggtcattgattaaatgtgagtgttcaagaaaacattagaattgtggaggacatgtattgtccactgtaagcttgagagcttcccgatacttaatactgctgattagatcagtggcaattctaacaagtgtcaatttttgatattctataatgaaatgcatcaatgtttggaagacacaaaattcagtgagcgggtattttttccaaatgaaagctccatgatgttacaaaatcatttgtagattaaaaaaagtaaaatggtttaatggtacacagtatgaaaagttgattgatagggtttagatttcacatttcaatgaatgtttaaaaaactacacttgtatctacaatcatcagaaaggactctaaaatttcccatcattttttaactacgttatctgtgtacggctggattttctttatatctttgaacaaatcaaccctatttcaacagatgaaatgcagaagcagataaaagaatccatctgccttctcaagaaattgcagagatggcctttagttctagccactcgaaaggctgaggcgggaggattacttgagcttgggatttctaggctgcagtgagcaatgatcctgccactgcactgcagcctgcatgagtgagcaagaccctgactcaaagaattaagaaaaaagcaattacagagatttgcaatcatgtaaagtaatgcccttcttctcataatatttaaaggttttcataaaatatgtgatttactttaacattgaattattttaaataaattcataagtaaacattttgaaagacattttgaaagactttttcagtttttattcctgttatagtaaatattgttagctataccccacatgaacaaatgctctttgagatgtcttgtaatttgtaagactgcaaaagagtcctgagaccaacacgttgagaacaatttatctaggctaaatccttaatattacaaatgagaaaacagagagtggttcagggcctggtccaatgtcacaggttttagggcctcatttgcaactctactgtggaatagtacttatttaagttaggctctgtgcctgtctccaaattgcttttctcatactttatttgccaaagtcaggtccctgctgcgaaacagttttcatttccttgtgaatcaaccctgtctttttattagagattctaagaactgtactaaaactgggatgtctccttttgaaaaatattgagtgctcatcagcagtagatctttacacacttcatgatctatgttttatttcaaagcttaatccaagttgtatttccagcattagtaaatttattttatagttgtaattctcagaaatgtaatctcgctgctctactaggtgagaggcaaaatcacttcctactttatttatttatttatttatttatttatttatttatttatttttacttttatgaaagagtctcactctgtcacccaggctcaagcgcagtggcttgatcacacctcacaacagcttcaacctcctggtctcaaaattaatccagttaatttttacatttttttgtagggataagagtctccctatgttacccaggttgttcttgaactcctgggcttaagtgaccttcccacctcagccacccaaagtgttgggattacaggtgtgaggcaccaagtgtggcccactccctactttttaaaattgtgtttgtcttgtagattacttatcaaacactaacagagtttgtcacaagaggaggggatatttgaatatgaagaatctattaatgccattatgcatcagttattattatataataatggttattagtaagttaaattctctaaggaaacagaacaaaacttccaatagataagtgagaaaaggttataaaatgaaaacataaatgaggaataacaaacactaaacaagcccatgaaagaacatttattacccaaaaaaaaaaagaaaattaaaataaagggaataaggagtttatattttcctttgtaataaatgctaaactattttattattttgaaatgttagcattcactggtggcaaaaatatagagaaccactctatttttgttatttgtgtatatattctgtggtgaaatgatatttacaatttacccagagtaattaccacttgtgtccatgcctggaaatttatcataaatcagtaattcaaaaaaggaaaaatctatttactcaaaattcctattgaaatagtttacctggaaagaaaaaaaatggataataatctaatgaccagtaatagaattattaaaaattatagcatatcagtgggaagaaataatgtaaaagcagtacattaattataatgtgtttatagaaacacggaagattacaaacagaactttcaaagtgactgaactaagtaaaaatgcatatgcatgctaacatagattgaatgccaataattttaataatatatatttttaaattgtgatgacatagcaacttttcttctgctataaaaatcattaaattattctgggtttaaataaaatgaacatatattaaaacatgaaatgatggcagtgaagtgtattccttagaagtaagtacatgttgcaaagagagagtgagatttattctgattttcacttttgtatcatcctttcacttatcagtatacaaaagaggtttaaagtgttttcgctatagattaaccttgcctgctgtttgaatagtgtgtttttaagtacatattttaatatttagttcaacaggttccaacaatcataaaacagtcaaaagtccaagttgcctttcccttcgatgagtattttcaaattgaatgtgaagctaaaggaaatccagaaccaacgtgagtattgtttcaaacgaagtggttctttaaatgcgtgctgttctttatgctgctctttactcttaccatcacaagcctgttggactatgaatccacgcatgattaaagctaagggtttacaaaaaatcatatccatgcaaacaaaaaaaaaatttggttatttcacatatgtttttctgccacttgaatttattttgaccataaactaagggctgttattaaaatacttagagtagtctttggtacagcagaaatactccacaatcccttagtctacaaataaataaggtagctgaaaactagaagatcctttattctacttagtaaaatgtagcatttattaagtcaaagtttgtaaataccattctatacatatttataattgtgcgtctttaaatttaaacatcttattttgtggataggttgttacttgattttttttaagttgtcatagaaatattgtcatctcaggtggcagagtactattgcatgatatactactatctagtattattttattttagaattaaataattgttattctaggtgaccataatcactgatgagctttttcaaaataccttctatgtttggggaggaagaaaaaaatgtggatgtattggaagtgagaagggagaggctgtgggaagaattcccaatattaaaactctacgtgattctaaaatggaaagcaaagctacatacttttattattctgcatgattatcttatattcattaagaatatccatatttaatgaaaattgatgattttcaattgtatcatgactattattattgcctgatgggttgatatttaataatcattagtgacccattaacatgctaaattataattatttctatgtttaaccaaatggaatatattcaatcaaaatatgtaagtatggatagaattacaatggaattaaggataatttattcaatcaatatggatatattgatcaatatcatgatatattaatattaattagctgaattattatgtcaaaaggtaataccatacacttgtcaacagtgaaatataagacacacagagagaagtaaaataagtcaggagggtggctgggtaggcctactcctaatgagaatacatgtccattgaaggtttgttattcctgttggaagaataatcacatagattagtgtaagaatatggcgtcctgaaatatacccaaatttgcatgggtaattccaatatacaatgctgaatacaatctaattgggaagtcattgtttgtctatcagactgataaagatttaaagagacttcttaatgtcattgttcatagaactgacactctagcatactggggtgggaatttaactgtgtacattttttttctagaatataattttgcaacatttatcaaatactataaaaagtttttaattattggtttattaatcttatttctaaggaactggcatattgaaatatttggacaagtaccaaagaataaatatatagggttgtttctcacaatattgttcataaaaggaaaaacattgaaatggttaaaagtaattaaattagtaaccatatgacagaagataatgtagctataaaaattgtctttagtatcattataataatggaaaaattcagttggccaaattatatattcagtgtggtctcaaatatgtgacaaaattctaaaaatactaataggaaatattagcaagtgtaataatactgggcttatctgttttgggattttgagtgagttccttacacacacaaatacatgaacagaaattatatatgtttcttgtagtctccagaatattaataataatcttgtattacctttctaattaaaaataaataaataattttaatttaaaaaagcaaaagctaatttcaatcttaatcctctcatttatcaagctgttttatggacagtaatatttctcagattcttctgagacccttatttatatcctgttatattccattaagtatatactttttatcataaaatgtcttggttttgtcaattttatgcaattgttaataagtactctaaacatatgtcattatttttcaggattattaagttcagttttatgttttagattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatcaacttatatgtgtcttgtattttatttataaggaaaaatttcctccaggtcttgatacttaaaatcggatgaccttagaaaacaacataatttgactctgtttcagtaaccttatatctaacatggaaaaatataatatctgctttgccttataagatgagaattaaacatattattagttaaacttggctaaattctatgcagtaatagataaccccaaaacctctatgtaaacataaagttattccccgataaagcaatttactgtgggcctggcaactctttcatgcagccttcttgctgatcacagctaatggagacatcgtcattctgtggttgcctcttgtgaaacatgccattttggtcaaagagtctgggacgaaacatgaaaaattgtacactggctcttaaatgcttctgacaagaagttatgcaggcaactcctactcatgttttgttaggtggggcaaagcaagttgcatagtcccatctaacatcaatagtatgatgctcattaggaaaggagaaacagctattggtaatgttaaccgtaaataaaatttgtgtaaaactgcaagacactttgttgttagaggtgtatttatcagtaatcgtcccctgaagtagcgtactttattcatagcttatttgccctatgtgcatgggatatccatgaccaccttttatattttatcacgttttccccctgttcttaatatatccaccattacacaattttagccaaagcctttatagagtaaattggtaagtataaaactgtcagccagcttctattcggtaatttcttcttttagagtcctagatatgaaagtatttcaaagaaagtcctaggacttgcaaaatatgaacacttgattctgggggtgcagaatggccacaaacttcagaaaaacaaatgatgaatctttaacccaaaagttcagagagggcattgtatttaaattgtcctaaagtccttatataattctagaggaaggaatataggtcaaatttagactcggaagtaaggtgtgcatcttaaaatttataagtatgtacactaaaattataagaaaatagtattatcacacaatgtggttgatgcagggaagaaaaaataaaggagagaaaaaaagtaagacaagcagaaagaaaaagagatagaaataaattcaaatatatcacaaatgaaagacaaaagtaaatagaataaatgctctgagttaaaaaaaagctataaactttttacaacacatctatctaaaccttaaggatacagaattgttgaaatgaaaaagacagaaaagatatcccagacaaatgctttccaaatgaaggtaggtatgaccatattaatgtcagtcataacagactttatttgtaaaagccttcatggaaattaatttactagacatatataatgttaaaatacctgaagcaaaaatagaactacaaagagaaatagacaaattcaccataataatgagatattaacatatctttttcattatttgctcactcaagcagagaaaaacatcagtgagcatatagaagatttaaagaatacaatcacaagctccatctaatgaaaacacatagaatattgtaactaacacggcaaaatgagttttttcatacacatggggtaaaaggttatatttgatgatatattgggctatgaggaaaatatcaaaatgtaattaagttagaaatcaataataaatagaaaacttaaaaaacttatatctttgaaaactaagaaatacatttctaagtgagtcttaggtcaagtaccaaatggtaaggaaaatagaatatattttgaagtgatgacagtgaaaactctacataacaaaacatgttgaatgcagtgaaagcattatttagagggatctttatcattttaaagacatattagaaaaacataaaggatgaaaattaatgatcttagcttattaggtaacataattttaggataaaaatgaatgagctaatttaaggcaacagaataaactggagtgaagggagaaaatagtataaaagcagaaaataaattcaacaatgtggtatgtaatctttgtagtgaaagtatccatatttattaaaaaaagaaaaaatctagacaaatagaaaataagtaaactatttctatttattggaagaatctatacacttaaaatgctcattctcaatgggttgatatatagaagaattgaaatcagaacgcctatagtttagtttttgtttctgtttgtgaaatgtgaccagctggttcaaaaatatctttgaggaacaaagggcaaacttcagtagaaattattaaagaataacaagtcataggggattcttgttttcagaaatcaagattcagcttaattcaggaattaagccattatggttctgtgcagggttacacaaatcagaatagcatagtaaacccagaaacagaccatcacatgtgtaaaaatagttgagggaattggcatgttagcatggatctctctctctctctctcccccactctctttactttgaactaaacattgtggaacaattgataattcacacagagaaacatttatatggacttccacctcatatcatataaaaatcatctcagagtggataaaaggctgaacagtgaaaggaaaaaatgttttaaaaagtgagactatttgaacaatacgtttatcaccagggtcattaatacagagaaagatttcttttcctttcttttcttcctttctggcttttttgtttgtttgtttgtttgtttgtttgtttttgacaggaactcactctctccaggtcaggctggagtgcagtggtgcagtcatggcttcatggctcactgcagtcttgaactcctgggttcaagtgatcctcccatctcagccttctgagtaactaggactacaggcgagtgctaccgtgcctggccaatttttatttttatttttatttttgtagagatggggtctcactatgttgccccgggtggtcttgacctcccagcctcgagcaatcttcctgcctcagtgtcccaaagtgctgggattacaggcatgagccaccatgcccagtgtgggatgatttctttagtcatattaaagcctcatgaaggaaatcatcaagaatacattctcctacatttgattttagatcctttttttattgaaagactctaggaagaaagtacaaacaaaaataagccacaactcagataaaaattattgataatgcatataactaaaaatggtatgtattcataaataattttacaaatctttataaaaaaggaaaaatgacaaagtggcaacatatataaacttgaacctcagactggagggccaataaaaatgtgaaaatgtgttcaacctctttagttaccagaaacagacctattgtaaccctagtgataaaagcatttgatcctacccaattgggaaatatcagaaaatccaaaagtaaaaattttagattgcaatatacatccaacagaatacgtatccactactgatgacagtccagtttactgcgtgatctttggaaaacattttctaatcccctccttcgttgaagatgctcttacttatgaccaaacaattccgttccctagctcatgtgcatgtgcctcttgtccatacataccaggaagatttgtggtcacattgtttatatttaaaaatatgctggaaaaaatacagcagtccactcaaagtagaatggatcaatgcattgtgctctattcataccaaaaatactattcaatagtaaataaaacgtcaagaatatgttgagcaataaaagtaaatcttggagaaagtttgaaatatgtaaaactgactacaattttgattggtataattttattgttaaattataatgaaaaataagagaatgataaaaacaatattcatggcagtaattacctgtaatggaagtaaaaattggaaaatggaagtgggggttgagatcagcacctgacaaaaaggtgatgacgatattcctattttgtaaaatgggtagtaagtgaatggatttccattgtgtttctttctttctttgtgttttttttacatttattctataaacaattgttttatattcttaaaatgagtaagtgtgaagcatcccgtttgtctcaagtggacatttctgagttactgagatattttagaatcagaccagtgacatgtcaacctgaaaattgttctcaggagtttggatttgaattgactttcagtaggaaatgtccatgaattctggattagaaagtattgctatgaaaattgtggttgatcatcgttaaactgtatattacatttatatacttcactgaaataagttaagaccagagaaaaggacagataaaatatcttttgtaggaggcaagtcatgaggatgattcctaacctaaattctaggggttgctatggagacacaaaggaaaaggcagcagctagatctattgcaaagaaaggagcggcagaatttggtttaagattctgcaattaaaggatttcagtttttttttctgtcattatctaggcagaccaagtgaagacatgaacaatataaggataattctgaccagaatatgatatgagagtattgtattaagagctgggagttggatctgagctacgttgttggataattgctctattttttttattttttttttttgctgctgctgcagaaaagagcaaaataaattaggtttcttatgcatcatttccagcctctcctgaaattacttcatcatctgacagctttctgcaaccatctatatattgaatagtaacccaacccaatacttaggagtttataaatcagagacaatttaaagcttcctacaatctttaatcgattcttctcttaaactgtagagaattggttcttctcaaagattgatagaaactttgtgattcaaatgttacagtttctacttctcaatctcctgttaacaaacagaaacctttgtatacaatgtccagttttctattttcaacaacattgcagttaagtttcctagggaaagagtgaaagaaacaacaacaacaagaaccaaacaaacagaatgtaccatttttatatacacgaaaaactatttaactaaatgtattatccaagacatggcacagggattttgtcagtgagttattcaacaatcttcctgaaactcccataatacaccagccactttctagtaatttgggatttaacagtgaataaaaacaaagactgtcctccagaaatatacatcctgtgcatgtatatggtgattgggtctggaaaggaagggagctactctcttgccttcattatccaactatcagtaaggttaaaatgataatataaataatcctaatttgactgttgaatactactcacacttcagtgcacagattagatttctccacttagcattcctggcctattccagcctagataatttttttcctttttctgagtttttaaacaacttgtttgtttgtttgtttgtttttgttttgagacaggatcttgctctgttgcccaggctagagtgcagtggtacaaacatggctcactgcagcctcatcctcctgggctctagcaatccttccacctaaacctacccagtagctgggactacaggcatgtaccaccatgcccacctataaacatcttttttgaagtataatttacatatcataaattttacttgttttaagtgtataattactagtttttatacattatttatttatttatcttagagatggggttttgctatgttgcccacactggtcttaaactcctgggctcaggtgatcctcctgcttcagcttcctgaatagctgggattattggcacatgacactatgccccaccaatgacttttttagtaatttttttagtgaagtatcattataatgtagtattaaaacatttccatcaccacaaaaagatttcttgtgcccatttgcagtcactctctgttcccatctccaggccttaggcaaccaccaattaattttctgcctccttaaatgtacttttctggacatttcatataattggaatcatgtatatggtctttttcatatgtcttctttcacttagcatgttttggaggttcatccatgtagtagcatatatcagtagtttatttctctatattgctgaagagtatttcactgcatggatatcatttcctgttaatccatccaccagttgatgaacatttgaattatttccacttttggctattataaatagtgatactgcaaattctctggggttattaaagcatttagttgtgtactgttagggacagtctatcaattgtcatatgtattaattaggatccttaagaatgagaaaaaatatcagacagactgtcatatccttcccgttctgcattgccttgtagatgtcacaagaatgtgtattatatttatttcattgatttattggttgataggctgaaaaataaaagaatgaataaaagtaacactgcaatttgcacatgctattaaaatagtctacgaaatgtctgacaaagatgaaattttctatataataatttaatgaaaactaattagaaatattcatgcactaggtttctacatttgtgttaacatacttcctcagattcctcaggacaatttccttaagataaaccctggctttttaccaccctgattttggagggggagtgtaggaaacctggatgttgtagcctgtgctaaattctcctaagtgcaaatcaacaaaaacagatcaatttgttcaattaagggtgcaactttgaattctaaagctttaattaagttcgaggattttactctgattcaccaaagtatgtgaatgcctgtaatgaaatgggctgaactgggtgtccttccttagcatgaattcattatgagctcatggactgaaagccagtgttatttctctgtagtcctaagtggattaatgggatgttctgcaggaaatgggaatcaattaaatctctttaccaaaggaaaccggagttagaggtgataaagtatgtgcactcagtagcatgcagttgtgacaatgatggcagactgtgagcaattcgccaagcatatttaagtgaaatgtacggccctggaaagctcaccaggccagtcctgtaaacggagtgccaagtcaaaatagataaagctttttggtataggaagattcgtccaatgatggaaaaagggaaaataattcaataaacacatcatatgttctacatgaaatgaacaaatgaacaggattttcttccttctgtccttctacctcctctgaaaatgttaattcaaataattgcacaaagtcacagaagttgttgagatgcaggctatggagaaaatcaggagcagcagcagaagaaaactccctgtccctttggcctaccttgtctctgtgcgtttggctgtaccatgcaaagtgaaaatatttgaggagtagccaagatgtattgaataatttttaagtgcttgctcctattttaatcgattcatgtgaaatatttaaatttcaacataaatcaaatgagttaggtgttattacatttcccacttatgaatgacgacactgaaacatattaagtagcagattcaaagatcgcataggaagagaagccaggacgcaggcccaagcagctgacttcagtgtttatggataatctgatgctacagtgttgtctgtactttgagactcaggtaacacatgctacagatgagcaaaaaggcattgtacttctttgttgaaaataccttgatactagattacagtatcatctagaaataggaaaatataaggaaaccttctattttgttcctagagtgccggagaatctgtagtgttgcataacatggtagcggttaagatgccagtgttttttggtttttgtttttttcatcacagtggttagttagcatgaattgtatttagttaaatttccctgatggcatttcactactactcttcactattaaacatgttggcatgatgggattacacagcttaggttttattatatctctacccttaagaagcttctaccctggtgaggtgtttgaggagcctagagagatgaattcaaaggattctaagacaccaaaggaaaacaaaatgagatacagaaaaaggtaaagatattggtctgaatctttgtaaccagttagttttctagtgcctgggctagaacctagtttatgctgtaggatatcctatagatataaattctgttttcagaagtcttctttatttcaggaatgaagatgctatttttctgtatattatgttgaaataattgggatgatgagttttcaaaactcattgacagcatctgaagtcatagagctcctgcaaattttgtatctgcaggttggttgtgccttgatagttgtggtaataagactcctgtgcagctagcttgtctgtagggaagtgtttccatgatggatttcaactggggaagttttcaaaaacctagatgtgaatatatttgaatgtcacttatacccttggtgttagttgttgctagaaatctgtctatgacactgaataataaatgtgaaagcctaatggagaagagtgaaaagatagatgctgtgatatgcttgctttgctgatgcaaatggattaatagtggcattagatagaaaggaaattgatctcatctagacttggttataatgggatttccaaacattcttttgtttttgtttttttttttttttttgagacggggtcttgctctgtcgcccaggctggagggcagtggcacaatctctgctcactgcaagctccgcctcccgggttcccgccattctcctgcctcagcctcccgagtagctgggaccacaggcgcccgccaccacgcccggctaatttttttatatatattttttaaattatactttaagttctagggtacatgtgcacaatgtgcaggttagttacatatgtatacgtgtgccatgctggtgtgctgcacccattaactcatcatttacattaggtatgtctcccaatgctatccctcccctctccccccaccccacaacaggccccggtgtgtgatgtcccccttcctatgtccaagtgttctcattgttcaattcccacttatgagtgagaacatgcaatgtttggttttttgtccttgcgataatttgctgataatgatggttttcagcttcaaccatgtccctacaaaggacatgaactcatcatttttatggcttcatagtattccatggtgtatatgtgccacattttcttaatccagtctatcattgttggttccaggacatttgggttggttgcaggtctttactattgtgaatagtgacacaataaacatatgtgtgcatgtgtcttcatagcagcatgatttataatcctttgggtatatacccagtaatgggatggctgggtcaaatggtatttctagttctagatccctgaggaataacactgtcttccacaatggttgaaccagtttacagtcccaccaacagtttgaaagtgttcctatttctccacatcctctccagcacctttttttggcatttttagtagagacggggtttcaccatgttagccaggatggtctcgatctcctgaccttgtgatccgcccacctcggcctcccaaagtgcaaacattcttgaaattctgcttagctagactgttatgtgcaagttgattctgatccctttgcagagaggccattcaggatcaagtccagtcttgttgaaacaaagttaagtgatttttggttttggtgttgatgaagtacccatgtgaaatatattggcaagataaaggagtgtaattacctcatttaccgaaaaaaatatttttttaatttacttttaaaaatattactgttgtccaaactcagcaatgctaatgtttgtcaccagataaacacagtaaatgccactggttggatttatttttaaatggagtcatttctttatctgaattgaggtagacttcatgttagctgctgtgttatagtaattaaagttcacatttatctgtgagtgttaaaattttcactttttatcgtgccatcaaactcactaaatagtttcagagtcaaaggataagacataaaaaattcctgaaaaattaatgccatttatatatcttctaaaaccttaaatttattgatgtataagtatgcgtccctgttttccaatattcattttgtatttagttaaaagctgttctgaagatttatggcacgcgatagcagttttggtagagttataaattttcttttcttttttattgttggtgccttagaagccagttgaattacaaatttacattttcagaattagaattgtataatctagatttaattaatgcaaggatgataatgcttcagtggcagtactatctgttcgaattgctaggttttttttaacgctctcagggagcagctctccaattagggatttatacatcttattaattaactactttacaatagatattatccagtgaactgtgtattcatattagggactgtatagtttgcttgttatcgaagtggattacatgccctttccattttctaatccatattttatttcctctgctgcctcttgtatctgagtatagatagattcaccaactacccaacagcaccactgacttcaatgccagtgtttactgggcttaagttacagcgaataaaactaaataagtggttcaatttggagatttgggtacataaacgttttgtatattactatgccttatgtctataaggtgtactttctgcaaaatgttttccatagcatttgatgtcaatcaaagccgaggctttaccaaatagctggcatgatgttttatctacaagctcttaatgtagtgaatatactaaacatactttcccgacttttgagggaaatttcatgctacctatagcaaaaatgtgattcaaagatggttgctatttcaaaaatgtttccagagactttctaaaaggaatcttatagaacgagttgagcaagaggaaacccactaaaggactgtcacatggctgaatgtataaagagaaccaaagtctgccttccgaaattgcaaaggcagtgtaatagccacaccgccccctgcaatgttaagccttggaaggtccttgaatttagacaaaaagcaattcactgtaaccagctggtgcatcgataagagaaatgtcagcaaattccctcaacctctaaaggcatggatgggggttgaggggctataggacaaatatataggaagtgcacaaagcttctcaagaagaaattttacagtaaatgagtaaacctttatatttccaagaacaatgaaaatcggttgtgaatcataatttaagaatgaaacatacaaataaataccttctaatgaattccatcaagttgggactgttataactgccttcctaagatccttctcctccacaagagactgtgtaattctataatgcaaattcccccaccaaaagttgaaagatatcaatgtaatgctcaggaagaatacattttgaatatccttataaatatcaatacttccataaaaatattaaactttggtgttagatttcaaattctgcacaattctgacttatattctgattataactgcattgctcttttaagaaattgactccagtgtggggaggaaacaataggttgaaatattgacaagtctcatttcctacatcaattccatttcatttaaatttttatttaatgggagtaatttcaatgtggctggctctttttgcaacttaaagtggtcaaatttggctttccattgcattcttaccattttctccatatgggctgggaagtttttatttagtgtggttaatgcactggctggaatatttgccaatcacattcaaggccttcccaataaagcgagagatagagaatatgcaaccgcccaaagtgaaatcagtgtttggagaaaaagatttcacatctatcaaagctaaagcaagaaaatcctgtgactctgggtttatatctctgctcagagaaatatgcacaagtatgttattgccttattgttgtcgcataacaaaaacattattgtctggggtttcaaaatgcagaaatatttttaaagttgtgtaaagatgcacaccagtttcttaatagtatttaactctgaaggggagatgtaagaaccaggatctgtagcatagaatttatttaaattgctgaattttgaaaaaaaagaacatattaagatatttgttgttatagtcaaagttaattttaaaataacacattaaaatgattttttacaccaggtgttccaaaattcccaaaagaaaaaattgaccctcttgaagtggaggagggagatccaattgtcctcccatgcaatcctcccaaaggcctcccacctttacacatttattggatgaatattggtaagtaatgctccgttccatcaaaaaagggggacattttaattctatccatcatatcaataacataatgaatccaaagacaaaataaaaaataaagatctcttaattttttcatatttgaagaggagatgctactaatatgataagatttgtctgtgaagacaatacttcctatatttcaaacagtgcacttacctttggaatatagatcatgtgaaagctgaggatggcatgggtttgtgttgctagcttcatctttctattttagtaatgctctacctgctaattgcagtcacctaccaggaaattagtattaacttttttgcttaattttctaaaaggtttgctgactctgatctgaaaatctagctttgtaaagtctacttctagcatatgccttagcagtgatctctacatgttttctcattgtgaaccatagagaaaaatgctatttgcacagcactcagaagaaagcaaatgaagctactcttaggtacagccaattgttccagacatcagttcccctagaaccttccaggctgcaaccagaacagggagattaatatcacggataaaacttttggagagctttttgttttttctttttaaatcatgttttaaataaacgtgattctcagaaaatacaagtgttaattaggtcattgtctgcattgatcagttttcagttcagccaattcagattcatagggcagaggtggagacaaagatggtaaacagagtttaccactgtttgtctactggtggacttctttggttaatggtaaaaagtatcctcccaagggttttgctgctgtttttgttttgttttgttttcctatttgctcattgttcctgtagtaagaccagacttgagaggaattaaagagcaaacaggaaaaaccaaatgaaataataatgtaaaagaaaatgaaaaaggaagatgaagcacagtaagggacaattgcccttttcaatggcaagatatctcttttcagaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttgtaagtccacataatttatcgtttcatcatgtatgctgaatgcaaatgtgtctgtaatttccttctggctgaagccatttaaagctgggttgatattttgcaccattgtgcagttcaactctggagacttcttccagatgaaatagacatctgcagctgcagattcacggtagctctgtctctcacagccaggaaatcacatctcaattcacaggacaaatgtatttcatctgacatctgcaggatcttgtcattttcagtggatgaaatatacaatgaaattccagggttttctaagcaaatcttgggcatcgattcactgtgatcttggataaactggcagactgaaaatgggggagaaaacaacagaggcaaaaagatggaaatttgtatcaccaaactggcaaacttacttgaatcaccctttcccgacttgattctgtggaggccagcctgggttcccaaatgggaagagtaattagagggaggaagaaccgtaagattcaaagggaagaaataatccccaacagtttgctgagcgaataattggccctggtatagttgaaagttggcattaccatttcattgtttaatttggtccatgattttttcatttttatgtgtagatatgccatgccagggcttcactataacattcttctagtagcctcagttctcttcagtggagctataacttgaatcttctccacctggattcaagattaaactcactataattattttctatgtaaaactatattcccaaaggcaatgttctagtgaagcatggttctacatcattttgtaatttttctaagacaaaaatatgacttttcattctttattgatatcagcatccaccattatgtttgtgttttttccttccgtttttttatttcagtaaagcatgctaatgactcaagttcatccacagaaattggttccaagggtaagttgaacccatgtggagtgttggcatttgtgtatagctcattgtcatctcagattttgaattttttctttaatatcctcttaagtttattacaatactgttattatgaaaaacatctgaacttagagggttctattgccccccatgccctcttaaatatatgcaaagggagtgatttttataaatatataactgtataaatataatgaaatacttatatataatgcattgaatagacagatagagatatttaatggagtaattattttgggtctcccaaaacgtctcttatggtatataaggttgatacttttgcagaaagaaaagaaatggttaagtgtcaaaagacgtagagaaaacactgcgtttaagaaagttaagtggatttttttcttgcaaggctttttgaaatatttgacatgcaactgtacattgtggctttctgagaaaaaaacagtttgtagcatttttcaagttcatgtgtctgcgtgatctttttatttaattctttcccccatagaacgtctaccagaacttgtgttctatggaaaatgcctgagtaaatctgagttgtatagcaggctagttctctataatgagaagagtcagttacataattgcagcaaatattctctataaaatgtggaccagtgataacttagataccttgcatacttgcaagttcagtggaggaggatgtaagctccttttgaagaaccgtcagttttaaggtggactgattcatccccaacatcatttcctttgagattaataactcacacatatatagtgctatattttcacagcactcaatgaaaaatcattgcacatagtacatattcaacaattatttttcaaaaaataaacacgaagtatagaagactgtctactgctaaagtccctttgaagatggaagtcttctaatttgccattgtatttgaaaaatattcttaagaaaataagaaatgggacacttcaatatgcaggtagtgaggatgcttactagtcatttcctaaaactgtgtttttctttaaggagctgagactacaggtagagttgccgaaagagcttgataaattcatagatgcctagtgtctaccacagccttcctcagtgagaatttctgagtgcaggagtgaggaagctgtttttagcagaaacctcgttaaattcttaggcaatttaaattaaataaaaacataaacataaagtcattgcacatgacatgattgaagtatagaatataaaatcatagattttcaattaaggacttctgtttgaccttctgagttagcagatatggtataaataataatatttataaaattttgcagtgctacgctcagtaaaaacatatgagggacaacccatgcttcatggtaagagagaagaggagtctatttaaatggaaatatgtgaaatgtgtatagaacacacacacacacacacacacactcgtgtgtcggattttttgttttaagaaagatgtggtgtcacagaattttatgtatattaatttgaaaaaattctgacttttcttttctattttgtagcaaattccatcaagcaaagaaaacccaaactgctgttgcctcccactgagagtggcagtgagtcttcaattaccatcctcaaaggggaaatcttgctgcttgagtgttttgctgaaggcttgtgagtaacctgactctcactcatgactttgtccatccagttctgtaaagaataagacatcaagcacattaagactgtgcttgcaaagatattttaaaattatttccttaaaaaaattaaattctgccgggcactgcagatattctgctcaggactgttattccaggtacttaagaggctgaagcaggaagattgcttgagcccaggagttggaggctgcagtgagctatgataatgccattgcactaaaacctggatgacagagaaagacctcatctaaaataaaatgaaattaaaattaataaaataaaataaataataaacataaattctgtcattatatctctggaggaagtaatttgtacttcactctacagacttcaggcagtaacaggctcataaaattagatctctctgtcaatttatgatattgtggatggaggggatgatgataacattctccttagttaagtttaagaagcctgaggttgttggtagtcagtccctcacttttggtgctgagttttctctctatgctatactacttgccccactcctgtttgctatgttacttactaaatctgctgctttgcaggttccaaggagccctatttatatctatttttactctgctgccctttgcacacatggaggtccagaccatgtaatttaagagagttttacatcaaaatctaattaagtgaactttctttacacctgaaaaagcaatccatttatttatttatttatttatttaattatttattcatttattcatttatttatttttttgagacagggtctcactctgtcacccatgctggagtgcagaggcgcgatctcagctcactgcaacctctgcctcctgggttcaagcgattctcctgcctcagcctcctgagtagctgaagctacaggtgtgtgccaccacacctggccagttttttgtatttttagtagagacagggtttcaacatgttagccaggaaggtctcgatctccggaccctgtgatccacctgagttggcctcccaaaatgctgggattataggcatgagccaccgggcccagcccgcaatgcacctttttaaatcctccaagaaaaccctaaaggacctcacttggtcacctcttaaaattgttccatttattaactactgttaagtacatgtaaacagggaccatcttatttaatatttaatcatacagggtctcctatttttaccactatccttccgaacttacggtccttccctaccattgaggataccttgggaaaatgcattccagcttcctagcacctgggattactcatttgaaatataatctgttcgtaagctaagggctttggggactctagttagtggactaggatttgaaattcaaaaaatcatattcattcataatttagagtacattctgaacgactggtttagaaatggagcagattttattggttttacagcccctaagctttgtaagtttctctttccaaccaccaaaaatatcaaagttgcttgtctgtcttcaactcccaatgtgtatttacataaattagttagaagtactatgacacagactctgtttggaatgtttggtctgtgtattattttagaagaggaaagtctcatattgagtttgaatcatgatggcaacaacctgctctactggttgtatttgtacatgtttacagtggtagaaattacattcttgcagagttcatcactgtattgagttgggcagggtgatcctttctgtaattcttttttcttatttcccacaaatgccttcactgacctcttggattgactagcaactgcgcagaatgtcttcaaaataatgaaatgctctcatgtgctttttagaaaatgaagagtcatgaaggaatatataaaaacagagtggatgaaaatatatgttgttgtgaggacatgaaaattcttgatgcgctgtcctaagacttttcacctgaagtagtttcttcttactcatactgattttgtgttgggtaatcctgtctgatctgggtcgtctctcagaagatgatacatttttaaaaagttttttgggtcctttaaaaaactctttctaagaagttttcaagccattaacctcctatagtaacaaaaataattataattaaagtattgtactattattttgtgtcaagcactatatttgggtctttgaaaactagtctaattgtctaatacattttacttgaaagaataaagtaaaatgattatctataagtgtcaggtgaacatgagatataatttatctcaagataggtctatatcttggcaagaatttccagctatattcttgcaaatgtttttcatttccttttgttttagatttaagggatatttaccaacagtatctgaacaaatgtgttttgagggaaaacttataaaatggccatagatggactcatgtgcactgctcaaatagtttttttttctgttttgtaaattcgtgggtttaaagtaggtataattctttcacaagatactactttataaatagagaaatatgcaaataaaagttggccagacaaggacctgaaaaaaattgagattatgaggtagtgtattttgtgtgcaaaaaggcattaagcaatatattttccctcaaaacacattgcttaaatgctgttagtaaatgttatttaaatttaaaaaaaggcaggaggtataaaaaaattggcaagaatagagctgaaaatttttgccatggtatagacctatcctgagattaaattatatctcattttcacataatactttagatcattattttactttattctttcaagtaaatggtattagaaaattagactagttttcaaagacccaaagactagggagtccgggagatcttgctgaaagtgagttacttgctctaataaaggatggactcttgaaaaaatcctgttttaggggaagtgagttccagagcagcctataacttggcaaattgtcattttgacagatggagtgaaaagccagcagttaggagacttgagctatgcatcctcttaggtggtgtgctcagaaagccagcagctaatatgctctcacagctgtctgcccaggcatcattaccatttcctacacaagcgtgccatgtgctcttagcctggtaaaatataagattattattccaggctgcacagcacgttagtgtttgaggcttgaaggaagaaggaaaagagtagatatatagagattaaagagccttcatctttacctccaattttttttgcataaataactgaattattttaaccacaaactatcaatacaaataatttgagaatattgacacacacgatttcaaggaattgctcaattattacatagtaactaatgggcaatttgacaggaagcatatattctaagactatagagttaggaaggacataggttgaaaagcacaaaataatagaacacactgataaaaaaggaacaagtttagagtagacaaatataagttggggtatatcatttattgctccagtgaccttaagaaattaatttattggagcttcagactccttactgttaaatgatcacaataatatgcccatctttagaactcaccaaataacctacagctactaataacaagaagaaatatggagaggaaaagtgttgcatcaataaaattagcaaagttgtttctcctactcacttatagaacctgactggggaagagaaagagacagtcatccttcatttagaaccaaccctttatgctttccacataatttttaaatcaaatgagtcacagaaggtatgacttctgcacttgtctgcttttcatgaggaggggtttttcttaatgtagctgccttgactccccagtccttttttcctccttactaaggtggggaaagttatcatgctggtgtgtaacaagttatcatgctggttttgttttgtctttactttcctgtttgttttgactgggtgagctaatcttttgaaagcgctaagcaagggaagatttggttcattcctcctttcctctgcttcccgacaagggcgagaacgtgatccaggaggcagtatctgtgctgcagattccagcttgccctggaataggctgttcatgggtctaatcgacatgtccagctttcacgcaggagccccattctccatgatcagcatcataggattaaaagggaaacttctctctgctgactgttaagtcccactttactgtgttttacacaaacagggaatagggctgttatcactggctgccccaaaccacccactgggagattttcacacttggaaaatatcttggtaatattatttcaatgagctccagctatttttccttcgctcagccacacctagtcagcacttacatgtagttagcccttgtaatagaggagagagaagacttccaaggagacagaccactggaggaactttcagtgaaagagacttgcttcaacaccagtgttcactattgttggtggtgggtgtgtctgtccactggtaaggatgacgtgattcagtggaatatgagcacatgtgtaaaagcaccctgataaaggatgtgtcctaaggttttctttgtattttactttccgcttttaaaaaaatgtttatttatttaactattttttgcaggccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaaggtacctttcccatgttggtctatttctctgcttttcaaaaaagtaactgtatacatgtagtaggccttgcttctaaatcatacatgttaaaacaggtcagcagtttcaacttttaattgtagtgcgggcattgaattatattacacttcaactaagcaggtttgtcatttacgccccaaaatgacatagaagggacaaatgacaagaaaagatctcatgttagggattaaacacagacagtttacatgatttattcaaatagtcattaaagctagtctcctaaattatttttattgtaatacacatatacatttcataatattaaatcataaaagcagcagtaaggattatgatgaaaggaagtattaaaatgagcctggaagaaagcttggatttaacttgctgtgccctttgccatttatttcactctccgtacctcaggctcttcaccaaagaagtgaaagaggcaggcaaattgttgtgtcagctctttcctgcatataacacttttgtaatccatatcttgggttcagatgataaattcagtatgttacttacaggcaaaaaagaatagactgtatgctataatattaattctctcaaaaagtgcaaaaacattatattcaagtcatcttctctctgtaaattcagagattttgatcaatcaaggttttattggtattagttacatttataggaataagtaggcaaagatgataccatttaaatgtggaatgtagttattagtgctgtgactggctgatgtgaagtttgtctagtcctctgaatgtgattgacacagactattttctgtggatccaatcacactgaggctttctatctacaatgtagttgaccgtattgatcaaattaatggaatgatgactgcatttgtacttatttagtgcagtgtaagcttagctactgaaaggaattattctttttagactacaatttagtgaactagtgctctaggcacccattaatattccagtaaagttcacctcttaaaactttagtttccacaaggaacacctaagtaatggcctgttgtttaaattaatggaaaaaaaaaaggactcagacacaaattctcctcccaagtaaatgttaacacagttgatttaggcaaacccctgtttggaataacactgcatttccaagccttctccataatgcatattattatttaaggtaggaagaatagaaaaccgaagttgagaattttattttctttgacttgacaaaagcaaaacttatatagatatgcattaacgtcaacatctgccaaacagtgatatattcctttgacattaaattattcacaaagaaattcaaggaagaagagtttgaaagatttatgttatgtatatttttagtcatcatttgatgtttctatataatttggctacatcgtgcaacaggggtatttttctgtaaccccctcctcccctccctggcacacacacacccacgaaccagacatatctaattgttagattctcctccaagttgctgactattagaaacacttccagatggctggaacatagctacggtagctgaatattttaacaatctggccacagttttcttgactataaaaccaaacctttcaaaagaattgcaagggttgcaaaaaacgaaatcaaagatgtaacattaattatgcaatttaaaatgttgactataggactccaaaggaatatagatttcctgaacaaattgttctcactactcataaaacagctattagcactattgagatgtaaatgatgtttttatgaagaacttttaatcctctctctttagtaagaaactattaaatgtaccttcagttgtatgtttttgaagtttctctttacctatacacatgaaaaacaaattgagcttaagaagtctttacttttttttctaaagtgtggaggtaataaataaaaactttgttaatcatctggatggatgagctcgtgtttattcaattttttctgccttcctgcaccctctccttttccttttttgtctcttttttagaagcccacattaaataataaggatttgccatgtgagaaaatagcaatgctattgtatattttgaaaatctactccattctgaaaacacccattgtgcttaagtaaaatcatggattcgattggattctttctgtatgtgcaatgtctttcctattaccaaacataatataatcaaatactatgagcttgtaatttaggttgcaacatcctaaatataaaatcagactgcacttcaaatcctataatatgtatgagcaaaagcagccaggatgtcttgactaggtacaactgtatattctaaatatctaagatatgattaattacacattcaataaaaagagatatattatagtgacatctaaaacagtctacatccagaaatcaaaatataatcacaatcacatttcaatagactatttaaaaataagctcccaccaataatttttatgttgtcaacttttgaattatttaaagcctttgaattttagtaagtgaaataggaaagcatttatatgtaattatagagccatagtataatccaaaatgtttttgcattttcaaaggttgtcataaaatcaaatgcaactcagtcattaatatacttgagaaatccttgttttcaaataacaaacctatttctaaaatgttgcgattaaatccaatttttgttgaacctaacaagttttgatttattaaaatatagattttaataagaacctgtgaagaaacagttttactaaaaataaccagtgttgtatgttctataggtaccaagtttgttttattttgtttttttcctagtgataaacatctctatttagcttgcttaatatatagtcccaatgttcagacatttgcatctgtttccagcaacatgagaaatatttatcatcttatttttgtatttacaattatgagaaaatgcataaagtttcaacataagcaattttcatctgttaccatatgtcttaggataatagataaaagaatgggtttctatgaggatggtatttttcctcagaatttttggttttaaggctcaagaagcagctgtttctgagcagaacaagcttgactcaagtccctcccaatattacatgattcaggaccagcttacttctataggagaaatggatgaaaagcattaaagtaaattttcaagcaattataaagaaagcttataaagaagggttaaggtaaagtatagtgaggaagcctagtgaatgctcagaacttcttgagtcagttgataaatattgggggagcttggatttggaagcataaattgggctggccttctttcctgtctttgatacaaattcataagataacactaaattagaaacaaaaaccacatgacttcagagtctaaatgctgctcatccatagttgctgtgtatttatctgtggaatggcgagaacaggaactggagcttcctttgctggtgggcctgggcaagttaggcaacttctccaaagctcagccctctgtctgtaagatgaaaggattggatgacgtgataatttggaacctctttcagtaatactaatattactaatagtcctaatagtaaatatcctaatggcaatagtaattattcaagaagatttacagaaatatcattattgcttgattttctttatttctgcatacgttgaaagcaatagttgtaattttctattataaatatgatatgccataatgttcatgttcatggaatatttttctctaacttacagatatttagttttatattggttgtattaaaataaccagaaaaaaagtaaggatatcattaaaaaaatgcaaaatagacaaaaataaaccttcacctcagaaaatgatcgcagtttataatttggactagtgtattttaaaccaagtgactaaacatttacaggtagtacagcttatgaatacagatatttaacttggaatttaacaattaagtccacaccctgtggagtaattacaaaggcacttatctcacttggacttgaacttgaacttgccaaggctagttgtgtacttttgtttcctctgatgaacttacagttctttcctttttacataatcctctttttcttcctttacttagaaaaattttaatgatattttttcattgtatacatacatatatctttgaagactttcgtttttagctaaaaatggaaatctaaaatatctttggggaaataaccaaactacacttgatgggagttgctacctgcaggttttgtgcaattttctctgaaatcaaattatccaaaccatcaacactttaatctaaaccttttagttacccctgacatagcaatattcatgaagttataaaacatagagttataaaaacatggaaatccagtaaaatgtgtcatctgtttctgacatactttgtagtattgttacactggagcattagggcatagaaagatacaggtaattttaaggtatattttgctgcattgttttgactgcagaaagctaaacactgcttttgggcttctctctctcccctcttacaaaaaaactctaggaaataatatttttcaagtagattatatgtataaatgctataagatcactaagaaatattcaaaataagcattaaatattttaattagttttatttttaaaattcttacaatataattcttgtgtatccacctttttagatgccatgctgcagcttgaaaataacctgtagtgagctctaaataaactcaccatctgcttattcttccctcattttttcctagtggggtagctacttgtatagctaaataaaatggttgtatataactattttcagtatgttgatgtatgatacatgctgagtccaaattaaacacaagcacacacacacacacacacacacacaccatacaacacaaaagcagctcccaccttgctttgcagagcaagtttaccaaaaagagctactatgaaaccctttgtggtgtctgccctctgctggtgcaaagtagaaatacaggccttaacatttttggactttttgacatagataacatctctcatgagctcttcactttacatccagagcctcctcgctggacaaagaagcctcagagtgctgtgtatagcaccggaagcaatggcatcttgttatgtgaggctgaaggagaacctcaacccacaatcaagtggagagtcaatggctccccagttgacagtaagtttaaaaaccaattgcaatgcaatgctgaaggccctggtttgacgggattaatgatggtcagacgtgtgtaaaatgaagttggtatgtggttggattagcaggacagatacaaccagcaaatcagagattgtttatttctaagcaatttggttgttaagacttgatattcatggaagagccataaataatatttatactgcctgtgccctcttataaattatatataagaataaagatttttaatttttaaaaagaaaattgaatgagaaagaggatgcatccaaggaaaaaagccaattattgttcctgtccctgagaagaaacagaacagtagcctagcagctgagggcacaggttcaaagtcaggacctcctttaggctcaggcaacagcaacacctgtcctgggctctgcccttttaagggacttgctctgatcaccctctggtcccgcttgtctccatgatttgaaagcatcctcagggaaaaggaggcatcccaagtctgaacatggtcccattactgcctatttgctaccaacctcaagcacaaagacctgaaaatccccatgcccggtccaccctgagcccactccaaatgggctgggcggggaaagacaggaatggcccagcactgagggccaactctccccatttcaccatgctcagcatagagctccaaggagtccccaaatcttccactggaacctagagctcagattattttggatgtccttgttcaggaagaaggatagaacatatttttacgtgtcaattgcttaattaagagcaggtacgatagtggcttccatttgtccttttgctctggggcctgcacaagtcaagggtgagccacttggtggataacagacctcgggtcccgtctaggatgtgcaccttgccagctgtttcatcttgaggtgttttctgaatctccccaagcttacgttttttaaactgcaaaatggagatagtggcggttggttgtgcttgaatgaaaaaaaatgtggccagctgcctagggcagtgattcatctgtagagcactgtgatggtttataaactctggagccagactgcctgggtttgcatactgactctaccacttactagctgcgtgacggggagtatcactgaccctcttcaaacccatttcttcatcagtaaattgggataaaaataacactgactcacggggttgttttgtggattaaaggaaacatcatgcagagaatgcttagcacggggactgccacaaaaacagccccccgtaaggtatggttggttggtattgttttcccataacagacactcaggaaaccttagtcctcattattaactatcttcagatttgggatttttctcttcatctctttagggaacagaataaaaaatgaaaaataataatgaggttttgggtagacgaagggaaatgaaagcaacttttgtttataatgaatgttcaggttacaaaagtaaggaacgcagattctccggaacacaaaatcataaaatattatatttggatggtatttggctgtttacaaaagacattcacaaattacttagaatcctcaaaagaactttataaaggaggtgctattattcatatttaactgattcgttcattcaataatatttatggggtactttctatgttcccggcactggacttcatgcttgagatatacaacagtgaataaaatggatggaatccttgctctcctgccattagacaaataacacatgagtgtgtgctatggtgtgataaagcagaaaatagctgggtaagggcagtgcctgaaagaggttcaggacccagagttgcaatcttaagatcataatagtaagacccctgtggtaatttacctttgagtggagatgggaaggaagtgaggaagtcagccacctaaatagcagggaaagtgctgtctcagtggagaggtgtgttgaggaggagaaaagaggtgagtgtgactgaagctgagggagtgcaaggggcagccctaggccaccagatccgccagcaggggaaggggccagagctcaggtaaagatgaacatcgaagtagggccttgggattttgagaatacactaggcagctcttggagaattttaagcagaagagtgacacaatctaatttacatttttacaaggtattttcctggcctttgaatggagaatggactgtgtgattgatactaggtaggaggccatctgagaggctctgcgctcagggctagattggtggcagtcatggttggcttctggatttattttgaaattgagccaataggtttgttaatggatgaggaggtcaaggctgaaaataaacttatgcgagaccacacagctgaataatggtagacttcaaaccaaagccaggtggctggaatccaagctcggtgttctgttcacagcttttggccctggctctacttgttgccctgcaaacaggtcgtaaacttttataggctgggatatttgatgacagagtgttggctagaggatttgaaacctctttaagcttattttagttttagaggttatatatcctttccccatgttatttcaaaattaaatcaaaatgattgctattattgattatcggactaacccttttcacatgctttgcatatgatatttctgaacctcgtagcagcttgaaaaatagattctattattctccattggcaactgagactcagagaggttacattacttactggagaatgcaacccaggtacatttaaaaccaggaactaaacccaggaaggattaactccagagctgaagtttcgtccattttattgcatgatttctcacagggttgaccaaagacaaaactgagaaagaatttctgaagtatgtcaggactagtgtgttttataaagacttggccttcttgaatcctgggagcttctgttagcctttgtcaatacacaacaatttccatacccatgccaacaggcagatttaagcaatgtttaattacttaaataaagtatcatttatatagtctaatttcttacttttgtaatgcagtgttaattcagagccatgcatggatcagacgggataaggagaactaaatgggaggatggcgttaactctgaaagtcttaggaccctgagtggggtgtggaagtgaagagtgggattagagactcagtgctttgcagcattcctaaagagtttagcctttaaaaacttggaagagctactcatcttgctaatttgcaagaaataagtgataaattgttcaacaggattgtattagttttctaacattgctgtaacaaattaaattaccataaacttagtgtcttaaaatagtgcatgtacactattttacatttctgtaaaagtccaacacgagtcttggctaaaatcaaaatgtcagcagtgccatgtcctggaagtgcttggagagcattccttcgtttgccttttccagcttttccaggctgcccacattcctggctcccttccgccattttgaaagccagctacactgcatctctctgaccatccttccatggtcacatttccctctgaccatagccaaggagggccttctgattttcaggagctttgtgattacattgagcccacttgggtcatccagatgtaggaaataattttcctacctcaatgtccttaatcttaatcacatctgcaagtcccttttttccatgtaaagtaacaaagtcatacattctgggacttagaacgtgtacatctttcaggggctattgttttgcctacttacaggggcctttcaggaataaaggttacccaacctaacattttaagtcattccaataagtatttactggctggattttctctggtagctgctctttgggcagtggggacacactgcacaacctcacactcaggtcctgcccttagagagctcacagtcaagtgaaaaaaatcttcatttgtgactcctaggcagaaaaagatgtgtaagtcttttatttcaatatgtagtattcatgttttctagaacctaaagcttagtatagtcattatctcgtataatggagagacaatcagaaaagtagaattcgattgattattaatcttgtaatgtcctttaaactaaaaatttttgcatttgtgcccttcccttgacatttccagctaacatgttttccttcccactggatttatatatataaaatatatgttatatatatatatattatatacggatattatatataatataataatatatatttatatctatatatatactatagatatagataaagatatacacatacatagtatcatagcaagggcagggcttttagagtcagaaaagtggccaaatgttgtgggatgtgtcatccaacttctctgtaatccagtcccctcacctttaaaatggccatgtaaatgctgatccatcgagttctgagcagtgtcagtgagatcatgcatgtgccacatccagtagagtttttggtccttaaatgcatcagaaatgttaggtattcttttttttcttccttttctttttcttcacttttattttaaagtctctctccatcacccagtctggagtgcagtggcgagatcttggctcactgtaacctccacctcctgggttcaagtgattctcctgcctagcctcccaactagctggggttacaggagtgcaccaccacacctggctgatttttgtatttttagtggagacagggttttgccgtgttggctaggctggtcttgaactcctgacttcaagtgatccatctgcctcagcctcccaaagtgctgggattacaggtatgagccaccatgcccagcctcatgttaggtattctcatttccaaaagatattcccagaattatacttggatcaggagtggggaaggttttattgccccaaagtagaaaatctggccctttttctcaagaagagtttagtcttcctgggaaaatgaaatatacaagcaatgtacatgaagtggttaaatagtgaagcaaggcaaatgaaatcaatggtgcagatcagaaaactgtagagaggcagagaactgaaacgggaacaaaagcgtcaagggggaaaatagcagccagtactggtagctagggagatcgtgatgtgttgaccatgtgacttgtgccaggcagcatcagtgtctaaattcagaagagtaacagagtgtcacttcatcataggtcttgaatgcctaaaggataatccagaatagtgccatgagtataggtatggaaattctgggaggtccagatgagcagatattttgttgctaaatattaacttgaaagataattgaaaattcacatggatctggaaagaaaagtccatagttgatgttcagaaaacctaaagaattggcttcaatgaactattagtcaccctaaactggtttgaaaatataaatactgtgtgacacatttaataaatggtgtataaatattttatgtcctgttccttatcaaactgacattctttaatctctttcagatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtgggtgagtgtgcctgggagctgacttaacatgctattttcctaaggaaagtggtcaaggtcatgttcagaagtgtattaactcttgacacataatatatggagggaaaaatcaaactacttttcaccatacatttgagttttagacttcacactgaaattgtactttcttttttttttttattatactttaagttttagggtacatgtgcacaatgtgcaggttagttacatatgtatacatgtgccatgctggtgcgctgcacccactaactcgtcatctagcattaggtatatctcccgatgctatcccgccccccctccccccaccccacaacagtccccagagtgtgatgttccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatagatggacatttgggttggttccaagtctttgctattgtgaataatgccgcaaaaaacatacgtgtgcaggtgtctttatagcagcatgatttatctttgacaaacctgagaaaaacaagcaatggggaaaggaatccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccagaagcaatggcaacaaaagacaaaattgacaaatgggatctaattaaaccaaagagcttctgcacagcaaaggaaactaccatcagagtgaacaggcaacctacaaaatgggagaaaatttttgcaacctactcatctgacaaagggctaatatccagaatctacaatgaactcaaacaaatttacaagaaattgtactttcaaaaatgtattgaattgggatacttctataattcaaaacagacaccataatattctgctgttttctgtttgtattcgtatgactaggacatagaaaaatttaatttgcatatctttcttccacaaaagtttaaaactgcgtttatgttattttcaaatagatgtccgtccattgatacaaaccaaagatggagaaaattacgctacagtggttgggtacagtgctttcttacattgcgagttctttgcttcacctgaggcagtcgtgtcctggtaagccggtggctcatggttttcttaagagaatgtcaattgtagatttgaccttgtttcttcatccgtcatttgacaggctgtattgtgtctatattgttacatgtacccagtacctctgagacataaggtaacaaacttaccggtccaggaaattagctctactgaaagcattggctagatttctaggattttctcacatagagacatacagagagccacttgtgttcataaagaaaagcagagaattgaagagattacagagacaattttaaaggtagttttggtttttcattatgaggtaccacaaggtcatgttttactctattgttgttgttttgggattatctaaatgattatctaagctcgaatttaattccaaatgcatgtgcttaagacttttccagcattcattttgattttaatttcaatgaattaattggtatcataagtccaaagacattatcaatatggatctaccttattagttgctttactgaaaaagcttggttaaatagttcttgaataattttgtcattggtctgtagggcagtgtgagatgagtgaccccaggtcataaatttatagggtcagatattgcctttattttaaatcatgatacgtattttgttcatcgtgggttttttgcattattgtgatttttcaaaatactagattgaaatattatttaccttgcttactgagatgtttggcaccctgttaaattttgcatctggggcaagcctcccacttgcctcagcctagtccctgtcctgtatgatcctacatggaccgcatccacagcttatccttaaaaaaaaaaaagaaactcaagcagtcgcttattgtcaaatgtacagggtaaatcaagctgtagcagcaagggcttggaaatggctgaatgttggaggaaatggctctggggttgatagggtaaatgtaatccatgtccacaggacaggcaagactccccagcttataatatttctgaatgaccaatgttctcccaggacagcaggaggtttgaaaggttcattatctctttcaattactagctttcccatttagtaccctggagcaatcattaactaaagagttcaccatcaataagccagaaaatatttattaagctctgaggacacatgcaaaccggtgctggtggctatgacaaatacagcagaagcactgagcatggacttggattttctatagccacagtctatttgggtagataagatatacaatcttggtccattttgagaaaaatatgaaacccactggaacatttcatgaggttttctgagctattgaaaggggattagcctgaatgacgtcactgactagtattaaaaagcgtatacaattttgccctacctcagatggatgtacgctttctttgtccataggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaagtatttttatttcactgttactttgcatgaattgtcacatgggttcagtctgtcttcatttgcccaaatggaataataccatttaagttggagtaccagataaagttctttgaaccgtttttcaaaattcctagaatgggtttcatctaaaagattattgcaagaactacagggtatgcccatgatatgtgcacagcttcatcctattttaagaggcagccaggtgtctgtagtgacagatggctgtcaatatttaaaaattacctattaaccatactacaccatatttctgtaactatattttatttccaaagctaactcaaggtaatggtaacagtaatcaagtttttgagctaaagatttcacaaactcataactttataatgactgaggcatgacagaatgaggagggtttttgatcctctttttgagtcataaacagctttgtattattccttctcacttcagggcacagtcctgggagctgttaatagtttcttgggcttcactgatattttgattttaatattgctcagagaatcttcaagaaaacacaaaatggaaaggatcttcggtattaataaggagcatttttgtttcttctgtcgtgtccatatcccagcctgcttctcacttccacctagataagggagagcatatttgtttgatcatctgttttcactgatgccacttttcctcatacatatctgctgttgtatccactgatgtcttgacatttctttctctcttcccatatatatccttccttccttcttttttcatcctgttttccttttcttttgctgtacatccttttcttattttatagcatttgtctctttctgtgccctgagtaaatcagtgtgccagccccacagactatatttttaaagcactcaaatactctcccacaatatctacttatctctgatgtcttttacattttcaagtgtcatgtacacttttcaagatgccctcatgaagtcactgaagatggtgatgattgtttttatacttcaaaaagtaaacctatatcaaggttaagcaactcagctaggtgtaaggagcgtgaagcctcgaatccaaatggaactttgcactcctattgcccaatacagtgcttggcccaaaatggacctcaaaactgctagtggccagagagatggacaagtttagaaagtttcaatatgctgtagtgtctattttatatgttaaaaatatatacgaatcgtatcaatggaggattaaggacacttttttttttacatatacaaaaggcatgttgagaatggagttaagtgagagcctatatagtatagtgattgagagcatgagctttagtctcaggcagatttgggttcaaatcctggttcagcccattcccggttaggaaaccttgtcttatggctcaatttcattttagccttaaattattttctctgtaaggtgggagtattaatattcataaagttgttataattataaaatgccacaatgaatatgcattacttagcagagccctgatagagaagtgtttattaaattgtatctattattattaaatgaatttctggctttaaatttagaattagaagtaggatgtcaaataattcacttaaaattaattcaatttaatagtctcttcaagttttgtgcctggaataacaattaattttattaatactttccatttttagccagttccttgagaaaaatgtacatagccaatatcagagtataattatagaattggaggtcagcttgtgcagttggtctctgggaggtccccaaaatgccaaatgccacattaagagtatacttacttttaatagggcattaaagagtaaggattgcacgttttgaaacaatcataatgaaccaaacattttcttaaggcagccataaaccaatctttgagtttcataatgttgataactacaaatttatttttgtttcaaactatcactccctgtaattcattcaaaaggagacttaacactatgtattgaatgcctacggtgtacaggctcccttctaggctctggagacactgcagtgtcatgaaacagtcacaggccctacttccctgaggcttgctttctagttccccaccttcatgttaatagttcatccattcatgggcttaaacatttaccctcaggtttctgaattaataataaacaccctaacagaaaatcaaatatctttcccttttcctttacagtgctttgattatatatccagaagcacttgaaggagaaattatgttattttcaacttctagagacatttgtttgcttatactttgcttactcccttccccaagaaataatgagggaaattcctaaactattagttgatatttccacttaaattttgtcagatgtccaagcctggatggaaagaaaataataatgacatacaatgttaggaaattacagtgggacaaaccctgcatgaggattggacagttatggtgacaatttgggttacttaacttgcaggcacttaataacaaagtaagttacgcttagttctaactaatatctttgtttggtaaaaacagatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggtaggtaaactattatgatatgtcataatatttgcttggggtaaacaacttgcatttgatttaaaaagttctaggtcgggcatgctgactcacgcttgtaatcccagcactttgggagaccgaggcgagtggatcacttgaggtcaggagttcgagactagcctgaccaacacggtgaaaccccgtctccactaaaaatacaaaaattagccgggcatgatggcacgtgcctgtgatcccagctactcgagaggctggtgcacaagaatcacttgaactcaggaggcggaggttgtggtgagctgagatcacaccactgtactccagcctgggggacagagagagactctgtctcaaaaaaaaaaaaaaagttcttaaagcattcatacagaaacaaaaacaaaaactgagtaatatttctgtcttcaagtcacttcactctgctatcatatgtttatcatcctgtttttgctactgacttttcatgtaacatgtaccattctattagtgtgtgaaatggaaaccactctaagtaaccgaggaagaattgcatgggcttggatggttgcaaaaaaaaaaaaaaaaaactggaggagctaggcctagaagaggctgcatactagtcttctaggttcttgatcacaaagcactgcagctgcaatccaggtgtctggaaactgctgccatcttcatggccacctcaccccattggtactactcgtgagtcctgccactgccacctctcatgtctgccagaaccactgtctgctcccactggcccagagaagatggcatccattttccttctacttttcaatctcacatgagtttatttaactcactagcaaaacctaaatcatatctgggattcttcctgccagagagtactgagaagtacacctttgagtcttccaaactctgtatagagaatatagacaaaatataaaagagaacatatagaggaaagtgtgaatggatgcttaatagcactagatgatattaagtacatcaaagaaataaaaagtcagcatttgctgaatgtctactctcttttgaaaatatgagaaagtcagcttcgcgtccttttgcattgttactaagtaagggttaaaacttaaccatcttggagccaaatctcccctctcattaattttgtaatttattaccctgtaaaactacaaatctgaaaatgtttagataggacatgtgctgcttgcatgagacagcaacactgccatgggtaagatcatgaactctgaagctcaatggctcagattcaaatctcagctcagtcacttattagatctttgaacttagacaagctgcttaacatctttgtgctttagttttaaatcccataacatagtttgaattaaaagtattaaaaaggtactttcattatagggttaacaataccaagtacttagaaaacattaacatacagagcacttagaaaataccaactgcacagtccatttttgcttttgtgatttgtactgctaatttcttcatttttttccttatgacaaatttctttttttaatttttgtttttctttacatcttcattaaaaaatgggatacatgaacagaacatgcagatttgttacataggtatacatgtgccatgatggtttgctgcacctattgacctgtcctctaagttccctccccttgccctccacaccccaaaagtccctggtatgtgtgattcacctctctgtgtccatatgttctcattgttcttctcccacatgtttgctgatgatgatggcttccagcttcatccatgtccctgaaaaggacatgatctcattcctttttatggctgtatagtattccatggtgtatctgtaccacattttctttatccagcctaccactgatgggccttggtatcggtttcatgtctttactattgtaaatagtgctgcaataaacatatatgtgtatgtgtctttatagtagaatgatatatattctgttgggtatataccaagtaatgtgattgctgggtcaaatggtatttctggttctagatccttgaggaatcaccacactgtcttccacaacggttgaactaatttacattcccaccaacagtgtaaaagtgttcctttttctctgcagcctcaccagcatctgttgtttcttgactttttaataattgccattctgactggcatgagatggtatctcattgtggttttcatttgcatctctctgatgatcggtcatgttgagctttttttcatatgtttgttggccatgtaaatgtcttcttttgagaagtgtctgttcatatcctttgcccatgtttgatggggttgtttgtttcttataaatatgtttaagttccttttaaattaagaatattagacctttgtcagatgggtagttgtaaaaattttctgtcattctgtaggttgcctgttcgctctgatgatagtttcttttgctgtgcagaagtgctttagtttgattagatcccatttgtaaattctggcttttgtttcaattgcttttgccattttcatcatgaagtctttgcccatgcctatgtactgaatggtactgcctaggttttcttctagggtttttaatggttttgggttttatatttaagtctttaattcatcttgaattaatttttgtttaatgtgtaaggaaggggtttactttcagttgtttgcacatggctagccagttttcccagcaccatttgttgaataggagatcctttccccagcgcttcgatttgtcagttttgtcaaagatcagatgattatagatgtgtggtgttatttttgaggtctctgttctgctccatttgtctatatgtctgttttcataccagtaccatgctgttttggttactgtcgccttgtagtgtagtttgaagtcaggtagcgtgatgcctccagctttgttctttttgcttaggattgttttgtctatatggggtcttctttgattccatatgaaatttaaagtagttttttttctaattctgtgtagaatgtcaatggtagtttgatgggaatagcattgaatctataaattactttgggcagtgtggccattttcgtgatatttattctttgtatccatgaggatgggatttttttttttcatttgtttatgtccttttttatttccttgagcagtggtttgtagttctccttgaagaggtcctttgcatcccttgttagctgtattcctaggtatttgattctctttgtagcaattgtgaatgggagttcatttatgatttggctctctgctggtctattgctggtgtaaaggaatgcttgtgatttttgcacattgattttgtatcctgagacattgctaaaattgcttatcagttcaaggagttttggggcttagacaacggggttttctaaatataaaatcatgtcatctgcaaacagacaatttgacttcctctcttcctatatgaataccctttatttttttcttttgcctgatggccctggccagaacttccaatactatgttgaataggagtggtgagagagggcatccttgtcttgtactagtttgccaagggaatgcttccagcttttgccaattcaatatgatattggctgtgggtttatcataaatagctcttattattttgagatgtgttccatcaataactagttaattgacagtttttaacatgaaggaatgatgaattttatcaaaggccttttctgcatctattgagataatcatgtggattttgtctttggttctgtttatgtgatgaattacatttattgatctgaatatgttgaatcagccttgaatcccagagatgaagctgacttgttcatggtggataagttttttgatgtgctgctggatttggtctgccagtattttattgaggatttttgcatcaatgttcatcagtgatgttggcctgaatgttcctttttttgtgtgtctcttcctggttttggtatcaggatgatgctggcttcacaaaattatttagggacgagtcccttcttttcaattgtgtggaatagttttagaaggaatggtatcagctcctctttgtacttctggtagaattcggctgtcaatccatctggtcctgggctttattggctggtagactattaattactgcctcaatttcagaatttgttattgctctattcagggattcaacttcttctggatttagtattgggagggtgtatgtgtccaagaatatgtccatttcttctagattttctagtttatttgcatagaggtgtttatagtattctttgatggtagtttgcatttctgtggggtcagtggtgatgtcccctttatcattttttattgtgtctatttgatacttctctcttttcttctttatcagtctagctagtcatctatctattttgttaattttttcaaaaaaaaaaaaccagctcctggattcatttatttttttggagggtttttcatatctctgtctccttcaattctgctctgattttagttgtttctcttgtcttctgctagctcttggattagtttgctcttgcctctctggttcttttaattgtgatgttagcatgtgaatttgagatctttctagctttctgatgtgggcatttagtgctataaatttccctcttaacactgctttagctgtgtcccacagactctgatacattgtgtctttgttctcattggtttcaaacttcttaatttctgccttaatttcattatttacctaggagtcattcaggagcaagtttatcaatttccatgtagttgtgtggttttgcgtgagtttcttaatcctgagttctaatttgattgcattgtggtctgagagacggtttgttataatttacggttttttgtatttgctgaggagtgttttacttcaaattatgtggtgggttttagaataagggtgatgtggtgctgagaagaatgtatattctgttgatttggggtggagagttctgtagatgtctattaggtctgcttggtccagagctgggttcaagttctgaatatctttgttaattttctgtctcattgatctgtctaatattgacagtgggttgttaaagtctcccactattattgtgtgggagtctcagtgtctttgtatgtgtctctaagaacttgttttatgaatctgggtgctcctgtattggatgcatatatatttagaatagttaactcttctggttgaattgttccctttaccactatgtaatgcccttctttgtcttttctgatctttgttggttttaagtttgttttgtcagagactaggattgcaatccctgctttgttttgctttccatttgcttggtaaattttcctccatccctttattttgaatctatgtgtgtctttgcatgtgagatgggtctcctgaatacagcacacagatgagtcttgtctccttatctgatttgccagtctgtgacttttaatttggctactcagtgcatttacatttaaggttagtattgttatgtgtgaatttgatcctgtcatcatgatgctgtttggtcattttgctcattagttggtgaagtttcttcatcatgtcattggtctttatattttggtgtgtttttgcatgactggttctggtttttcctttccatatttagtgctttttttcgggagatcttgcaaggcaggcctggtggtaatgaaatctctcagcatttgcttgtctggaaaggattttatttctccttcacttgtgaagcttagtttgacaggatatgaaattctgggctgaaaattcttttctttaagaatattgaatattggcctccactctcttctggcttgtagagtttcttctgagaggtccaccgttagtctgatgggtttccctttgtaggtgacctggcctttctctctggctgccctgagcattttttccttcatttcagccttagagaatctgatgattatgtgtcttagggttaatcttctcatggagtatcttagtggtgtactctgtatttccttaatttgcatgttggcctgtcttgctaggtttgggaagttctcctggataatatccggaagtgtgtttttcagcttgtttccattctacccatctccttcaggtactccaaccagttgcaggttcagtctttttatgaagtcccgtatttcttgaaggctttgttcattcctttgcattcttttttctctagtcttgtctgcacactgtatttcagcaaagtggtcttcaaaatctcatgtcctttcttccacttggtagctttggctactgatacttgtgtatgcttcatgaagttctcctgctgtgtttttcagctccatcaggtcatttatattcctctctgaaatggttattctagttagcagctcctgtgaccttttatcaaggttcttagcttccttgcattgggttagaacattctcctttaggtcagcatagttttttattacccatcctctgaagcctactcctgtcaattcatctgcctcatcctccatccagttctgcgcccttggtggagagacattgtgatcactgggaggagaggggtttttagcattttttttgttgattctttctcatcttcataaatttgtcttccttctatctttgaggctgctgacacttggatggggttttttgtgggagattttgttgttgatgctgttgttgttgctttcttttctttcttttttttttttctttcaatggtcaggtctaccttctgtagggctgctgcagtttgctgggggtccacttcagtccctattcatctggttcacgcctatgcctggagatgtcactcaaggaggctggagaacagccaagatgggtgcctgctccttcttgtgggatctcagacctcaaaggtcaccaacctgttggcagtaggatcactcctatatagggtgtctgacaagccctcttggagggtctcacccagttgggtggcacggggaataggacccatctaataaagcactttgtcccttggtggaggggatgtgcttcactagggggaaaccgacttgtctgggctgcctggattcctcagaactaccaggaggagacgctaagtctgctggtctgcagagaccatggccacccctccccctaggggctcaggcccagggagatctggattctgtccctgagcctctggctggagttattggagttcctgcagggaagccccacccaaggaggaatgatgggtcagggtcaggcctgaaaaggcactcagggtcaggcctgaagaggcattgattctgccacagtgggtgtgttgggctgtgggggacgtgtcttgggaccaagccatccagcctccctggctccagcaggggagaaagcacagcctggagctacagatatgaatgttgcctctcccccacccagggagcttagcgtgttaggcagttgtgattcccagtgctggctgctgcccctcttctaaggagctcaaatggcttaggaagcaggcagctgcagctgtggggctggccgcccctccaccaggagctcggtaggcttaagcagattccagctgaaaggctgttgagaatctgtggggcttcggggttgtgatgctagacccagtggctggagtttgtgagtggggtcttccaatccatgggtttcacagttctgtggaaaaagctgggtagcacattcactcaccgcctcccttggctggggggaagggtctcccctgccccgtgcggctctcaggtggaccactgcaccacactgttcttccctcctctccgcggatcatgccagcctcctagtcagttcttctaagagaaacctggataccttggttgccagggaaggattcacacacttactatagttcttttccatgggagcctccgaacacagctgtttctagttcgctatcttggtcctgctccctgcctccgcctcccccagcccccaccgccccactgccttcatttcttcatctgcttgtctcatttctgttgcttgcttggtctatgttggtatttatgtgtgagccgcctctatgcaaaggcattggtctcagccttggttcttgatttattctctcccctccttccgatatatacaaaggtttgcagaaaggcagtgtatgtattacaaccagttctcattgaaacacgagattaattatatacctctaaaggctacgctttgcaatacagatctccagcctcaggttaggtctccgctgatctgccaactgctcagatatgcctaaattctgcctcttttgttactactgcctgactatccggggtcttccatgtgacctctgggctacagccaagaagggaatcagagacccatggctggtgggtaatatgacatggacatttaggctttgaccccagaagccctaagcaaccttttcatgtgacccagttttacagttcctgcaggatcccagagctgacactgaaatgaacctctggctatctgagtggactgagcaagtgacacagatgttctgccaatttccctaaacaagtaacagggataaaggacaataaccttagctcagaagaggccccaggagcaaggaagcctgggagtaactgctgctggctggccttgactgctgccaagggcatgcacggtgatatagcagggagtagaagtcacaggtatctgctaattttctacaaagccatatcagtaacctcatacttcttaccttctgctgagacaccttctccttattactatgcagaagaccggaagctttaacctaaagggaggttaaacttctaatcaaatatacatggtgaacaatgagaagtgaaaattccttcttctcttctcgcttgtcccctttcttgtgtagggatgcagtaagtgctgggaactgccactctgaaccattagacctacggggcttcatgttatgttagtacttcccatacatgctttctctctttaggcctcccaataatactattaggtagattgaaatgcccccccaggaattttctgtggatttcctacctgcaggtggccatagaccatacaggctatagaccatacactatggttatgaaaaatgaaatggagcatggctatgaaaccatttttagaatttatatcgtgcttaacaaaggtaatggggactgttcatgactgtaggcaaagggagggacctagtcctgtgggagagaccactgtagcatgaaaagtgggatatactgataactaggagggcgtgggaggaaagggcattgagaatccagtgggagggtttttccttggcaccaaataggagctgcttttttccccctccagaaatagtggcaaattaatgagggaaggggagaagttgaagatgcaaagatgaagatgcagtcatagtgaaaggtctctttctaacaaattaggaaataaggtaatttgttcaagcagagaggcaggagaaatgggagttggggacattaaaacaccaaccatgagaaatgtgattagcaataagccaaaaatgaatgaaatcaacttgattaatattattagtaacactctctgagcacatactctgccaggctgtatgcactaatcactttatgtgctttacctcatttaattctcctaaagagaaagaaaatattgttatccccatttttcagataagatgaattaggctcaatgttttgttcaaggttgtacaaataataattgatggaactgagccgcaaacacaggtctccaaagagagaatcgttttgtcatagtgccttcagggaaacacggatattactcagctgaacagggtaagacaacaatggctgctgacatggattagggactagcagactggataccgcagatgaaggagtcgagtggttttagtggatagatttctcaggcaaggtaattaagcagatgaaggcaaacagaggaaaagattggggcacgaagatgtgaagaggtttttagcttcttctaagagttcaagtgttatgagagtagaaatgatacaactttttaaagcagaatcccagctgacctatgatgggaacataatgtgagggaggaataagtgactgttttcttgggcatggggaatttggagctgtctgttactgcagcacaccatagtgtgaccccgtgtgtgattttctgtgtgaccctatgtgtgacaactatttgtgattttgacatgtgacagaattatccaggcttcatgttcaaatgcaatggcccttgccccatctccaaatgtactgatttggaacctggactgaggctggaacacgacatttttaataagttctttaggtataccatacctaccacatttcgaggactagtgaggcacccaacgttgattaattggaggcacctaagatacatttgtgagactggaaacaaggcatagtgcaaccatgacttgccaaaaaaattggtagctttcttctctggcctgaaacaccccgtgccagggtataaatcttggcaagatttcagctactatgggccctcgtgcagggcacagaagtcctatttcaagaggttattaaagtatattctttcatctaagaaggtacatttttcaaaaattgtcaggatatgcagtattctaatattgtatcaaatggacacctgagtaacatgacctgacatgttaattcatgtcaaagttttattatgtctagaattatggtgagattcttgattaacaattcaaggtaatattggttggcaaatctttctattattggtgtaggaataagggctgattctgtctataatcaaaataactatgtttcattacactgcaatttaaagtaggtttatataattcaaaattctcagcattttatatgaaatgtacataaaaatattaattatgtgagcctcctttcctcctcacaaggatgacactatttaagttatttcaacaaaatgctaattattatgaatacattttaaattttacggaacttgaaaaatactttaatagttatctcaacaatggtacggggtaaaaggtgaagtttataaagaagcagttttctcatagtaaacctgatcacaaattggtaaaaacaaatgataaaaagtgaggtgaaatgatttgcaaaaagaagtactacactgccatcttctgttcaaataagtcatatgcttcaattgctatctgatcttaatgtgcattgtacttgggagtggaggggcggagaaaagagaaacttgtgaaaaactgagattatccgactccttctcaggtattctggttctgtggaatggagatggaattcaggaatctgcctttgtaggaagcactccaatcgagcctatataggtgattccctaaacataccttaagaattactcaaatatatcttggccattgtgaggtatgatgcactctttaaacatgccaggcaacatacagttccatcactgacccatgcaaacagatggttagatttcataatttttaatgtgattttgtttatggctatgtagacagttgtgtatgctagaataattctttatctccaggtttcaactgtggcattctctaatcaaatttgcattgcataaagtcatctttcactcttagattgttttcgataaggaatatgcatttttaaaagaattgggtttctatcatttctattgttttccttctcatcatgtactcactttttttctgataggataattattgatggagctaatttgaccatatctaatgtaactttagaggaccaaggtatttactgctgttcagctcatactgctctagacagtgctgccgatataactcaagtaactgttcttggtaagtgcactaactaatgagaaatctgttcatttcttcatttctgattaaatcccatcgttcctggccaataaagctaatgattctttgagcccctgcacatatattgttagtttcaaatttttgtttaaaaagcaacacaacttcaaatcctttctccttttttcatataaaagaaattaattaatgcttaattttttttccctacatgtgttaatttgccaatagcagtgggaggtaagtgatgctatccgcagaaagaaaaataaagcacgcttgagttcctagcactcttgagctactctttcctggtgtacaaagaaatggggctgaggaatggaggtgggctagactggaggatctcgataggggtcaagaggtggatgcacggtggtcatctctaaaccaaaggcacagactgagttcccagggttccaggaaggatggagaggaacttccagcattctacaaaggaatgtctttgatttttgtcgttgttgttgttgatgaaagtactaatcaggaaacagtgtgcacacttcactagtataatcaatgcaattactcctgaaatcaccaatgtttaaagctcttagaccatctgctggatgttttccaaaatttcccttccagattcactctctaccagctctttgacctagaaaggttgcttttaaggacaacatcagcaaaccactttccttccagctattatttggttcagcaagtggagggccgtttggagtgttgtactgattctccctactccatccctgtggactggctgtgtcccactgccaaagtcatggcttctgcagacagggtctcctcacaccattccttctgatgaggctctagcagctgcatcccaccaccaatatttcaagtctctctcacacccaacctactgaacatcctgcccacatctttttaaagacgttttattaaaacattttggaactatcgtaaatttgtgtgagttattcattgattttctgcagggaccctaacagctacagacatttgttctgtttcggtggccaccatgtagtctttcttttagtttgcagacattccttaaaagtgttggttttgcctacccttctttatcatatgtctacattaatcactgttatcaacagacctttgtgtctttagcactccagctgttggggccacctgttaggttccaaacaagggaggtggtggtacagaccaagggagaaagttcagtctcttctgagagactgataaaaaaatgggtcaacaggctggatcccttcaagtaaagcaaatggccaacctgtctcgggcgaaacaaatggccatcaaggttgggttctaaaataaaagaacagtttccacttacagaaggtatggacttgtagagttgtcgagtcggctcagtagaattgtacctttaggcagaatgtttggccattgggtatttgagcattttcaggtctttacaagcagaaaggtttaatcccctaggatgatttcaacaataattcatcagataaagtagtcgagcttcagataaactggaattcatcccaggcctagtgagtagaggggtaagtgtcaggctccgtgcgctttgtccctaagtattttgagcagtctcagccaccaaaaggaccgggtctcctactgcttggtgctccccttctcaatttccttacaaaatttaaaagttcattcttgcgattaggctgccatttttggaactattaatttttttaattctacataaattttacctacgattatatgtactggttatatacgcagtaatctaccagtgtttacagaataaaaataaaaataaattttggagaatattatgtttaaaatttacattcttttattttttagacaaacttctgatttaccaaagcatctctcgacaattgacaataaaaaaataattatatagacacatacgaggtttctaaaagactatgttttaccccctggaaaacaattttttaaagtacatacttgaccccctttaatcaaaagttatttttaaaagccttgacataaacatgctttcaggatatcattttttaaaagtttcagttgcaagttcatcagttctagctccatacgattctcagaagagccagattttaatatcagatgcaatacacagccttagtttattccaggaagcttcagaaatcagtggactcagtaaatactgaagagaaaccaaagtcctctgagctcagagattctgaaacctgttgaagaattaactttttatttatggctttaatgtttggacacagtcatgaaccacattttttaaaaaacatgttctctcttctgaattggaaacgatgctttttgtcaatgtaaatttctaacaattagcaaatattcaggaggagcaatggacggtgctttccacttggagaagaaagagcccattgaaaggctacattagataatatcttccttttctcttctgctaaaagataaaagtcctccaatgcttgagagaattcaaacccaattttcagagtaaataccattagaaataagatttctttttactgttgctttattttcaaagtaccagaaattttcattttctttagtactcaaaaatttgtgatcatttacttacttaattttccagtttctgtcacaacatttaacaatgccaaatctccctgttctgatataaactgccttcctactctttttgagaactccaggttaagacggtatcaaagttgctataatgaaaattcattgttatcaataatgataaaaatccaacacagttgcagaaaagaaagcagagctcatgatctctttttctataaccataagacctaatgtttattgctttaatataataattatacacatgattgaagtaataatatctttttcactgatttatttagttataaaacatttatgtgtgaggcactgtgggcaatgcaaagcttaataaaatatgacccctattcttggagatgaatcaggcatataaacaaatatgtactggacaaacagaaatgattcatttgagatacatcatgtttcccagacttgggtatacctaatccccatccaaggaacttgtttgcaaatgcagattcctgggcccaccttcctcagtaagccagaaatagggcctaggaattttcattgttattaactactcctaaaagaattctgatgtccctggtcaaggataaccccttgagactgtaatcagagaagagggaggtaatatggtccattggggaggacatgtggagatgctgcattttacaaagaaccccagaccccagagcctgatgcgattgaacacagtggagacatgggcccagaaaagaagggtttttatggaaccaaactggggtccaccaacccagtgcagtaagaccaggtatctatactgaggtttgcagtgggagaaaggaagacacttatctgcagggcaccaaacaagaactggtcagctcatgcttaagtcccaacctccccagtggcttgcaggtgaaggtatttaaaagcaggagtaaatttcaggagagcaaatgctataggcaaaatagtaaattagtacattgaggttacacattgctttatgcctaaaagggtgaggtatcttgaactggagttggggcatggcttacaggtcataggtggattcaaagattttctgatttgcaattggttaaggaagagaagctttgtttaaaaattgggagtcagccaaaaagaatattagctctggctcatggatgtggctccctttaggccctcaggaagaaatttacaaaaaatgatggtcagaactcagacttcagtttccccttatctgaggtctccatgccagcaaagttatttggtgagagtctgggttccagaaaaacaacttagagacatatattaagatgttatcttcagtttctataggagaaccaaacatccctgtgattccagcttccttggctattgtttaaagctactattacctccgttcttatcaagttgtttatttacttcttagggctagctaggtgcctgaattacccttgaaactccacctttcccttccatatgtggggtggggggcgggggtgcttcccaggtccctaagagggtggtacctcctctgtctccgggtagctggcaatgtgtctgaggaagggaatcaggtaaacaaaggcaattatctacattttcccttcctttattaattagatgttccggatccaccagaaaaccttcacttgtctgaaagacagaacaggagtgttcggctgacctgggaagctggagctgaccacaacagcaatattagcggtaggaagacttgggataactgttttcattactctagatagtcaaaattaatagcgaagtcactttttaaccactcttactggtttattcttcttataacatccttttgaacttttaatattgagtataaattttggtataacttatccatactccatacattctaatattttttccctgtttatactaccagagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcaggtatgcaggttctcacatcaggtttctaacaaaatatttgtttgtccccatctttgaacatctaaaaaaaaaagattgatagagtaatgtaggattttagatttctccaaatagtgttaacagttctctaaacagcacacaaaatattcaaagcacacaagtttcagaagtgttacatacgagttcgataaaagcaggaaattaggggagtgacatatgaaaaaaaaacattactttcagtaattttgtgatggctaaatatcaagtttaaccagatatcatcaagtaagttctaaattaaaattcaatatgtatgcatctaacattattaatttttatgcattcagtgtcttttcttgtgtctcaacatcaatctaaatttccaagatgcgtttgaaaaaatctcaaggatgactgctaaaatttgtattactgaattgttattgatcatcaatgtggtcatagcatgatattttatttttccttggctaaaataaatactctaggacataatttcctttttggactgagaaaaagcaagtgaaggttataactggatcagatagaaattaacacttgtgtgattttagtgcatgtcaacctttgcactaaactccacatttagctatttctaataaaacgaatccatctaaaaatattcatgactactgtacaggttttattcattttgatgtccttaaaacttggctgctgatattaatacatggtgtttactttattcttctacaggcaaatattcacaacatatgtttctaatgacaattctaatagaaaaaatagagcaggcttaaattaaaatttttttttaaaaaagcaggttcagaattttaaaaagcagttttaaaaattttaaaagcagattcaaaattaagacacatatactaaaccatctactctccactggataataattatttcactccaagaagactgttttactcttttaaataaaatacatatttaaaatctaccttaaatctttttaggaactggaccagatataaattaataagtacaatcaaacttacttaattatctgtgtttttggggggcaggagttgtgatatgatgacttacctatgggttaaaaggaaaaataatgttaatgtttttaatttttcagctccagataggaatccacaaaacataagggttcaagcctctcaacccaaggaaatgattataaagtgggaggtgtgtatttcttaatacgttatgtatttctttgtgcttttctcttcctcttaggtctgcatgctaactacaatgatagcacaacatttttttaagaacaaagataagatttggaaatgaaattaacttgtgagtcatcatcacaaattttaaagatcattgtgattaaaatgatgttatgaaatcgagtttaacactggtcaacaatttagggaagattatacagattgatttagttgtaatacattaccgaagtttcaaattattaataatttaattaacaatattctagattctcttccattcaaaaaatactgaaaatctttaattaatttagtataatctactagatattatgcatatcaaactgatgaacccccataaagtattcactactcattaaacaccagtagacattttgtattctcctttctagtaattctgaggatggtcttgtgaagaaagcatcatgaacgccttattctagatctggagatggcatccaggattatgaatgtcttgcccatcaccacacaaccagaaatccgcaaagctaggatttatgtatgaggatctttggactccaaacctcactttttcctcctttacatatctcggttaaatgttattaaatagacttcaccatttgaattttgcataaaaatgcccatctacccagataattttaattattctagggtcatttccaaattttttctgtaacagtggggcattttattttctctctactacttggatgtatttaatgaccagtatattggcctacctaaaaggaaattatcattcaaccattctgatgagtaataggcctccaacattgaatttataaaattttgtgtaaacatagaacatttttaatgtatgctgaaatatactaatttatttccacaattcattccaggtataatttttgggagaattttagaatgcacaaagtttagtttgctttttatcctcatatgttggtctttgtactcattacacaatcacatggcccatacctgcaaaatatttagtcaatattttttagatcaaaattagatctttatttccacttcagtgaaattaagttttacaagtttaagatgtggaaaactttttttaaaatggtaatacatagaaatgaaatatattcaataatattatttctttccttgaatgtgtggttatagttactactacattgtcttgataattacttaatttatagtctaaaatgatgttagtcttttagggtgtatctgtattatcctcccttaagttccatagaaattttcataaagtagataatatagttggttagatatcagtaatactgtgtatttgccagtcagttcctcagagaagcacatcatgttccagtaacattagctcattaatcctcactactcctttgggagggctgtggtccatgatggtgtcagtcttatatgtcataaagagaaactgggaatctcagagtttaatgacctcacccagatgccatgggctgagtcatatggaaaaaaggccagaaatcttcagtctttttgactgctcctctcactcataagtcattttttattaccccaaagatacacaagattgattattaatgctctcttcttgtaagaatgggactgtactaagaaagcatctatggccaggtgctgtggctcatgcctgtaatcccagcactttgggaggccaaggcgggcagatcacaagatcaggagtttgagaccagcctggacaatatggtgaaactgcatctctactaaaaatataaaaattagccaggtgtggtggcacatacctgtaatccctgctacttgggaggctgaggcagaaaaatatcttgaacccgggaggtggaggttacagtgagttgagatcatgccactacgctccagcctgggtgacagagcgagactctgtctcaaaaaaaaaaaaaaaaaagcatttaaaattggtctttgaggagcaaacgacatgtcatttagtaattaattgactagaggaaggaagtagtcacaggatttggatctaggctgacagttacattcccaatatgtcccatggtgtctcctattatcttgatgtgtcagagatctaatcactactgacacagccagtgaagtttaagaacattcattcactgagtatggttctgtatggatcatcctgcggaaaggagttagactccaggtttttcccagtttcacaatcagatagtattgtgaatgaattaccagaccccctccagagatgtactagaaataattcctatctacatgataatggtcagagggacataatttgaaaaaaaaaaaaaaaaagctgatctttcccaaaagaattaacaatgaagatgagcagtaggaacagactggacatccctaatttttgtttatttgtttatgttttacatttaacattaaacatgattcaatttaaagtaacattacaatttaacttaatggtagaactaggctttttagttagcattaccttcagacattcacttctcatatattaagtcggtcatgactcactcatatattttgagtgttcgaacatcataatgttctacttgcaaaacaggacaaaagagtctactgcaaccttatcagttaaatacctgtatcaggataatttttgcttgagagtttccattgttcttaagcatatgtatgtgaatttttaactttgctcagcaaaataacacatttcaaacttaaaggacaccaaaagcaaaaccaaaagcccaaaaccccactaatgttgggaagcaggaacatctttaattacctggttatataatcgcatccaagatagttaactcctaatggatctaggttttattatttataatacaagtataataagaagacctactggctttaaaatgaaaataagtggaattaaatgaaatattgtataacataatgactatagtagataacaatgtattgtattcttgaaaattgttgagagactaggttttaagtgttctcatcataaaaaataagtatatgaagtaacatatattttgagtagctcaatttagccactccacaatgtatacatatttcaaaacatgttgtacataataagtagatacaatttttgtttctcaagaataaataaaaatgttcaacaattttttaaaaaatggaatcaaggcaggacggcagtctttctgttttctagattaatagttataaccttgcttgggtcatagatctctttgaaactatgttggacgtgcaagctctttttctagaaaattacacacaaaaagtcatactaacaatatcattggtttctcagatcctctaaaggatacacatgtaccccatctagagattcctacaccccacgttaagaacctcttttctaaagactccttcctcgtgggctccttcacgagaggcagagggaagggaaggctggtggcctcttcctgcttactctgccctggctccttttgttctttcttgaagagattatttgggaaatgtctgaggctcagtaggcattgccttcaagtcaaatacaaagcattcaggctgtttatttgggttcccaggtactaaaaaggccgctaatatagctaaaatatttttgtttaaagtgttatggtttattatttatttatttaaaatttgtcagagaactttattaaatttaactcctttctttggagcaaaatgtgtaaaatgaataatattatttgcacacacttattgtcagcagagactgaagaaaactatcattccagattgcagtacggcactacaagcccatggcctaattcactgggacaatgctaaagcccctggtgaatttatatccatttcacactctaaaatatcttggagcaaaactttccaatgaatccaagtattaacaaggtctgcagaaaatctcagaaagttttcattttgttttgattttttttttccctcagttagtttagtttattcaccttggaataggaatacacttaaaattattttgctgatatgtcactaccctttcaacttaattccaagcaatgcctctaataagtgttttagtaaattagattaagttgagaaggattacagattctgtaagaacactatgtatgacattgttgactcactcacatatccagagaaaattactgtttatataagtgaaccttaaatttaggattaaaatcgtattttaaacttattttatataactgattcatttcaatgcacaatcccattatctttgaaagctaaacaggcagtttaaaccacattattgtttttaaattaaagtgttgctcaattaaaaactaaagtggaaataaacaatttcccatactagaaattattcctccaggctgggtgctgtggcccatgcctataatcccagcactctgggaggccgaggcaggcggatcacctgaggttgggagttcaagaccagcctgaccaacatggagaaaccctgtctctactaaaaatacaaaattagccgggcgtggtggtgcatgcctgtaatcccagctactcaggaggctgaggaaagagaatcgcttgcacccgggagatggaggttgccgtgagccgagatcacaccactgcaatccagcctgggcagcaagagtgaaactccgtctcaagaaaaaaaaaaaaaaaaagaaacgaaaaaaaaagttattcctccaaatatttctatggagaaaaataaagtgggtaagggtgacattttttcttaaagaaaaataaagaatggtcaaggagctgggaaattataagaaagaggagctactgtttttttgtattaaaatatgaacattcatattctccaaaaatatttacatgatctctctcttcttatagaagaaaaatggagaaggatagaaccaggtgcaagaaagagttctcttcaaaaagccatgggagaatcccattcacaaccaaagaattcgtggccatattattttttatttcagcctgttctttgaaaatgaaaaggcggaatgtagtggaaagcataagcaaaaagctaaaacactttgtggaatttctttgtaacttccttcgtgtgtaaaaacttaagactttaccatgaggacataatccaggcatctgattgtaggcttctcgttacttggggagttaagggattaattttcatacttaagctcatatgatgacaaaactttttcacaactgtctctaaaccaagaagggggatttaagatctctcaacaaatgaccatttcattacattgttccttattccacttagggtggttcaccatcatctctgagtcaacacatctgtgatcagactaaatgagtcttgccttctgttttagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactgtaagtgatgcacctaaaactgctaagcacgtcagtaactgttgctttcaaatatattgtacttcaatcaacaaatatttgtgaacaactactgcatgcaaagaggatgtactagccgtgggagataaaaacaaatataacacatgacttctatcttaggattgattgtaggacagttgatcgtatagagtaccaaggaagtatgttgaaagttttcattttattcagtttcctataaagctctttctacattgaaaattgaagacctggaattatcactgcaatcatttaaagcagcataactgtcataagattttcaagtacatctgccctttgcccttacttgtcaaggatcccctaagagccacttgctctcatgccctgggcttcagtggcatgtctggagctttcctaatactgatgagatatatacccagatttatatgtagaattatatgcacacacaccttctgatgccatagtaactgctgcaaataggttattggaagaagaaaaaaacactgcattctgtattgctaatactgtgaataatattaggggttattctcattgcctttccagcatctaaaggaataatttgatccaaaaatagaaaaggttcagaatgagaaatagccaactcattactcacctgccgtctaaattcttctacccaaataaaagcacacaaaacacatatcacaagtgaattaagatagtattagccttgactgctctgtatttggcttattactctgtagtaagaactcctgtagaacagagataataatatcctcttcacagggttgtatgaaccaatttaggtaagtcccttagaacagtgcctgacacatagcatatgctcaaatgttagctgttattaatatttgattaacaaaattcctgaccaattttatttatattactagtttaattcacttgcttccaaaggcaagatgcccacagaatagtttctggttttatttatccacattgtatctatctggagggctttgtttctcagtgtgatacagtctgtcctcttctttgggaaatctatttgggctgataaacttatctatcatgagaaactcttttggttccatttggagtgaatttcacaaaagtgctttctccagaagaaacattatgaaaatttttgaaaaggatcctaacaatcacatttgcaggttattgaaaactaatcaatcttctatgattaacagatcctgatacagctccagtgatccatggggtggacgttataaacagtacattagttaaagttacctggtcaacagttccaaaggacagagtacatggacgtctgaaaggctatcaggtttttatcatcatggtttttcctcttcttgttgaattggtatctttcctgagaataaagaagaattgatttcagaagaagtcaaagagaatctgcgaccacaatggatatactaaaagattttggttttcattgcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggaggtgagaggataatgatgtagagtcatgtcaaaaatggaggtgatccatggccatattaaacattcttccttatggccaggcacagtggctcatgcctgtaaatcccagcactttgggaggccaaggcagatggatcacttgaagtcaggagttccaaaccagcttggccaacatgatgaaatcctgtctctatcaaaaatacaaaaattagccagatgtagtagtgcatgcctgtagtcccagctactcgggaggctgaggcaggagaatcacttgaacccgggaggcggaggttgcaatgagccaagattgggctactgcattccatctagcctgggccacgtgagactctgtctcaaaaaaataaataaataaacattattccttattagtagttaattaatatttacttcagatgagtttgcttgtcaatttctataaaatttataatataataaggcttttttgaatttttctaattgatgtgagtttatttttggtcttgtgttttctagtacctgaacagccaacttttctaaaggtcatcaaagttgataaagacactgccactttatcttggggactacctaagaaattaaatggaaacttaactggctatcttttgcaatatcagataagtaagtagaaatttgaattggagttaacttgttaatgtttcattttttggttgaatattctctgtgctatgttgggagtctaatgatcacttaaggccatggtttgtaagctgccgttcttccttgtagcccaggggtctgtaaactggcttgcaggccaaattcagcctgctgcctgtttttaggaataaagttttatgacgacatggccatgtccacttatttatatatgtctacagctactttctccctggagtggcaaagttgagtcatctcaatggagactacacagcctacaaaggctaaatgtttaccgtctggccctttaatgaaaggtttgcttacctgttttagaaaaaaagcagtgtgctgatgggtacacaaaacacgtgtttaatgtttatatataagatgtttggagaagtaggaaacatgtgaaagagttattgagtgatgtgatggagattcaaagcataggtaccttccacgctacctcttctgcctcagatatatgctcccagactcaatcctaaatatgcttgtgtttatccaatgtctatgggttgctcactgtttcatggagatgatattgcaaggactaaataattgtctttggatcatgactcagaatgggctctgcccagatgctgctgtgcgactagagtaacgtgaatgtgtttagatgagatcaggtcgtttttaatagcagcgcgttccctctgaaacagtcgtcaagtttaagcatcatctcaaaatggaaattcggggattgacattatagaaaattttatcaacaacccatcatgaaaattttaggctttcaagacatcaattcccaaaacaccagaaatacagagacccagcacacactgcttactagtcaacttgatcatagtcctgttgtgctactttcacatcagctcaagacttccagcaatccaggtcacgtatttgctttagtttctgatggtttctgctgaaattagcacgtatgtttaaatacatacaggcataatcccaacggaagtagactttagcacttttacgtgcttgctaagtagcaggatcaatactaagtgtatctctttgcattgtgccattaaaataagaaatctattagaaatgtactatcactattttatgaatgagggaattgatgtacatcagagtcaagtagtaaaataagtgttaagtgggaggccgaggctggtggatcacgaggtcaggagatcgagaccatcctggctaacacggtgaaaccccgtctctattaaaaatacaaaaaattatccaggcgtggtggtgggcccctgtagtcccagctactcgggcggctgaggcaggagaatggcgtgaacccgggaggcagagcttgcggtgagctgagatggagccactgcactccagcctgggcgacagagccagactccgtctcaaaaaaaaaaaaaaagtgttaagaatgcaaagcaagatcagtccaattctagatgttgagctcttaaccttatattagtcgatgaactggttttcaaaaaaattgtaagaactgcagaaatattttaagattcttttaaatgtcaatttgtttggtaaagatataacttctccttatcctaacaataggaaactcaactaattaaattcccaccttcatattgatccgtatgtgacatttacgtttatttaaaaacaagttcttagaatatagaagttgaaatattaacaattgtaatgattattgaactgcttgatatgtgtattttaaaataaaataatatataattattttgctttctattaatattaattgatcaagacattttaggtagtttacctttttcttattgcttttagatattttaaattgttgcaatttatatgtatgagagctctatgtatactctcctgaattcttatattgattgtagtcgtttttcaattgactttgtggtcattcacaattatgtgttcaaaaaatctaaaaaagtgatgatttcacctccttctttccaatgtttgaatgcctagtttgtttgttttttcttttcattgatttgaattgcatttttatggaccaaggaaggcatttttatgtcaataataaatgcatttttttaacctctatggtatcttggactgggagtcaagaggatttattctacattccttcttgccactaacagctgcactatcttgggtgtatttcatctcttggactattgttacagtaatcttataatactccatactcttacacaaatctcatgtctttgctgggttccaaattctttgaaagaagctgtctatctgattcagctttttacagtgagcactttacatagtacttagtacacagtagatattcttaaatatttaatatattccttcatttattgattctatgtatactgagtagctatttggtgccacatgttaaactagaaaccatagaagacacaaataaattatcatctcaattattcttccaaaaggaaattataatacttaagtcaaagatacaatgaaaatatagcaatggggaaaattcattattattaatgcgtattatgaagctggagcagctggctccaatatagcacagggattaaagacgtttctctggggtcaaaaggccatggtttggattcaaatcccagtctgcaaatttagagacccaagatgggagcaaagggcttattcttgcgagacctcagttttgtcatatatgatatagtcatagtagttgtatgtacctcataggattaaatgagttgatggttatgaatcattaatgtatctttacgtaccacaagcataaggagaaatgaaaataatgaagaatgcaacttgaatggttaaatacatttgagctgttgttcatgtttatttttttagtaaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaagtacatgaggcttctctttttaatagaggctttaaaaagagactgcatctttttaaacagctgcactgaaaggaaagcaccgtgccagtcattgtaaattagaaatgattgtgatcccactctgtctgaccttctgttttccactgacatagaggcagaatttattaatctgtttggaaagttcacactgactcaatttatggatttctgcgcaataccaatcaaattatagcttagtgtatacaaggtcaggaactataattttacttaattaaagtagcaggacataaggtcacaaagctattcaaaaggttagtaaaggtacgtttttcttttagaaatgtttccatacagaaaaatatttggctcttccattggtagacattacagatctaatacatctcactttcatgccttcactctatatacattgattcatatgtcaattttgttttactgtctgatgatggatgccaagcaactgtctgggaaatggcttataaatgtatggtttcacttgtaacacaattatcctaattcaattacacttttctgtttttttctacctttaaccatttcctttcccaaattgcatctccagttatgattttagtgaggttcttgctaagctttctatgatagcaacaggacctttgcagagaaatcaggtcagaggaactgatgtacacacgaagtgaaacagagagagatttatgtagggcttaggctgttcaggcatggaaggatattggagaaagaaaagaaggatgtagaagatggcagaaagggaaatagagttgtttatttatcatgtattaagtgtggtgcaaaagtaattgtggcccttccattaaaagtagtaatggcaaaggccgcacttacttttgcaccaatctaatactatgtgtcagactgtgttctggatgcttttccaagttgtagattagaaaaacggtagaatcaatgaaagaaacatcacagaggggaaaaatagtagagaaaatgcagttgcctattatttattgaagatgtatattaaaatatattcaagcttgtgagtgactgtaaatcaccgtgtttgtgtgtgaatggttatgctctgacctttaatattggtttgtttttacatcttattgtgcctactatatctaactaataacaagcttacgtttttctcagattccttaaacatttaaaagccctttatgtgggaaaattgtataatccaaataattacttccctaaaactcacaaagtattcccagggatgaattgaacaccaagtgaaatgaagaactaatttcactgactttacctactcataaaagttagacttaaagatggggattggaaacttcccagtaactaaaaggttcttatgtctgaagcattggaactgacatcaagtgtccaatacaaagagaagtcagagtggtagtagtccaaacatgcaactgccatatttttaaaaacagaatttaaggcatggagttggttgctattttgatataaccaagaccataatgtgcatgtgaaatgctgatcccattcttaccaattggaagcacatgagaaaaaatattcacagaattgcctgacaagtgttacacattctagtatatatgttgcgaaatttgggcttggttgcattcgtgcttgagaaattgtttttggaggatgaaagtgctgttcatgtgattttacaggtgatgtggcatcttttctttaaactaaaaatgtaactaatgtgctgcatgtcttaaagaacatttcttcactgtcgtatgtgtcaggaatttaaaaatgtttcttactggtgtgtttgtgctctttttcaggaatccacattttcagtattccagctaactgcccccttcccgagttgacactgatttctattctataggcatgtcttgctataagtacagggaaaaaaattacaatctctttttctactagagttcaacatgatctttgaaaaaaatatatatttccaatgaggagagatacatcttgttatcagtcagcactctaaaaatgatcacttgtgcaaataggaacctactgctatgcatctttcttcttgctctgcctatatagctcatttcaaggtcatttggcatttgttcaaaaaataggatttgattgacaagtatttttctctgattgttttcactctgatttccaagtaaatcatattccataatctaagaggggaaaagatggagttaatcagaaatattatttttgtgtcattagcggtttgaataaatcacttgctttactctatttttcaaaagcttgcactacttaatgttatactaatatctctgtttttcaaggtcaaaattaattgcactctgtttcaatgacgcttaatcttgaaggctttgctcatataattggccttatttctctcatggtgtcatttttaataaaacctttttgttatttagtaactatataattaatttttattttatagtgaaaatacataatgaaatattgatctgtaacatatacccacttaaaatagcatttcataaccccttgtagtctcagtaagaaacatattttatatcattgttaacattttctgggttatgtttattatattgagttgattcccagcaaagctgtggatcacatgcaaaaatatttaagatatttggtggtaagacaagaagttaacatatttttgttcaacttgattcattttatcttctactatgagattctactattaacatattgacatattaatattttttgaaaagtattaacttctcacaccactttcaaaatgtcagtaaaaccattccattggtatgtacctgcaagcctgcatttcacgtagtttggacttctataaatttcaaatatttaatatatgaccatattttaatgctatttcatcagtgtttatggagaagaccaaagcaaaaaaaagcaatatatagttagttacgattataaggttatgtgctgtcaattataagtcaaaaggccatattcagtttcgcattaggtttgcgaaaatccaaattgcacaaaattatattgtataatttttttaagtctgtggttttgaaccattcatgtgaccaggcagatttacagtaccatttcatcttaaatggccatgcattgagttcatttcatttactcaatttcattatattaaaaaagaaagttgaaatgttgattttcttgatctcctggtaattcaaaaactatctgagaaaatatggtataagtgactttcttattcacctctaacaacaatatttttttatgtcctgtttttccatgattacaattcacatgatttaactgtgtacatttcttaggtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagaggtgagaaatgagattatatttggggaagtcttagtcaatctatgtcctgtagaatacttagtgttgcctgtgtcctatattaaacataaaaacactgagtgtattaattatgaaaatcgtaatttcaatttgttttgacatatttttaaattatcaaaatgaaaaatgtttcacagtagtccaccatcctttattttgtttttactagagttgttgcctaaaaatatctcctgctaattaacatatcttaataacacaaactaaaaagaaaaagcaaaacaaaacaaaaaccaccggtctccatggtcatctgcttctaaccaaggcagcttgcgcttttgtttgctccttgctgcttctgagtttaacttcatctgccttcattatccttctttggtttttcatcctcggaatcaaacacaactcgaagaagtccctttttaaataaagaaggaaagatttaccagtattctcccattaacatgtccttcaaattgcattccttctggggtcattaaaaaaactgatactatttggtatgtttaaaaatgatgtctaattttccccaatgttacagaatacaaaagactgtttctagtttacaatgctgtgacttctctttctaccacagaatatgctggtttatatgatgacatctccactcaaggctggtttattggactgatgtgtgcgattgctcttctcacactactattattaactgtttgctttgtgaagaggaatagaggtggaaagtactcaggtaaaattgtttcttaatgtgattttcaacttattaaaaagcattttctgggaagcattcttcagagacaactttttttaaaaatacacattcaagtcaaatttatattagcaagttagatgtacaatgcactgacaggaaaaacgtattgctaaattaaccaaagaaaatatgtatgttctagtttctagcacttaaaatgggctctaactgccgggcgcagtggctcacgcctgtaattccagcagtttgggaggccgaggtgggcggatcatgaggtcaggagatcgagaccatcctggccaacatgatgaaaccccgtctctactaaaaatacaaaaattagccgggcatggtggcagctgcctgtaatcccagctactcggaaggctgagacaggagaatcacttgaacccgggaggtggagtttgcagtgagctgagatcatgccactgtacttcagcttgggcgacaagagcaaaaactccatctcaaaaaaataaaaaataaaaaataggctctaacaaggttgataacacttccaagcttctattgtctatctgtaaaatatcagcgtcgttgagagacatatcactaggtcacatatatgctttagtgttttaagaagtgacccatgtatagcacgcctctctctatgcatgacatacatgactcatatttttcgcactagtgcattctaatattactggctccactggtcaattttgttggtgttaatcattactaggaatgcatttcttattaccatggcatgtagtagacacactgcctcttgaattaatgatacataagatatacatgaaaaccatcatagttggtaatatgacgtttgcctttaatttcattcaactcccgaatttgttttgtctttttcagatatacatattgtatcaagatgatgattattactagtattgcttagtattcatgatgcttttataaagggacaaagatttaggttacactgctatttgtttcatgatgttcagatatatgagaagttcattactggcttatgatttatctagcaaatatttattgggaacccgtcatctacatagaaacattgagagcataatttctaggtttttgtaaaatgacatgcataatttatggagttatgcgtttcacttttttctctgaagactgaatgattatgaattaagttcacaatgactaataaatgttctgagtaattaattggaaacgttaaagagttatagcattctccttatccccaacagataatcatttgtgtattgtggtgctatccagattccaaagatgtttcttcaaatcatgccctaaaaagaaaaaaaaaattagcatttcatattgtagagcaactaagagaatctactaggtctctgcatgtagtcgtaaaatgttccaggaagaacaatttgtatttgagggctttttttttttttttaagtaaagggaacaagagctttttggtcttatattccactaataagagaaatcagccaggcatagtggtggctgcctgaaatcctaactactcgggaggctgaggcaggagaatcccttgaacctgggaggcagaggttgcagtgagccgagatcacgcctctgcactccagcctgggcgacagagtgagactgtctcaaaaaaagtaataataaaataaaatgtcagtggagacctgaatattcagattgttgcaacaattttgagtaagagtgatgtataacaaccaaatgactgcctttttttttttttttttttgagacaaggtcttgttctgttgcccaggctggagtgcagtggttctatctcatctctttgcaacttctgcctcccaggctcaggtgatcctccaacctcagctcctcgtgtagctgggactacaggtgtatgctaccatgcctggctaatttctgtgtttttaatagagacagggtcttgctttgttgcccaggctggtttcaaactcctgatataaagtgttctgcccaccttggcctcccaaagtgccgggattacaggcatgagccaccacatccagccttgattgactttttaaattcaatttagtttaatgacacagatctaataggtgtctatgacatcttcaaaaagttcagatagtaaaataaatatttagtaatttggtcttcactgagaaatcaaactcagttgggctcttccaataagacttctcgttcacataaaattgagtagtcacgtgaaaatatgcaacatgctgcaggtgtgacgacaagtagaaccccccaaaatcccctctcttttttgtttaaacaaagaagcaactgatgggctgtaggtatagccagaaaaaaatattgcctcactggtatcaaaacatttgagcaatgctgttcttactgactattaactattccacagcactggtaaaatgtcttttaaatggtcactgtattacttttcccactttttttctcttttttagttaaagaaaaggaagatttgcatccagacccagaaattcagtcagtaaaagatgaaacctttggtgaatacaggtaaacataaggttctgttgtaaaataaaacacatattcatcatgttgaaagcttaagtgaacaaaaaggtgtttattcttaataaaaaggttacataactacaatgtaatgaccctataaagaatactttgtacaaatagggcccacttaagtgctagcaaccaaatttctgtgtgtgtgatgagggtgtataaataattaccgtctaggcagaaatgtcaggtaggacacttttcttgaagctctgtgcctaacacaaagaatatctatttggggtagctaaaacatctatagcatggccattatgaactcgggttcaatccaatttgcatccacacacgcatatctgtatacctacagcgttgcacctgcaaaggtaagtaagttacaaaccctgtcctctagatgaacctgatcagcagagaaaaatatcctatatatgcaaatgactgtaatgaattaaatagaataaaagagcacaaaagagagtaactgtttctgcccaggtaggattttggaaaaagaatcatccataagagataagctaagccttaaaggataaaaagtattgtgttactgttaaccactggacagaggatgaccaaatgagtgagggtgtgtcgggcaagggaggaatggcaagaagtctactctgagctaggtaggaatctttcggggacgtgttaaactgtctcattctccttttatctttctccaccttcccctttctgctactctctcaacttcttagttcttttttgttgtaatgtcatcatttttctcaggtctcctgtatatttcagccaacagacatattgtaagttccaggtttgtattgattttagcacatgggaaaccagagtttatattaaagaagaaatctgattgatcctgattctctcatctctggattcattactctagcaagggatatggagtattttcattagctaattggtagacatttgggcttacctgtacctccattttgtggtatacttatttttctgtattctacttagtcaataccctttttatatttttatatttcttaataaatgactttaaattctttccagaataaagaacaataaagagaaagaaagaaagagagaaaaagaaaaaggaagaaagaattttggaacttcacgaattgtgatcattactattgtattagttagcagttgcctcataacaataaccaccaatactcaacagcttaaaacaataaacatttattatttcaatgtcctcataattcaggaatccagacatggcttagatgggtacttctggctcaggacctctcatgaggttgcagcaaggttttgaccagggctatggtttcatctaaagtttcagccaaagcacaaatcattcctaggccattcgtgtggctgttggcaggatatagttccatacaggctgttgaactaagggcttctgttcttcacaggccagaggtcattcctaactccataccacgtagatatctccatggggccattcacaacatggcagctggcttccttcagaatgtgtgagccagggagcaagagagagcacccaagttggaagccacagtccttttgtaacctaatattggaagtgatatcccatcacttttgttgtattctataggaacaaatcattaagtttagctcacaactcaaaggaagaggattatacaagatacaaattccatgaggcaatgatcattaaggacctgcaacaacttttcaaaagctgaggcaggagaatttcttgaactcaggaggcggaggttgcagtaagctgagattgtgccactgcactccagcctgggcaacatagcgagactccatctcaacaacaaaacaaaaacacaaacaaacaaacaagcaaaaaaaaattttgaaagacaatattagctcaattttacaggcaagaaaacaaaaacaatgccttgtctaaaaacccatttccccacaccctgctgctcctttataaagatagctaacatcttcctgtgcattatttcctatgacatccctttatagtagctgatgtgttttccaacctctttcccccaaactacatatttatcaggataattgtctactttccacattatcccaggagacacttttataagatgctgtgcccttgcataagtcctcattcttctagcttctgataatcatcccttttgttatttttctttattctttgttcctgattcctcagccgatgcctcattgtttttcttgatttgttcttgtaactgcaatatcctaattcaagagccaattatcgtatcagtcaggggagcctgtgttatgctgctgtcaaaacaactccaaaagcattttctttctcaagttatgtgtcccacagagattgcccttttcatcttaatcacttaggagcactggctggtggacgagcatccaggctccccacagcagggaaaatagaatgtaataaactgagcactggctttaaatctttggctcggaagagacacatgtcacctttgctcactttttttttaaaccaaagaaaattccatggtggcatataacacagagtaggcaaagaagtgccatcctgctttattcctagaaacctgacatacttgatgaacagctctgacaaataccacaaattataaagtgatatgtacatccaaattatattttttccaaatgcttcattgatcaaatttgataaaatcattttatatggtgtatagcttcataatgtaatactaattggtacttaaaaaaatcttgatccaaaatttagaagatcataccatttgataagcatttcactaatggatttgcttctgttcatgaataaaacacctaccataaatatagtatacttatttatgttcttaaaataccagccatttctttctgtcttaaaatgtaacaaacttgaattgttaactatattaaagaaagttatttggtttcaaaaacagaatgtgattgatttttaaaaaagaacattttatcaggatataagagaatcaaaaggatcagaagtaaaggcagaagatcaagacttggaggccaggagctccaaaagttcatgacagcaagggaaattgcatttgttctctgtctgagtccattagggctactataacaaaataccataagctgggtggcttataaaagaacagaaacttaattcccacagttcaggattctgagaagcctaagagcaaagtgccagcattttcaatgtctggtgaacgctcactttctgggtgacagatggcaccttctctttgtgtcctcacatcgtgaaaggggtagggcagctctctggggcctcttctctaagggcactaatatcattcactagggttccacccttatggcctaatcacttcccaaagactccacctctaacaccctcacattggttatcaggttttaacataggaagcttgggaggacacagatattcagaccatagcagccactgtggacatcaacaggttgaatcccacatgtcctacagaagctaagctgctcaattttaaagagaagcacaaatgttgtgaataatgaaaaattgtttggtggaaattgcttatgactttgtagacatgtgtttacagacttcgtaaacttggtaaacatttgtggtagtatcatgtgggctttactatctgtcttcaatgctaacacaaatgtcctgaaaattataaaatcttttatcacttatgactgtgttgctttacatgaatattaatattagattttgttgagctatttttgtttgtttgttttctagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaa

SEQ ID NO: 2083 - DNA, 212820 bp, Homo sapiens; identical to SEQ ID NO: 2080

SEQ ID NO: 2084 - DNA, 14310 bp, Homo sapiens
gcatggtgggtcatgttttaatcctagcactttgggaggtcacagcagaaggatttcttgaaaccaggtgtttggaccagcataggtaacctggggagatgctgtctctacaaaaaaaaaaaaaaccaattagctgggcatgttgacatgcacctgtagtcctagcatcttgggaggctgaagaaggagaattgcttgagcccaggaggttgaggctgcagtgagccataatcacaccactgtattccatcctagggtggcctacagagtgagagcctgtctctctgtcttaaaagaaaaagaaaaaagaaaaatgaagcgattactaccaattctaataaaataatgattatgaaagtactataaataattgtatgccaataaattggataacctagatgaaatagacaaactcctagaaacacacaaaaatatgaatataactataatcagtaagaagattgaatcaataaaagcatttgatgaaattcagtattttttcataataaaaacattctaagaatggaaggcaaccacctcaacataaaggcaatatgtgaaaaacccaatgctaacatcttacataacagagaaagactgaaaactttccctgtatgagcaggaaaagacaaggatgcctgctattgacacttttattcaacatagtagtgaaaggtctaatcagaaaaattagggaagaatttttaaaaagacattcaaattggaaggaaggagtaaaattatttctgtttatagataacttgaacttatttgtagaaaatcctaaagatggaacaaacctattagaattaataaattcagtaatgttgcacaatacaaaatcaacattcaaacatcagttgtatttcaatacactaaccatgaacaatctgaagggaaattaagaaaaataatttcaatttatattcacatcaaaaagaataaaatatttaggaataagtttaaccaaagaggtgaaatgattatacctgaaatctacaaagtattgctgaaagaaatgaaagatgacatcaataaattgaaagacattttgtgttcatgaattggaagactcaatattgttaggaggacagtgctgcccaaagtgagctgcagattcaatacaattcctatcagaatctcagtgacatttttgcagaaaaagaaaaatctgtcctaaaatttatattgcatctcatgactctaaatagacacacagctttgaagaggaagaatgaagctggaggactcacacttcctgatttcagcatttactacaaagccccagtaatcaatacagtgtggtactggcataaaggaggacatagaaattaatgaaatatcatagcccagaaagaaatgcttgcatatatggccaaatgattttcatcgagtgtgccaagatcgttcaatggggaagggacagtgttctcaccaaatgatattgggaaaggtggatatccaagggcaagaagagtggaacctttacctaacaccatgtacaaaaattaacccacaatagatcaaagatctaaatgtaagagtaaaaactatacaactcttagaagaaaaacttcatgatagtggatttcacaatgatttcttggttgtaacaacaaaagcataggcaacaaataaaatggataaatcagacttcataaaaatcaaaaccttttatatagcccatgcaaagttcctcagcatcacgaatacttagagatatgcaaatcaaaaccacaatgttacaacacctcacacactttaggatggctttgataaacaacaacaatgacagcaacactaaacaacaggtgtttccaagtagatggaaaaattggagctctagtgcattgctgatgggaatgggaaatgttatagccaatgtaaaaagtagtgtggctgtttttcaaaaaattaaacaataaattaccatttgatccagcaattccccttctggacatactccctatagaattgaaagaaatttgaagaaatatttgtacactgatgtacagagaagcattactcacactagccaaaaatggaaacaactgaaaagtccattgaaagataagtgggtaggcaaatgagatgtatctatacattgaaatgttattcaaccttaacaaggaagaaaattacaatacatcgtgcaaaatggatgaaccttgaagatattatgccaactgaaataagccagacacaaaaggataattattatataattccatttataaaagatagttagaatagccagttacatagagacagaaagtagaatggtgggtgttaagggttagggggagaaggagtgagagttactgtttattgggtacagaggtttaatatggtaagaggaaaaagttctggaaatggatagtgtgatagttacacaacactaaattgcacacttagttaatggtaagtctaatattagatatatataaagtgtctcgtggtcttgccctctctataattacacactttttggcactgcccctttcctgccatgcagagccccaggggtgaatctccctatttctctagctctgcatcagtcactgtcctccgtgctgtgtcccacgtgctgtgcccaaagcctcatacagctggtgacttcagagccaggatgcagctcaggagtcagccctgaagctccctctcttcttatttccctgcagcctggcccgggggaggcttggcttcaactggcagctcgatttagccaacttcaggacaggccaccagggccctttctccacacatgttggttccaccccaggtggagtcaggcagggccaggccagtcaccagaggagcccggagcagagcaggaagcagagtctgagctgctcctccctcacccaaagggcttcctcctctcatttgggggaaaagtgtgagcttgtttcaaagcctcagatgttccttgtagctcatggaataggtacaagaaaacaaagacatggcagaaggggatgtgttcgtgacagcgagaagcaacttgatcttgaggactctccttcttgtccctctgtgaagcctcttctaccacatagggctcagggctgataaagccccctccctacctttctcaggccagacacaaggtcagccatgagaaaacagaaaaacaagcagaagagagtctgtagagataagttgggagggttcaggaggagaatttgggatttgcttgtgcccatgggacacagtctgggaatacaaatgttttcctgactcttctctgaaagccagatagactccacctaaaaccctattgccaaggatgctgggatccacttaccagagactttgactatcatggatttggagatttccttgccagtggctgagttacgaacagagcaagcatagagcccgctatgatttgtagtaatttgggggataaagagcttttgtcctgatagctgaaacttcccattaattgtccaagaatactctgccggtgggttagagtccgcaaagcaggacaagtcgaggttttctcctgaacggtaataggtgaatgaagggtaaattctggggaggtctggaccatctggaggaaagagaataaagccacaggtgatgtcatccaagggaaggggatgctcctggtctcttaaagggacacagtgaccctctgaaccaagacacaacctcaagtgacagccaaatcccatctatgtttactaagcccaagcctgaggtattcccctgtttctctcattacaagctgtgggcccctagtgtcccatgacaagagcgcccctccccttatattcttggttaaggctgtgcctacccaggatttcccagggcagggagtcatggccaggtctgatgtccagaagtaaagttgtctatacttggaccggagagagactgagaggcctggcctctggtcgtttggagttaagctggtgtcctggcccacagaggaacaaaggatactcacagaggacattcagggtgactgggttactgcggatgccaccatatcggtcccgtatttcacattgatagggtcctgtttcatttctcgtgacactgggtagaatgagtatcctgttttcaatgggtcgctttaccctcggactgaccgggaggctctgaccatttagccaccaaatgtaggtgtagttccgactcttaggttcacaggtgaaggctaacacatccttcttctccctggggtttaagttgttgatggtgatgtaaggcatgggcagcttcgctgtgtggataacagaagattgtcctgtgtggcacctttgattcctccacaggcatccttcattcagagttggcatctcccacctgtcaacccacatgagtccttgaaagccagtagctggtgcatgtgtcacaagacagatgtatgatgatctaagggctcaaagactgtgaggcctcctgctctgtcttagggaagcacagactttctcaagtgtcaattgagcagcagtgttgggtcatggacagacacgtcagtgggagtcacagcccctggtacccctcccagtccctccataatcagttgactggctggctcaccctgggttccttacctggaatgtgcaactgctgggccccttccaaattacatcctactttgcccccctagatgtgatttctctgcagcttccatttccaaggacattctagagatgagtaataatgggacttcccattgtcctgaaaccctgcagatactgagcagcctggcctgggactggatgtttcagcagaaataacacagggaagaccagagtcaagcctgtaggtcagttcagtcatcaggcactagaggcaccaggtggggcagtttttttgcaggtgtttcatgatgacttacttgaaccagtgacctctaaagatagagcagagtgcaaggaatgatctagaaagagtgaaggggacaggcaagagctggtggctttggagcagaagcatgttccctgtcctgggttctttaagtttcctctccttctgcagagggcaggtgaggaccatgtggatctttctagaaatacatgtggacatttgcaaatgcagaactgagtggtggaaagggtgggaatgaactgctggaaatctagtcctcatggaccatgtgtgtttgatggatatgagacaaatttggagagaagttttgcaaatattttctttcattggacattctactctctgattccatgggttccactaatctagggacctcatgtaagttgattccagattgaatatgagacgaggctgctggaagccaggagctgggagtggggagaatcagaagttgttcatgggtgtgcagtttcagttatacaagttggagaggttctagagatctgctgtagagcttgatgcctatagttcacacagattatctcttatgcataagttttaggacaaaaagtgttttggatttctgatattttttgattctcaaatatttgtcatatacttactggtttagcatcccaaatctgaaagattcaaaatgtaaaatgcttcagtgagcatttcttttcagcatcagattagtaggcaaaagtgggaggtgataagccagatatattcttgcccttttttttctctcaccatgtttctagcttggtgattagttttcggtgaattccatagtggccatgctgcactcgtatatttttgaaggctttgggatgtgagaaaggctgattgctattttctatgtcatcagaactttccaccttttctggttgcttctttttctcagtgtttgtgttgtggcagtcattaagaagagcctgtcagctcagatttaggacagagttttctaaattctgcaaaaaatgttactgggattctggtaggggttgcattgaatctgcaactcaattgggtagtattgcctttctaacaatattgcttcttccaatccatgaaaatgaaatgtgtttccatatattgatatcgtctttaatttctttcagcaatgttttgtagttttcagggtataatcatttgacctttttggttaaacttattccaaaatattttattccttttgatgttaatgtgaattgaaattctttccttaacttcctttcagattgttcattgttagtgtattgtctaaagaatgatctagaaagagtgaaggggacaggcagaagctggtggttttggagcagaaacatattccctttcctgggttttgattttccctctccctttgcagagagcaggtggctcttccctgacagctagatagactttactggaaaacatggtgccaatgctccagggatccacttaccagggactatgatcctcttgattatgagatttgttccaccagtggctgagttatggatgaaacagacatagacccctctatatgttttagtgatttggggtataaagaacacttgtgctgattgctggaacttcccatcaatcagccaagaatgctctgccagtgggtgagagtctgtgaggcaggagagcttggggacttcccctgtatggtaataggtgtatgaggaagaaacggtgggagcatccaggccatgcggagcaaagagaataatgtcacaggcgatattgtcagagggaagggaaaatcctggtctgtggaagggacacagtcacagtgaccctgtgagccaagttgcaacactgaagtcccagccaaatccccgctgtgttcactgatctggagcctgagacattcacctgtttcttccatcacaagctgtggaacctgagtctcccatgacaggagaagcctcttctctcttattgttgatcaagcctaggcctactctggtttgcctggagcagaaagtcatggccagctttgatgttcagggataaaggtctctgtacttggacctgagagggactgagaggcctggcctctggccacttgtatttgggatggcagcctggctcacagaggaacagaagatactcacggaggagattcagggtgactgggtcactgcggctggcactcactgggttccgtatttcacattcatagggtcctgcaatatactttgtgacaccaaatagatagagggtcctgttggttttggacagctgcaacctgtgagtcatagggaggttctgaccattcagcaaccacaggtagcttgcatccggagtctcaggatcacagattaagcgcacagcctccatgacctccctggggtttaagttgctgctggagatggagggcttgggagtctccgctgtgcagaaaacagagagaagattgccctgtgtggcacctttgattcctccaaaggcatttttcaatcagagttggcatttccaacctctcagcccacccaagtccttaaaagcccatggcaggtgtgtgtgttacaagacagatgcatggcaacctgagggctcagtgattgtgaggctgcctgctttatgtaggagaagcatggactttctcaaatgtgaattgagcagcagcattgggtcatggaaagacacaggaccagcagtcacagcccctggtgcctctctgagtccctccgtctccaactgcctgcctggcccaccttttggtccttacttggggcatgcagtgctggaatcttgttagtttcagtctcactttgccccctgaggtatgttttctcatcagcttcccttgccaaggacatcctagagatggatgatggaacttcccattgtccttaagccctttgggtattagaaagcctggcctggaactgggtacttcagcagaaataacacaggggagaccagagtcaggcctggaggtcagttcagtcatcaggcagtggagccacaaggtggggcagttttccaggtgtctcatagtgactgagttgagccaatgactctaaagatagagcagagtccaaggaatgacctacaaagagtgaaagggacaggcaagagctgataggtttggcccaagaccatgatccctgttctgggtccatgatgctcccttccccctgtagagggcagttgaggaccatatggatctttctagaaatacatgttgatgtttgcaaatgcagaactgactggtggaaagggcaaacatgaacagatgacagaagtctggccctcagggaccttatgtgtttggtggatattagaccaatatttgggaagaagtcttgcagatactttctcttattagacattctactctctgattctgagtttgactactctatgtacctcatatcagtggattccagagggaatcagagattagaatagtagtttgcagcaactgaaatcacgggtatagggcgttgttccgtgggtgtgcggtttctgttatgcaggatgaggaggttctagagatctcctgtgcagcctcgtgcctatacttcatgcagatacagtgctccttatgcagaaagcttaaaacaaagtgttttggatttctaattttttttattttggaatatttgcagtatatgtactggtttagcatcccaaatctgaaaaatttaaaatccacaatgcgcgagtgagcacttctttttagcatcacatcagtggtcagaagtgttgagttttgagcatttcagattgtggatttctggatttccgatgctcaatttgtaatactgtaattttcccataaaaagttgtcaggagtttagacctcatgttatattctgactctagtaacaaaaaaaatttggaggaaaccttaaaatgttttcataagtggaaatttttactgatggtccaaacatctaagatcaattgctggtagtcatatttctcttgagaccaaaataaggtttaggtgtgccatgaattccagcaggatcacattatgctcaaagaaagatgccaaaggtgatttgaaattagcaactccttaagtagagagagtcctgttaaaaggaccgaactggttagtgtgtcaattacataaaaggaggaaggatgccaaattaaaagaagtgatgtgtgttatgttagtaaatatagaaagaacctgcttctaatttctgtgcagagttacaaaacatggggaggaccccaaaacaggtatgtgaaatgtcttcttcattttctcttaaggtcaggaaacaccactaaaatttaagtttgtgtgaattaggaagagtctaagtgagatgccaatggctcttgtgtctccccacacgaagaactccaacttatgaaaacggcatcatcatgaggaaatagttgtatgtggcacaggcagtaaaaccatgagataggacctacctggccacctccatctggtccccaaaccacaagtattcccgttaagtgtatgtgacagcctttgtagttgtcccacaactacaaaatttaaaaattgctattgtcaaaacaaaatattaaatatgaagttgaatatgttgttccgctttttttccccactctttttgagctttcctgtttcagttttggaagtttctattgacacattctcaagctagggattctttcctcagctctgtgcggtctatcagtaagcatcaaaagcattcttcatttctctaacagcatttttttttctgagacagagtctcgctctgtcaccccagctgcagtggcatgatctcagctcactgcaagctccacctcctgggttcatgccattctcctgcctcggcctcccaagtagctgggactacaggtgaccaccaccatgcccagctaattttttgtatttttagtagagacggggtttcaccatgttagccaggatggtctctatctcctgaccttgtgcccgcctcagcctcccaaagtgctgggattataggcgtgagccactgtgcccagccatctctgaaggattttaatgagttgttgacttttgagtttgttcagctttttacttagtgttagaaccgagtgacaaatttcaagcttgttttatgcctgacaggaagccagaagtctctagaaagtgaccggagaatgtgagctccatagcaggttgaggatggagtcactagtgaaatgggtgaaatgagcctatgggcttaattgctcctataattgctcctatagataacatcactattgtagaacgtgagattggtcttttgaaatgtttctcattcttttgccttctgacaaccggctgacctcatccatacctatgcctaatggctcagccagtcatgtggcccctacctagaggcagattcaagcactaacagatcatttccctccgcccgcatgattccatcaccaatcagcagtactcattttttagtcctgtgcccctgaaactatccttgaaaatctctaacacctgatccactggggaggctgatttgagtaataataaacctccaccctcctgtttggcagacttggagttcttaaaatctttctttactgcaaaccaccatttcaataaattttattttattttatatttttttgtgtgcaggaggccagaggaacttgtctggcaattacaagggtggatgggggaactgcctatccctgtcccatggtcttgtccacaggtcagcctcacaaagggaaagagccctggatgggaatacagtggaaggtttctcttagtgacctggggacattggctcgagaggaagcctggcaggagtggcaactccaggtgatttctgcacctttcctatttcctgggaggtgggccaggccacagtgttagcgggaagggaacagaacagccagcctagttagagggagtgtctggggaaggcctagggttggaggaagaagctgtgcaggacagggcttgccagtcagaatgaagtgggaggaagatgagggacacagagaagcagagagaggcagagacaccatggcagtgagcagtgagggagacactgacttcaaaaaccccagggaccaggtgcccccagctccacagtccaggaccaaagagccctgagaaccctccggtggccaaagaacttcagagttgcatgaggtggggtggctttagggtcaagaggtagtggggggatgaaacatgggtgtcagcctctgaaggacaagggacaggtgtggctagaacctcctaggattctgattccaagatccagtctctaaagaggttttggatcatccatttcttcattccattccttcatttgttatgtgagagctcctgagtgtgtctctctcactgggcctgtgctgaggcagggtgtgagtggggaaagaaaacaaggtcctctccttgatcctctcatgacggtgacatggacacttgggaaacacaggatttcacattcagtgatggaggttaagatctgagggggagacctggacattttttttgcactgactctggcggttgaagccagtgatttagttctggagtacagactaatcagctgaccatttgctctcactcctctgaggtttggatgcctaagaagagaggatttgagtcaataaatgactatggggtccttggaacccagtaagccctcacttctggtagaggagaggatgggcctgtggctgcagacagacctcatgtgaccccgatctcccctttgtgtttgtgtgactgtggctcagtgactgtgccttcctgtgcctcagttttctctcaatcaaatgagctaaatggcaaatggactgtggcttttcatgctatctgtgaataaatgttaaagtattcacagtcaactgacttaatgcttggcacagtggaggtgttcacacaaacagcatttattattaatttgcttccatgagaaagcacctttgcgtcagatccctgtggacaaacggctacctggtgcatcttctctcttctgtttctgcttctggggatattagactttctatggagtgtcctaggcctcctaaggcagttggctgatggcctacaaagcttgtctttctgtcctctccactctgagtgtcaggtgaagaaagctctgtccttgcccagatgaggctctgaggactgagccctggctggtgaacagctccaggagacacagtcctcagacagctggtaaatccttggtcccagtaagccctgccaaagaagccacaacccagtcctggcacaggctcctcagctttacctggagcaaggatttagggacaggggtctgggattgaggcttccagagctgaggttctctgagggtatctcagtgggcccctcaggccaagccctactcagttttccagggtctttctcagggtcaaatttatgaagagggcatgaggtgcttggctgagactgatctcctcctgctgagtccccccatcagactgtccttcctctgcagcgagtgtctgcagggtctggatgcgggaaaggaattctgatctgttgaaatgtgtctcctctgtgtgtgtcctgcactaaatgcccaaaccccagcatgggacataatgcagagagtgacacaggcagagtccaggcctgacaattctgtgtgtgtgaagtagaaatgacccctgccccccaacacccagggatcatgcggaatcactcacagtataaggtgacagtgaaatatccagttactcctccagtcccatcgcctcgctttatgatgtgtaaggtgtaggatcctgcatcctcctgtgtgacattctggatcagcagggatgcattggaatatactgtttctcgtccactgtaggcaggcccatatataatttgaccgtgtactacatatgatgtaatgtaatggtagaggtccgtcatttgccctttgtaccagatgtagccagtaagattctggggcaaattgtggacaagtagaagaacatccttcccctcggaaactttgggtggcttggcttcaattattacttgggcagtggtgggcaggttccagaagtttaaaagtgatgctaggaggtagagacagcatcagttaatatttggacctatgtattggggtgaaaagatggggccctgtgtcctgagaaggtctcttcaatcatcagccttgaagatatgcacacacacacatacaaacacacacacacaaaagggcatgtgtgtttgtgtgtgtgtatgtgtgtgtgtcctactgtcctactaggtcaaggtcagcagcatgacccccattccttcaacactcctgaccttggcatttttctgtttgcaatcctcttccccaggggtccgcacggccccctccacactgccctcaggtcctgctcacatcagggcatccttagacttctttcctgatgcctgcttcagagaccctgggtcttccctttctgacctttccctgctctgctccctctagggttcttgtcaacacctgacctcacattctatatctctttgcatgtctgtcttcctccccatgagagtgtgagctctgtgaggacagagacttttgtcatgttggttgcaccccagtgcctggaacaggatgcagactcctgtagatgtgagagttctcagggccctccatgccctgggtgttttttttcccccaattgttgaggttttttgctgaggaaagtgtttcatgccctggttacatttttatttgaggtgtcatctgatatagtcattattatcatttttcaaaatgtggtggcccctgatgattaatcaggaaaacagaacacttaagattttactacctcttaccaattccggttcaatgtgactttcctattttgacccctgtccctctctggtgtattttcccctatccaggctccaacagagccttctttccctttttttctttcttctttttattcttttttttttttttttttgaaatggagtctcgtactgtcacccaggctggcgtgcagtggtgctgtctcggctagctgcaacttctgcctcctgggttcatgtgattatcctgcctcagcctcccgaaagctgggattacaggagcacaccaccatacttggttaattttttgtattttttggtagagacacgtctacactgtgttggccagactgatcttgaactcctgatctcgtgatccacccacctcagcctccctaagtgctggcttcttttattttttagaaccccatcctctccaggataccccatccagtcactctgcttcctcctcctgtcctctcccaggaagtcctctcctcacctgtgagcaggagccccttccaggtgatgtgctgagtgcagggaggggctgagaggggtcccatggtctctgctgtctgtgtgttctcccctgtggagatgagcctaggatccagagacttcctgagcagggctgtcaggtgtgctgtccttcctccttctgtgctgagcctcttcccagggcagaagcacttctc

SEQ ID NO: 2085 - DNA, 15844 bp, Homo sapiens
cttactgaacttgtgcaaataactttattaccataaacctatgaatactcatgaatagtttcccaattctggggcactcagatagagagcaaaagcaaatgtttcaatttttgtttacaaaagtatactttaccaattgctgaagaaaaaaagttcataaatctggagaataaaacattccaagaatcagcacattttccaataaaaaattatgaaaacattatccttttgattatttagtccaataacattgagtttttttcttctttgtcttgaatttcatgaaggtatcaacctgttctttttctcagtgtctctattgtggcagccattaatgagactctgtctggtttccatggcagggacctgattgacagaaggcccaggtcagcgcatttcaaattcactacctcctttacagagaaagcttctttcccacaggctcccagcaagggtgtgaaagcaagtctagttctccgaggctctctttaactccaatgggtgactggttggaggattcctcatcagccttgcaaaaactcttagaactgcattggtacctaaaacttctttctctttctttttcacaggaatcagctctgcatagcggtctgtgggttctcccatactaccttcatgcctgccccacattccctcacaggtgtcttccctgataaattatcttgtatgtctaatcccatcttggatgcatctcagttggtaaaaactaacataccagacttgattctttgcacttagctttttttctttctctcccacaattagtcagtaaccatgtcctagtgttttatgtgttaccgcttttttcatatctatggaaaaaggtaggtactgttgaggtgcactttctatgtgccaggccctgtgctcaatactttacctgtatctcatttaatccacacaataaccctgtcaggtaggcattatttccattttgctgatgaaaagacagaagcttagcatggtgtaaaaactttcctggtgtcatatggctagtgacaggtggatctgagatttgattctaggactatttgacctcaaggctaatgatgatggtagtaatatagcagctgacattggttcctctttgtgtggcatcttgtttcattgactgcattaaacctttaaaagaatggtatgaagaaagtactcttattgcaattttcaggtgaggaatcaggggttcagagaagttgagtcttgtgcaagaaatttataactgtaaactcttacattaaaaaagaagaaagagctcaggtcaacaacctactttaatacttcaggatacgaaagaagaacaaactaaacccaagcacagtgaatgagggaaataataagtattagggtggatataaataaaatggagaatggaaacagaatagaggaaattactgaaaccaaaagttgattcttcaaaataaaatcaacaaaattgacaaccattaactagattggctaagaaaaaaagagaaaagataaaattactcaaatcataaatgaaaatggactctgagcatggtgggtcatgttttaatcctagcactttgggaggtcacagcagaaggatttcttgaaaccaggtgtttggaccagcataggtaacctggggagatgctgtctctacaaaaaaaaaaaaaaccaattagctgggcatgttgacatgcacctgtagtcctagcatcttgggaggctgaagaaggagaattgcttgagcccaggaggttgaggctgcagtgagccataatcacaccactgtattccatcctagggtggcctacagagtgagagcctgtctctctgtcttaaaagaaaaagaaaaaagaaaaatgaagcgattactaccaattctaataaaataatgattatgaaagtactataaataattgtatgccaataaattggataacctagatgaaatagacaaactcctagaaacacacaaaaatatgaatataactataatcagtaagaagattgaatcaataaaagcatttgatgaaattcagtattttttcataataaaaacattctaagaatggaaggcaaccacctcaacataaaggcaatatgtgaaaaacccaatgctaacatcttacataacagagaaagactgaaaactttccctgtatgagcaggaaaagacaaggatgcctgctattgacacttttattcaacatagtagtgaaaggtctaatcagaaaaattagggaagaatttttaaaaagacattcaaattggaaggaaggagtaaaattatttctgtttatagataacttgaacttatttgtagaaaatcctaaagatggaacaaacctattagaattaataaattcagtaatgttgcacaatacaaaatcaacattcaaacatcagttgtatttcaatacactaaccatgaacaatctgaagggaaattaagaaaaataatttcaatttatattcacatcaaaaagaataaaatatttaggaataagtttaaccaaagaggtgaaatgattatacctgaaatctacaaagtattgctgaaagaaatgaaagatgacatcaataaattgaaagacattttgtgttcatgaattggaagactcaatattgttaggaggacagtgctgcccaaagtgagctgcagattcaatacaattcctatcagaatctcagtgacatttttgcagaaaaagaaaaatctgtcctaaaatttatattgcatctcatgactctaaatagacacacagctttgaagaggaagaatgaagctggaggactcacacttcctgatttcagcatttactacaaagccccagtaatcaatacagtgtggtactggcataaaggaggacatagaaattaatgaaatatcatagcccagaaagaaatgcttgcatatatggccaaatgattttcatcgagtgtgccaagatcgttcaatggggaagggacagtgttctcaccaaatgatattgggaaaggtggatatccaagggcaagaagagtggaacctttacctaacaccatgtacaaaaattaacccacaatagatcaaagatctaaatgtaagagtaaaaactatacaactcttagaagaaaaacttcatgatagtggatttcacaatgatttcttggttgtaacaacaaaagcataggcaacaaataaaatggataaatcagacttcataaaaatcaaaaccttttatatagcccatgcaaagttcctcagcatcacgaatacttagagatatgcaaatcaaaaccacaatgttacaacacctcacacactttaggatggctttgataaacaacaacaatgacagcaacactaaacaacaggtgtttccaagtagatggaaaaattggagctctagtgcattgctgatgggaatgggaaatgttatagccaatgtaaaaagtagtgtggctgtttttcaaaaaattaaacaataaattaccatttgatccagcaattccccttctggacatactccctatagaattgaaagaaatttgaagaaatatttgtacactgatgtacagagaagcattactcacactagccaaaaatggaaacaactgaaaagtccattgaaagataagtgggtaggcaaatgagatgtatctatacattgaaatgttattcaaccttaacaaggaagaaaattacaatacatcgtgcaaaatggatgaaccttgaagatattatgccaactgaaataagccagacacaaaaggataattattatataattccatttataaaagatagttagaatagccagttacatagagacagaaagtagaatggtgggtgttaagggttagggggagaaggagtgagagttactgtttattgggtacagaggtttaatatggtaagaggaaaaagttctggaaatggatagtgtgatagttacacaacactaaattgcacacttagttaatggtaagtctaatattagatatatataaagtgtctcgtggtcttgccctctctataattacacactttttggcactgcccctttcctgccatgcagagccccaggggtgaatctccctatttctctagctctgcatcagtcactgtcctccgtgctgtgtcccacgtgctgtgcccaaagcctcatacagctggtgacttcagagccaggatgcagctcaggagtcagccctgaagctccctctcttcttatttccctgcagcctggcccgggggaggcttggcttcaactggcagctcgatttagccaacttcaggacaggccaccagggccctttctccacacatgttggttccaccccaggtggagtcaggcagggccaggccagtcaccagaggagcccggagcagagcaggaagcagagtctgagctgctcctccctcacccaaagggcttcctcctctcatttgggggaaaagtgtgagcttgtttcaaagcctcagatgttccttgtagctcatggaataggtacaagaaaacaaagacatggcagaaggggatgtgttcgtgacagcgagaagcaacttgatcttgaggactctccttcttgtccctctgtgaagcctcttctaccacatagggctcagggctgataaagccccctccctacctttctcaggccagacacaaggtcagccatgagaaaacagaaaaacaagcagaagagagtctgtagagataagttgggagggttcaggaggagaatttgggatttgcttgtgcccatgggacacagtctgggaatacaaatgttttcctgactcttctctgaaagccagatagactccacctaaaaccctattgccaaggatgctgggatccacttaccagagactttgactatcatggatttggagatttccttgccagtggctgagttacgaacagagcaagcatagagcccgctatgatttgtagtaatttgggggataaagagcttttgtcctgatagctgaaacttcccattaattgtccaagaatactctgccggtgggttagagtccgcaaagcaggacaagtcgaggttttctcctgaacggtaataggtgaatgaagggtaaattctggggaggtctggaccatctggaggaaagagaataaagccacaggtgatgtcatccaagggaaggggatgctcctggtctcttaaagggacacagtgaccctctgaaccaagacacaacctcaagtgacagccaaatcccatctatgtttactaagcccaagcctgaggtattcccctgtttctctcattacaagctgtgggcccctagtgtcccatgacaagagcgcccctccccttatattcttggttaaggctgtgcctacccaggatttcccagggcagggagtcatggccaggtctgatgtccagaagtaaagttgtctatacttggaccggagagagactgagaggcctggcctctggtcgtttggagttaagctggtgtcctggcccacagaggaacaaaggatactcacagaggacattcagggtgactgggttactgcggatgccaccatatcggtcccgtatttcacattgatagggtcctgtttcatttctcgtgacactgggtagaatgagtatcctgttttcaatgggtcgctttaccctcggactgaccgggaggctctgaccatttagccaccaaatgtaggtgtagttccgactcttaggttcacaggtgaaggctaacacatccttcttctccctggggtttaagttgttgatggtgatgtaaggcatgggcagcttcgctgtgtggataacagaagattgtcctgtgtggcacctttgattcctccacaggcatccttcattcagagttggcatctcccacctgtcaacccacatgagtccttgaaagccagtagctggtgcatgtgtcacaagacagatgtatgatgatctaagggctcaaagactgtgaggcctcctgctctgtcttagggaagcacagactttctcaagtgtcaattgagcagcagtgttgggtcatggacagacacgtcagtgggagtcacagcccctggtacccctcccagtccctccataatcagttgactggctggctcaccctgggttccttacctggaatgtgcaactgctgggccccttccaaattacatcctactttgcccccctagatgtgatttctctgcagcttccatttccaaggacattctagagatgagtaataatgggacttcccattgtcctgaaaccctgcagatactgagcagcctggcctgggactggatgtttcagcagaaataacacagggaagaccagagtcaagcctgtaggtcagttcagtcatcaggcactagaggcaccaggtggggcagtttttttgcaggtgtttcatgatgacttacttgaaccagtgacctctaaagatagagcagagtgcaaggaatgatctagaaagagtgaaggggacaggcaagagctggtggctttggagcagaagcatgttccctgtcctgggttctttaagtttcctctccttctgcagagggcaggtgaggaccatgtggatctttctagaaatacatgtggacatttgcaaatgcagaactgagtggtggaaagggtgggaatgaactgctggaaatctagtcctcatggaccatgtgtgtttgatggatatgagacaaatttggagagaagttttgcaaatattttctttcattggacattctactctctgattccatgggttccactaatctagggacctcatgtaagttgattccagattgaatatgagacgaggctgctggaagccaggagctgggagtggggagaatcagaagttgttcatgggtgtgcagtttcagttatacaagttggagaggttctagagatctgctgtagagcttgatgcctatagttcacacagattatctcttatgcataagttttaggacaaaaagtgttttggatttctgatattttttgattctcaaatatttgtcatatacttactggtttagcatcccaaatctgaaagattcaaaatgtaaaatgcttcagtgagcatttcttttcagcatcagattagtaggcaaaagtgggaggtgataagccagatatattcttgcccttttttttctctcaccatgtttctagcttggtgattagttttcggtgaattccatagtggccatgctgcactcgtatatttttgaaggctttgggatgtgagaaaggctgattgctattttctatgtcatcagaactttccaccttttctggttgcttctttttctcagtgtttgtgttgtggcagtcattaagaagagcctgtcagctcagatttaggacagagttttctaaattctgcaaaaaatgttactgggattctggtaggggttgcattgaatctgcaactcaattgggtagtattgcctttctaacaatattgcttcttccaatccatgaaaatgaaatgtgtttccatatattgatatcgtctttaatttctttcagcaatgttttgtagttttcagggtataatcatttgacctttttggttaaacttattccaaaatattttattccttttgatgttaatgtgaattgaaattctttccttaacttcctttcagattgttcattgttagtgtattgtctaaagaatgatctagaaagagtgaaggggacaggcagaagctggtggttttggagcagaaacatattccctttcctgggttttgattttccctctccctttgcagagagcaggtggctcttccctgacagctagatagactttactggaaaacatggtgccaatgctccagggatccacttaccagggactatgatcctcttgattatgagatttgttccaccagtggctgagttatggatgaaacagacatagacccctctatatgttttagtgatttggggtataaagaacacttgtgctgattgctggaacttcccatcaatcagccaagaatgctctgccagtgggtgagagtctgtgaggcaggagagcttggggacttcccctgtatggtaataggtgtatgaggaagaaacggtgggagcatccaggccatgcggagcaaagagaataatgtcacaggcgatattgtcagagggaagggaaaatcctggtctgtggaagggacacagtcacagtgaccctgtgagccaagttgcaacactgaagtcccagccaaatccccgctgtgttcactgatctggagcctgagacattcacctgtttcttccatcacaagctgtggaacctgagtctcccatgacaggagaagcctcttctctcttattgttgatcaagcctaggcctactctggtttgcctggagcagaaagtcatggccagctttgatgttcagggataaaggtctctgtacttggacctgagagggactgagaggcctggcctctggccacttgtatttgggatggcagcctggctcacagaggaacagaagatactcacggaggagattcagggtgactgggtcactgcggctggcactcactgggttccgtatttcacattcatagggtcctgcaatatactttgtgacaccaaatagatagagggtcctgttggttttggacagctgcaacctgtgagtcatagggaggttctgaccattcagcaaccacaggtagcttgcatccggagtctcaggatcacagattaagcgcacagcctccatgacctccctggggtttaagttgctgctggagatggagggcttgggagtctccgctgtgcagaaaacagagagaagattgccctgtgtggcacctttgattcctccaaaggcatttttcaatcagagttggcatttccaacctctcagcccacccaagtccttaaaagcccatggcaggtgtgtgtgttacaagacagatgcatggcaacctgagggctcagtgattgtgaggctgcctgctttatgtaggagaagcatggactttctcaaatgtgaattgagcagcagcattgggtcatggaaagacacaggaccagcagtcacagcccctggtgcctctctgagtccctccgtctccaactgcctgcctggcccaccttttggtccttacttggggcatgcagtgctggaatcttgttagtttcagtctcactttgccccctgaggtatgttttctcatcagcttcccttgccaaggacatcctagagatggatgatggaacttcccattgtccttaagccctttgggtattagaaagcctggcctggaactgggtacttcagcagaaataacacaggggagaccagagtcaggcctggaggtcagttcagtcatcaggcagtggagccacaaggtggggcagttttccaggtgtctcatagtgactgagttgagccaatgactctaaagatagagcagagtccaaggaatgacctacaaagagtgaaagggacaggcaagagctgataggtttggcccaagaccatgatccctgttctgggtccatgatgctcccttccccctgtagagggcagttgaggaccatatggatctttctagaaatacatgttgatgtttgcaaatgcagaactgactggtggaaagggcaaacatgaacagatgacagaagtctggccctcagggaccttatgtgtttggtggatattagaccaatatttgggaagaagtcttgcagatactttctcttattagacattctactctctgattctgagtttgactactctatgtacctcatatcagtggattccagagggaatcagagattagaatagtagtttgcagcaactgaaatcacgggtatagggcgttgttccgtgggtgtgcggtttctgttatgcaggatgaggaggttctagagatctcctgtgcagcctcgtgcctatacttcatgcagatacagtgctccttatgcagaaagcttaaaacaaagtgttttggatttctaattttttttattttggaatatttgcagtatatgtactggtttagcatcccaaatctgaaaaatttaaaatccacaatgcgcgagtgagcacttctttttagcatcacatcagtggtcagaagtgttgagttttgagcatttcagattgtggatttctggatttccgatgctcaatttgtaatactgtaattttcccataaaaagttgtcaggagtttagacctcatgttatattctgactctagtaacaaaaaaaatttggaggaaaccttaaaatgttttcataagtggaaatttttactgatggtccaaacatctaagatcaattgctggtagtcatatttctcttgagaccaaaataaggtttaggtgtgccatgaattccagcaggatcacattatgctcaaagaaagatgccaaaggtgatttgaaattagcaactccttaagtagagagagtcctgttaaaaggaccgaactggttagtgtgtcaattacataaaaggaggaaggatgccaaattaaaagaagtgatgtgtgttatgttagtaaatatagaaagaacctgcttctaatttctgtgcagagttacaaaacatggggaggaccccaaaacaggtatgtgaaatgtcttcttcattttctcttaaggtcaggaaacaccactaaaatttaagtttgtgtgaattaggaagagtctaagtgagatgccaatggctcttgtgtctccccacacgaagaactccaacttatgaaaacggcatcatcatgaggaaatagttgtatgtggcacaggcagtaaaaccatgagataggacctacctggccacctccatctggtccccaaaccacaagtattcccgttaagtgtatgtgacagcctttgtagttgtcccacaactacaaaatttaaaaattgctattgtcaaaacaaaatattaaatatgaagttgaatatgttgttccgctttttttccccactctttttgagctttcctgtttcagttttggaagtttctattgacacattctcaagctagggattctttcctcagctctgtgcggtctatcagtaagcatcaaaagcattcttcatttctctaacagcatttttttttctgagacagagtctcgctctgtcaccccagctgcagtggcatgatctcagctcactgcaagctccacctcctgggttcatgccattctcctgcctcggcctcccaagtagctgggactacaggtgaccaccaccatgcccagctaattttttgtatttttagtagagacggggtttcaccatgttagccaggatggtctctatctcctgaccttgtgcccgcctcagcctcccaaagtgctgggattataggcgtgagccactgtgcccagccatctctgaaggattttaatgagttgttgacttttgagtttgttcagctttttacttagtgttagaaccgagtgacaaatttcaagcttgttttatgcctgacaggaagccagaagtctctagaaagtgaccggagaatgtgagctccatagcaggttgaggatggagtcactagtgaaatgggtgaaatgagcctatgggcttaattgctcctataattgctcctatagataacatcactattgtagaacgtgagattggtcttttgaaatgtttctcattcttttgccttctgacaaccggctgacctcatccatacctatgcctaatggctcagccagtcatgtggcccctacctagaggcagattcaagcactaacagatcatttccctccgcccgcatgattccatcaccaatcagcagtactcattttttagtcctgtgcccctgaaactatccttgaaaatctctaacacctgatccactggggaggctgatttgagtaataataaacctccaccctcctgtttggcagacttggagttcttaaaatctttctttactgcaaaccaccatttcaataaattttattttattttatatttttttgtgtgcaggaggccagaggaacttgtctggcaattacaagggtggatgggggaactgcctatccctgtcccatggtcttgtccacaggtcagcctcacaaagggaaagagccctggatgggaatacagtggaaggtttctcttagtgacctggggacattggctcgagaggaagcctggcaggagtggcaactccaggtgatttctgcacctttcctatttcctgggaggtgggccaggccacagtgttagcgggaagggaacagaacagccagcctagttagagggagtgtctggggaaggcctagggttggaggaagaagctgtgcaggacagggcttgccagtcagaatgaagtgggaggaagatgagggacacagagaagcagagagaggcagagacaccatggcagtgagcagtgagggagacactgacttcaaaaaccccagggaccaggtgcccccagctccacagtccaggaccaaagagccctgagaaccctccggtggccaaagaacttcagagttgcatgaggtggggtggctttagggtcaagaggtagtggggggatgaaacatgggtgtcagcctctgaaggacaagggacaggtgtggctagaacctcctaggattctgattccaagatccagtctctaaagaggttttggatcatccatttcttcattccattccttcatttgttatgtgagagctcctgagtgtgtctctctcactgggcctgtgctgaggcagggtgtgagtggggaaagaaaacaaggtcctctccttgatcctctcatgacggtgacatggacacttgggaaacacaggatttcacattcagtgatggaggttaagatctgagggggagacctggacattttttttgcactgactctggcggttgaagccagtgatttagttctggagtacagactaatcagctgaccatttgctctcactcctctgaggtttggatgcctaagaagagaggatttgagtcaataaatgactatggggtccttggaacccagtaagccctcacttctggtagaggagaggatgggcctgtggctgcagacagacctcatgtgaccccgatctcccctttgtgtttgtgtgactgtggctcagtgactgtgccttcctgtgcctcagttttctctcaatcaaatgagctaaatggcaaatggactgtggcttttcatgctatctgtgaataaatgttaaagtattcacagtcaactgacttaatgcttggcacagtggaggtgttcacacaaacagcatttattattaatttgcttccatgagaaagcacctttgcgtcagatccctgtggacaaacggctacctggtgcatcttctctcttctgtttctgcttctggggatattagactttctatggagtgtcctaggcctcctaaggcagttggctgatggcctacaaagcttgtctttctgtcctctccactctgagtgtcaggtgaagaaagctctgtccttgcccagatgaggctctgaggactgagccctggctggtgaacagctccaggagacacagtcctcagacagctggtaaatccttggtcccagtaagccctgccaaagaagccacaacccagtcctggcacaggctcctcagctttacctggagcaaggatttagggacaggggtctgggattgaggcttccagagctgaggttctctgagggtatctcagtgggcccctcaggccaagccctactcagttttccagggtctttctcagggtcaaatttatgaagagggcatgaggtgcttggctgagactgatctcctcctgctgagtccccccatcagactgtccttcctctgcagcgagtgtctgcagggtctggatgcgggaaaggaattctgatctgttgaaatgtgtctcctctgtgtgtgtcctgcactaaatgcccaaaccccagcatgggacataatgcagagagtgacacaggcagagtccaggcctgacaattctgtgtgtgtgaagtagaaatgacccctgccccccaacacccagggatcatgcggaatcactcacagtataaggtgacagtgaaatatccagttactcctccagtcccatcgcctcgctttatgatgtgtaaggtgtaggatcctgcatcctcctgtgtgacattctggatcagcagggatgcattggaatatactgtttctcgtccactgtaggcaggcccatatataatttgaccgtgtactacatatgatgtaatgtaatggtagaggtccgtcatttgccctttgtaccagatgtagccagtaagattctggggcaaattgtggacaagtagaagaacatccttcccctcggaaactttgggtggcttggcttcaattattacttgggcagtggtgggcaggttccagaagtttaaaagtgatgctaggaggtagagacagcatcagttaatatttggacctatgtattggggtgaaaagatggggccctgtgtcctgagaaggtctcttcaatcatcagccttgaagatatgcacacacacacatacaaacacacacacacaaaagggcatgtgtgtttgtgtgtgtgtatgtgtgtgtgtcctactgtcctactaggtcaaggtcagcagcatgacccccattccttcaacactcctgaccttggcatttttctgtttgcaatcctcttccccaggggtccgcacggccccctccacactgccctcaggtcctgctcacatcagggcatccttagacttctttcctgatgcctgcttcagagaccctgggtcttccctttctgacctttccctgctctgctccctctagggttcttgtcaacacctgacctcacattctatatctctttgcatgtctgtcttcctccccatgagagtgtgagctctgtgaggacagagacttttgtcatgttggttgcaccccagtgcctggaacaggatgcagactcctgtagatgtgagagttctcagggccctccatgccctgggtgttttttttcccccaattgttgaggttttttgctgaggaaagtgtttcatgccctggttacatttttatttgaggtgtcatctgatatagtcattattatcatttttcaaaatgtggtggcccctgatgattaatcaggaaaacagaacacttaagattttactacctcttaccaattccggttcaatgtgactttcctattttgacccctgtccctctctggtgtattttcccctatccaggctccaacagagccttctttccctttttttctttcttctttttattcttttttttttttttttttgaaatggagtctcgtactgtcacccaggctggcgtgcagtggtgctgtctcggctagctgcaacttctgcctcctgggttcatgtgattatcctgcctcagcctcccgaaagctgggattacaggagcacaccaccatacttggttaattttttgtattttttggtagagacacgtctacactgtgttggccagactgatcttgaactcctgatctcgtgatccacccacctcagcctccctaagtgctggcttcttttattttttagaaccccatcctctccaggataccccatccagtcactctgcttcctcctcctgtcctctcccaggaagtcctctcctcacctgtgagcaggagccccttccaggtgatgtgctgagtgcagggaggggctgagaggggtcccatggtctctgctgtctgtgtgttctcccctgtggagatgagcctaggatccagagacttcctgagcagggctgtcaggtgtgctgtccttcctccttctgtgctgagcctcttcccagggcagaagcacttctc

SEQ ID NO: 2086 - DNA, 12994 bp, Homo sapiens
gtattagcaaatgtggtacatgttttattctgctagaatcagtattactgtcacattttacaatgtatctcttaggaaatggcgagagccatccacagaatgtgcatttaaaggggactctattataatttcagctttcctacctcttcatagaaaccatcttatctgcaaacacacgggcaatatctctgtgttcatttctattgggagtcctgtatgcaaggtggagagagccacatttccccctgagatgttatgtaaaagtttgggttgagatgacatatctgacactctattgttaccctcagaagctactacatgtgaaattctaatgactgcattatcctgccaagtgaaagaggcaggcatgagcaaggacagttaagaggggtgagagcctcatcatgatggggagtcttgttctgacatcttgggaaaaactgtccacagtgtgaagtcatccacttgttgtcctggtttacagtttgagcatctgttgttatggtgtcgaacattttagtgagttctgagtggctcacccttcaggtacaagggttttcccatgaaatttacattgagttgtccacctccagcttatagggcttctggaacagagtgggtctttttcttagcgattccatggaagaaaatggaattggaggaactagtagaattcagggtaatgtccagtctacaggtggataataaaaacacagaaacaatgaacagagatgcaatctcataacaggtgtactacagtttttattttccacataatttttctctctatgggcatctctagttttaccaatgataatttcagtagaataagtttgtttgcaaaataggttgagtttcttcaaacgtggtctgattgtttacataagtgcagcaagagtagcaatggaccgtgtaggctctcttttaaaattttcttttctctaagtttttataaggaatctgagattaaacttttacaaaactcttgagaataggaagccaaaccaaggctgacttcagactttgcctgcagttcatactggttcattctatctatatccttaaatataacatcccagtcaaagccttggtaatataaccaatgatttgaaatgtgtcctgttacaaagagagcagattgttgctgtacttgtgcaaatatgtgtattaccataaacatatcaattctcatgaatagttgcccaattctggggcagtcaggtagaaagcaaaagtaaatatttcaattacagttcaataaactgcggtatagtttattgaactgctataagctacagataggttaaaagagaaaaattccgtcaatgtagaaaacaaaccatttaaagaatcagcaaattttcaaatgaaaatcataaaaacattatcctcattattatcaattatttcattgaaatcaatgtttttcctgcttggtctaggctgggaattttatgaagatatcagcctgtttgttaaagttttcaaagttcttagacaaatttggagggtttaggaggagaatttgggatttgcttgtgcccatgggacgcaggctgggaataaaaatgttttcctgactcttccctgaaggccagatagactccacctaaatccctattgccaaggatactgggatccgcttaccagagacttttactgtcatggatttggagctttccttgccagtggctgagttacgaacagagcaagcatagagcccgctatgctttgtagtaatttgggggataaagagcttttgtcctgatagctgaaacttcccattaattgtccaagaatactgtgccggtgggttagagtccgcagaacaggacaagtagaggacttctcctgaacggtaataggtgaatgaagggtaaattctggggaggtctggaccatctggagcaaagagaataaagccacaggtgatgtcatctgagggaaggggatgttcctggtctcttaaagggacacagtgaccctctgagccaagacacaccctcaagtcccagcccaaccccctctatgttcactgagccgaatcctcaggtattcacctgtttctcccatcacaagctgtgggccccaagtctcccatgacaagagcgtccactccccttatactcttggttaaggctgtgcctacccaggttttcccagggcagggagtcatggccagctcggatgtccagaagtgaaggtgtctatacttggaccagagagagagtgagaggcctggcctctggtcgttttgatttaagctggtgtcctggcccacagaggaacaaaagatactcacagaggacattcagggtgactgggtaactgcggatgccaccatattggtcccttatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaagtttaagacatccttattctccctgggttttaagttgttgatggtgatgtagggcttgggcagcttcgctgtgtggataacagagagaagattgtcctgtgtggcacctttgattcctccacaggcatccttcaatcagagttggcatctcccacttctcagcccacccgagtccttgaaagccaatagctggtgcgtgtgtcacaagacagatgcatgatgatctaagggctcaaagactatgaggccagctgctctgtcttagggaagcacagactttctcaagtgtcaattgagcagcagtgttgggtcatggacagacacgtcagtggaagtcacagcccctggtatccctcccagtccctccctaatcagttgactggctggctcaccctgggttccttacctggaatgtgcaactggtgggccccttccaaattccatcctacattgtccccctagatgtgatttctctgcagcttccatttccaaggacattctagagatgagtaatgatgggactacccatggtcctgaaaccctgaagatactgagcagcctggcctgggactggatgtttcagcagaaataacacaggggagaccagaatcaagcctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggcgacaggcaagagctggtggctttggagcagaactatgttgcctgtcctgcgttcaagtttcctctccttctgcagagggcaggtgaggaccatgtggatctttccagaaatatatgtggacatttgcaaatgcagcactgactggtagaaagggtgggaaggatctgctggaaatctggtcctcatggaccatgtgtgtttgatggatatgagacaaatttgaagagaagttttgggaatattttctttcactggacattctactctctgattccctggattcgactactctagggacctcatgtaagtggattccagagtgaatatgagaagagactgctggttgccaggagctgggagtggggagaatcagaagttgttcatgggtgtgcagtttcatttatgcaaggtggggaggttctagagatctgctgtagagcttgatgcctatagttcacacaaattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgccctttttttttctctcaccacttttctagcttggtgattagttttcggtgaattccatactggccatgcctcactcgtatatttttgaaggctttgggatgtgaagcctttgaaggctgattgctattttctatgtcatcagaactttccaccttttcatggttgcctctttttctcagtgtatctgttgtggcagtcattaataagagcctgtcaggtgagatttaggacagtgttttctaattctgcaaaaaatgttactgggattctgttaggtgttacattgaatccgcaactcactttgggaatattatctttctaacaatattgattcctccaatccatgaaaatgaaatgtgtttccatatattgatatcgtctttaacttgtttcagcaatcttttgtagttttcagggtataatcatttgactttttggttaaacttattccaaaatattttattccttttgatgttaatgtgaactgaaattctttccttaatttcctttcggattgttcattgttagtgtatagtctaaagaatgatctagaaagagtgaaggggacaggcaaaagctggtggttttggagcagaaacatattccctgtcctgggtttttgattttccctctccctttgcagagggcaggtggctcttccctgataactagatagacttcactggaaaacatagtgccaatgctccagggatccacttaccagggactatgatcctcttgattatgagatttgttccagcagtggctgagttatggatgaaacagacatagacccctctatatgttttagtgatttgggggataaagaacacttgtgctgattgctggaacttcccatcaatcagccaagaatgctctgccagtgggtgagagtctgtgaggcaggagagcttggggacttcccctgtatggtaataggtgtatgaggaggaaatggtgggggcatccaggccatgtggagcaaagagaataatgtcacaggcgatattttcagagggaagggaaaatctcgtctgtggaagcaccacaatcacagtgaccctgtgagccaagtcacaacattgaagtcccagccaaatcccagctgtgttcactgatctggagcctgagacattcacctgtttctcccatcacaagctgtggacgctgagtctcccatgacaggagcagcctcttttctcctattgttgatcaagcctaggcctactctggtttgcctggggcagaaagtcatggccaggtttgatgtccaggggtaaaggtctctgtacttggacctgagagggactgagaggcctggtctctggccacgtgtatttgggatggcagcctggctcacagaggaacagaaaatactcacggaggagattcagggtgaatgggtcactgcggctggcactcactgggttccgtatttcacattcatagggtcctgcagtgtactttgtgacacccaatagaaagagggtcctgttggtttcagacaactgcaacctgtgagacatagggaggctctgaccattcatccaccacaggtagcttgcgtccggagtctcaggatcacaggttaagctcacagcctccatggcctccctggggtttaatttgctgctggagatggagggcttgggagtctccactgtgcagaaaacagagagaagattgccctgtgtggcacctttgattcctccaaaggcatttttcaatcagagttggcatttcccacctctcagcccacccaagtccttaaaagcccatggcaggtgtgtgtgttgcaagacagatgcagggcaatctgagggctcagaggttgtgaggctgcctgcttcatgtagaaacacagactttctcaagtgtgaattgagcagcagcattgggtcatggaaagacacaggaccagcagtcacagcccctgttgcctctctgagtccctccgtctccaactgcctgcctggcccaccttgtggtcctcacttggagcatgcagtgctggaatcttcttagtttcagtcttactttgccgcccaaggtatgttttctctgcagcttcccttgccaaggacatcctagagatgggtgatggaacttccaattgtctttaaaccctttgggtactggaaagcctggcctgggactgggtacttcagcagaaataacacaggggagaacagagtcaagtccggaggtcagttcagtcatcaggcagtggagccacaaggtggcgcagttttcccaggtgtctcatagtggctgacttgagccagtgacctctaaagatagagcagagtccaaggaatgacctacagagagtgaaggggacaggcaagaactgatagctttggaccaagaccacgttccctgttctggatccatgatgctcccttccccctgtagagggcaggtgaggaccatgtggatctttttggaaatacatgtggatgtttgcaaatgcagaaccgactggtggaaagggcgaacatgaacagatgatggaagtctggccctcatggaccatatgtgtttggtggatattagaccaatatttgggaagaagccttgcagatactttctctcattagacattctactctctgattctgaatttgactactctatgtacctgatatcagtggattccagagtgaatcagagagtagaataggagtttctacgagctgggatcagggcaatagggcgttgttccatggttgtgcagtttcagttatgcaggatgaggaggttctagagatctcctgtacagcctcatgtctatagttcatacagataaagtgctccttatgcagaaggcttaaaacaaagtgttttggatttctaatttttttttgttttggaatatttgcagtacatgtactggtttagcatcccaaatctgaaaaatttaaaatgcacaatgcgccagtgagcacttctttttagcatcacatcagtggtcagaagtgttgagttttggagcatttcagattgtggatttctggatttgggatgctcaatttgtaatactgtaattttcccataaaaagttgtcaggagtttagacctcatgttatgttctgactctagtaacaaaaaatatttggaggaaacattaaaatgttttcatgagtggaaatttttactgatggtccaaacatctaagatcaattgctggtagtagtatttctcttgagaccaacataaggtttaggtgtgccatgaattccagcaggatcacattatgctcaaagaaagatgccaatggtgatttgaaattagcaactccttaagtagagagagtcccgttaaaaggaccgaactgggtagtgtgtcaattacataaagggaggaatgatgccaaattaaaagaagtgatgtgtgttatgttagtaaatatagaaagaactccctgcttctaaattctgtgcagagttaggaaaaatggggaggaccccaaaacaggtatgtgaaatgctttcttcattttctcttaagctcaggaaacaccactagagtttaagtttgtgtgaattaggaagagtctaagtgagatggcaatggctcatgtgtctccccacacgcagaactccaacttatgaaaatggcatcaacatgaggaaacagttgtatgtggcaaaggcagtaaaaccatcagatagcacccacctggccacctccaactggtccccaaaaccaccagtattcccattacatgtatgttacagcctttgtagttgtcccacagctacaaaatttaaaaattgctattgtcaaaacaaaatattaaatatgaagttgaaatgttgttccacttttttaccccactctttttgaactttcctgtttcagttttggaagtttctattgacgtatcctcaagctagggattctttcctcagctgtgtgcagtctaccagtaagcatcaaaagcattcttcatttctctaacagcattttttttttctgagacagagtctcactctgtcaccctggctggagtgcagtggcatgatctcatctcactgcaagctctgcctcctaggttcacgccattctcctgcctcagcctcccaagtagctgggactacaggggcccgccaccatggctggctaattttttgtatttttagtagagacgaggtttcaccatgttagccaggatggtctctatctcctgaccttgtgcccgcctcggcctccgaaagtgctggtattgtaggtgtgagccactgtgcccagccatctctgagggagtttaacgagttgttgacttttgagtttgttcagctttttacttagtgttagaaccgaatgacaaatttcaagcttgttatatgcctgacaggaagccagaagtctctaggaagtgaccagagaatgtgagctccatagcaggttgaggatggagtcatgggcgaaatgagcccatgggctttggggactgcaggcctgtccagcctctgacaccctggtgagtccgtgcaaagattacaacagtgacaggaaactagcatgcctgactccatctggcatctagtctcaggctggctgtcctcactcattgctgggcataggccaggctaaccttgggaggaatttagtttatggtttaaatttgaagcaagaatgataatagttcctccataaaactaacacccttactttgcccagggactgcctttgtaaaactagtgaaagaccatgagattaaggttataggagggaactgaattctgctaaaatgttggcacagtttctataatccctgactgctccgatgtcatttggcaagagtttacaaaagttgtaactaattgctcctatagataacatcactattgtagaacgtgagattggtcttttgagatgtttctcattcttttgcattctggcaaccggctgacctcatccatacctatgactaatggctcagccagtcatgtggtccctacctagagtcagatttaagggcaaacagatcatttccctccgcccacatgattccatcaccaaacaatcagcagtacttattttttagtcctgtgctcctgaaactacccttgaatatctctaacccctgatccactggggaggctgatttgagtaataataaacctctgtcctcctgtttggcagacttggagtcgttaaaatctttcttgactagaaaccaacatttcaataattttttttttttttttttttttttttttttttgtgcaggaggccagaagaacttgcctggcaattatgagtggatggaggaactgcctatccctgtcccattgtcttgtccacaggtcagcctcacaaagggaaagagccctggatgggaatacagtggaagctcattctcttagtgacctggggacattggctcgagatgaagcctggcaggagtggcaactccaggtgatttctgcacctttcctatttcctgggaggtgggccaggccacagtgttagtgggaagggaacagaacagccagcctagtcagagggagtgtctggggaaggcctaggggtgggggaagaagctgtgcaggacagggcttgccagtcagaatgaagtgggaggaagatgagggacacagagaagcagagagaggcagagacaccatggcagtgagcagtgagggagacactgacttcaaaaaccccagggaccaggtgcccccagctccacagtccaggaccaaagagccctgagaaccctccagtggccaaagagcttcagaattacatgagctggggtggctttaggggcaagaggtagtggggggatgaaacatgggtgtcagcctctgaaggacaagggacaggtgtggctagaaactcctaggattctgcatgcaaattcagtctctaaagaggttttggatcattcatttcattccattccttcatttgttatgtgagagctcctgagtgtgtgtctgtctcgctgggcctgtgctggtgtagggtgtgagtggggaaagaaaaggtcctctccttgatcctctcatgacagtgacatggacactttgggaaacacaggatttcaggttcagtgatgggggctaagatctgagggggaggcctggacatgttttttccactgactctgatggttgaggcaggtgatttagttctggagtacagactaatcagttgaccattttctctcactcctctgaggtttggatgcctaagaagagaggttttgagccaataaatgactatggggtgcttggaagccagtgagccctcacttctggtggaggagaggatgagcctgtggctgcggacacacctcatgtgaccctgatctcccctttgtgattgtgtgactctggctcagggactgtgtcttcctgtacctcagttttctgtcaatcagataagctaaatggcaaatggacagtggcttttcatgctatctgtgaataaatgttaaatgattcacagtcacctgacctaatgcttggcacagtggaggtttcacacaaatagcatttattattaatttgcttccatgagaaagcccctttgcgtcagatccctgtgggcaagctgctaccaggtacatcttctctcttgtgtttctgcttctggggacattagactttctatggactggcctaagcctcctaaggcagttgtctgatggcctacaaagcttgtctttctgtcctctccactctgagtgtcaggtgaagaaaactctgtccttgcccagatgaggctctgagggctgagccctggctggtgaacagctccaggagacacagtcctctgacagctggtaaatcctcggtcccagtaagccctgcccaagaagccacaacccagccccagcacaggctcctcagatttatctggagcaaggatttagggacactgttctgggggtgaggcttctagggctgagcttctctgagagtatctcaggggctcctcaggccaagccctactcagttctccagggtctttctcagggtcaaatttatgaagagggcatgaggtgcttgtctgagactgatctcctcctgctgagtccccccatcagactgtccttcctctgcagcgagtgtctgcagggtctggatgcgggaaaggaattctgatctgttgaaatttgtctcctctgtgtgtgtcctgcactaaatgcccaaaccccagcatgggacataatgcagagagggacacaggcaatgtccaggcctgacaatcctgtgtgtgtgaagtagaagtgacccctgtcccccaacacccagggatcatgtggaatcactcacgatataaggtgaaggtgaaatgtccagttactcctctattctcatcacctcccattatgatgtgtaaggtgtaggatcctgcgtcttcctgggtgacattctggatcagcagggatgcattggaatatattgtttctcgtccactgtatgcaggcccatatataattatttgaccgtctactacatatgatgtaatgtaatggtagaggtccctgatttgccctttgtaccagatgtagccagtaagattctggggcaaattgtggacaagtagaagaacatccttcccctcagaaactttggttggctgggcttcaatcgtgacttgggcagtcgtgggtgggttccagaagtttaaaagtgatgctaggaggtggagagagcatcagtcaatattgagagctatgtattggtgtgaaaacatggggccctgggtcctgagaagttctcttcagtcctcagccttgaagacacagacacacacacatacaaacacacgcacacacacacacaaaagcggcatgtgtgtctgtgtgtgtgtatgtgtgtgtgtcctactatcctactaggtcaaggtcagccccatgacccccattccttcaacacttctgaccttggcatttttctgtttgcaatcctcttccccaggggtccgcatggccccctccacactgccctcaggtcctgctcacatcagggcatccttagatttctttcctgacacctccttcagataccctgggtcttccctttctgacctttccctgctctgctccctccagggttcttctcaacacctgaccttacattctagatctctttgcatgtctgtcttcccctccatgacagcgtgagctccatgaggacagggatttttgtgatcttggttgcaccccagtgcccagaacaggctgcagactcctgtagatgtgagagttctcagggccctccacgcccttggtgtttttttttccccccaattgttgaggtttcttgctgaggacagtgtttcatgccctgtgtatatttttatgtgaagtgtcatctgatacagttattattatcatatttcaaaatgtggtggcccctgatgattaatcaggaaaacagaacacaagattttcctacctcttaccaattctggttcctgtgactttcctgttttgacccctgtccctctctggtgtatttccccctatccaggctccaatagagccttctttcctttttctcttttttctctttttttttttttgagatggagtctcatactgtctcccaggctggcgtgcgatggcactatctcagctagctgcaacttctgcctcctgggttcacgtgattcttctgcctcagcctcccgagtagctaggattagaggagcacaccacaatatctggttaaatttttgtatttttagtagagacagggcttcactgtgttggccagactgatcttgaactcctgatctcatgatccacctgcctcagcctcccaaagtgctggcttctttcattttttagtaccccatactctcaaggagaccccatccagtcactctgcttcctcctcctgtcctctcccaggaggttctctcctcacctgtgagcaggagccccttccaggtgatgcgctgtgtgcagggaggggctgagaggagccccatggtctctgctgtctgtgtgttctcctctgtggagatgagcctaggatccagaagcttcctgagcacagctctcagcagtgctgtcctgcctccttctg

SEQ ID NO: 2087 - DNA, 12994 bp, Homo sapiens; identical to SEQ ID NO: 2086

SEQ ID NO: 2088 - DNA, 11448 bp, Homo sapiens
gggacgcaggctgggaataaaaatgttttcctgactcttccctgaaggccagatagactccacctaaatccctattgccaaggatactgggatccgcttaccagagacttttactgtcatggatttggagctttccttgccagtggctgagttacgaacagagcaagcatagagcccgctatgctttgtagtaatttgggggataaagagcttttgtcctgatagctgaaacttcccattaattgtccaagaatactgtgccggtgggttagagtccgcagaacaggacaagtagaggacttctcctgaacggtaataggtgaatgaagggtaaattctggggaggtctggaccatctggagcaaagagaataaagccacaggtgatgtcatctgagggaaggggatgttcctggtctcttaaagggacacagtgaccctctgagccaagacacaccctcaagtcccagcccaaccccctctatgttcactgagccgaatcctcaggtattcacctgtttctcccatcacaagctgtgggccccaagtctcccatgacaagagcgtccactccccttatactcttggttaaggctgtgcctacccaggttttcccagggcagggagtcatggccagctcggatgtccagaagtgaaggtgtctatacttggaccagagagagagtgagaggcctggcctctggtcgttttgatttaagctggtgtcctggcccacagaggaacaaaagatactcacagaggacattcagggtgactgggtaactgcggatgccaccatattggtcccttatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaagtttaagacatccttattctccctgggttttaagttgttgatggtgatgtagggcttgggcagcttcgctgtgtggataacagagagaagattgtcctgtgtggcacctttgattcctccacaggcatccttcaatcagagttggcatctcccacttctcagcccacccgagtccttgaaagccaatagctggtgcgtgtgtcacaagacagatgcatgatgatctaagggctcaaagactatgaggccagctgctctgtcttagggaagcacagactttctcaagtgtcaattgagcagcagtgttgggtcatggacagacacgtcagtggaagtcacagcccctggtatccctcccagtccctccctaatcagttgactggctggctcaccctgggttccttacctggaatgtgcaactggtgggccccttccaaattccatcctacattgtccccctagatgtgatttctctgcagcttccatttccaaggacattctagagatgagtaatgatgggactacccatggtcctgaaaccctgaagatactgagcagcctggcctgggactggatgtttcagcagaaataacacaggggagaccagaatcaagcctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggcgacaggcaagagctggtggctttggagcagaactatgttgcctgtcctgcgttcaagtttcctctccttctgcagagggcaggtgaggaccatgtggatctttccagaaatatatgtggacatttgcaaatgcagcactgactggtagaaagggtgggaaggatctgctggaaatctggtcctcatggaccatgtgtgtttgatggatatgagacaaatttgaagagaagttttgggaatattttctttcactggacattctactctctgattccctggattcgactactctagggacctcatgtaagtggattccagagtgaatatgagaagagactgctggttgccaggagctgggagtggggagaatcagaagttgttcatgggtgtgcagtttcatttatgcaaggtggggaggttctagagatctgctgtagagcttgatgcctatagttcacacaaattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgccctttttttttctctcaccacttttctagcttggtgattagttttcggtgaattccatactggccatgcctcactcgtatatttttgaaggctttgggatgtgaagcctttgaaggctgattgctattttctatgtcatcagaactttccaccttttcatggttgcctctttttctcagtgtatctgttgtggcagtcattaataagagcctgtcaggtgagatttaggacagtgttttctaattctgcaaaaaatgttactgggattctgttaggtgttacattgaatccgcaactcactttgggaatattatctttctaacaatattgattcctccaatccatgaaaatgaaatgtgtttccatatattgatatcgtctttaacttgtttcagcaatcttttgtagttttcagggtataatcatttgactttttggttaaacttattccaaaatattttattccttttgatgttaatgtgaactgaaattctttccttaatttcctttcggattgttcattgttagtgtatagtctaaagaatgatctagaaagagtgaaggggacaggcaaaagctggtggttttggagcagaaacatattccctgtcctgggtttttgattttccctctccctttgcagagggcaggtggctcttccctgataactagatagacttcactggaaaacatagtgccaatgctccagggatccacttaccagggactatgatcctcttgattatgagatttgttccagcagtggctgagttatggatgaaacagacatagacccctctatatgttttagtgatttgggggataaagaacacttgtgctgattgctggaacttcccatcaatcagccaagaatgctctgccagtgggtgagagtctgtgaggcaggagagcttggggacttcccctgtatggtaataggtgtatgaggaggaaatggtgggggcatccaggccatgtggagcaaagagaataatgtcacaggcgatattttcagagggaagggaaaatctcgtctgtggaagcaccacaatcacagtgaccctgtgagccaagtcacaacattgaagtcccagccaaatcccagctgtgttcactgatctggagcctgagacattcacctgtttctcccatcacaagctgtggacgctgagtctcccatgacaggagcagcctcttttctcctattgttgatcaagcctaggcctactctggtttgcctggggcagaaagtcatggccaggtttgatgtccaggggtaaaggtctctgtacttggacctgagagggactgagaggcctggtctctggccacgtgtatttgggatggcagcctggctcacagaggaacagaaaatactcacggaggagattcagggtgaatgggtcactgcggctggcactcactgggttccgtatttcacattcatagggtcctgcagtgtactttgtgacacccaatagaaagagggtcctgttggtttcagacaactgcaacctgtgagacatagggaggctctgaccattcatccaccacaggtagcttgcgtccggagtctcaggatcacaggttaagctcacagcctccatggcctccctggggtttaatttgctgctggagatggagggcttgggagtctccactgtgcagaaaacagagagaagattgccctgtgtggcacctttgattcctccaaaggcatttttcaatcagagttggcatttcccacctctcagcccacccaagtccttaaaagcccatggcaggtgtgtgtgttgcaagacagatgcagggcaatctgagggctcagaggttgtgaggctgcctgcttcatgtagaaacacagactttctcaagtgtgaattgagcagcagcattgggtcatggaaagacacaggaccagcagtcacagcccctgttgcctctctgagtccctccgtctccaactgcctgcctggcccaccttgtggtcctcacttggagcatgcagtgctggaatcttcttagtttcagtcttactttgccgcccaaggtatgttttctctgcagcttcccttgccaaggacatcctagagatgggtgatggaacttccaattgtctttaaaccctttgggtactggaaagcctggcctgggactgggtacttcagcagaaataacacaggggagaacagagtcaagtccggaggtcagttcagtcatcaggcagtggagccacaaggtggcgcagttttcccaggtgtctcatagtggctgacttgagccagtgacctctaaagatagagcagagtccaaggaatgacctacagagagtgaaggggacaggcaagaactgatagctttggaccaagaccacgttccctgttctggatccatgatgctcccttccccctgtagagggcaggtgaggaccatgtggatctttttggaaatacatgtggatgtttgcaaatgcagaaccgactggtggaaagggcgaacatgaacagatgatggaagtctggccctcatggaccatatgtgtttggtggatattagaccaatatttgggaagaagccttgcagatactttctctcattagacattctactctctgattctgaatttgactactctatgtacctgatatcagtggattccagagtgaatcagagagtagaataggagtttctacgagctgggatcagggcaatagggcgttgttccatggttgtgcagtttcagttatgcaggatgaggaggttctagagatctcctgtacagcctcatgtctatagttcatacagataaagtgctccttatgcagaaggcttaaaacaaagtgttttggatttctaatttttttttgttttggaatatttgcagtacatgtactggtttagcatcccaaatctgaaaaatttaaaatgcacaatgcgccagtgagcacttctttttagcatcacatcagtggtcagaagtgttgagttttggagcatttcagattgtggatttctggatttgggatgctcaatttgtaatactgtaattttcccataaaaagttgtcaggagtttagacctcatgttatgttctgactctagtaacaaaaaatatttggaggaaacattaaaatgttttcatgagtggaaatttttactgatggtccaaacatctaagatcaattgctggtagtagtatttctcttgagaccaacataaggtttaggtgtgccatgaattccagcaggatcacattatgctcaaagaaagatgccaatggtgatttgaaattagcaactccttaagtagagagagtcccgttaaaaggaccgaactgggtagtgtgtcaattacataaagggaggaatgatgccaaattaaaagaagtgatgtgtgttatgttagtaaatatagaaagaactccctgcttctaaattctgtgcagagttaggaaaaatggggaggaccccaaaacaggtatgtgaaatgctttcttcattttctcttaagctcaggaaacaccactagagtttaagtttgtgtgaattaggaagagtctaagtgagatggcaatggctcatgtgtctccccacacgcagaactccaacttatgaaaatggcatcaacatgaggaaacagttgtatgtggcaaaggcagtaaaaccatcagatagcacccacctggccacctccaactggtccccaaaaccaccagtattcccattacatgtatgttacagcctttgtagttgtcccacagctacaaaatttaaaaattgctattgtcaaaacaaaatattaaatatgaagttgaaatgttgttccacttttttaccccactctttttgaactttcctgtttcagttttggaagtttctattgacgtatcctcaagctagggattctttcctcagctgtgtgcagtctaccagtaagcatcaaaagcattcttcatttctctaacagcattttttttttctgagacagagtctcactctgtcaccctggctggagtgcagtggcatgatctcatctcactgcaagctctgcctcctaggttcacgccattctcctgcctcagcctcccaagtagctgggactacaggggcccgccaccatggctggctaattttttgtatttttagtagagacgaggtttcaccatgttagccaggatggtctctatctcctgaccttgtgcccgcctcggcctccgaaagtgctggtattgtaggtgtgagccactgtgcccagccatctctgagggagtttaacgagttgttgacttttgagtttgttcagctttttacttagtgttagaaccgaatgacaaatttcaagcttgttatatgcctgacaggaagccagaagtctctaggaagtgaccagagaatgtgagctccatagcaggttgaggatggagtcatgggcgaaatgagcccatgggctttggggactgcaggcctgtccagcctctgacaccctggtgagtccgtgcaaagattacaacagtgacaggaaactagcatgcctgactccatctggcatctagtctcaggctggctgtcctcactcattgctgggcataggccaggctaaccttgggaggaatttagtttatggtttaaatttgaagcaagaatgataatagttcctccataaaactaacacccttactttgcccagggactgcctttgtaaaactagtgaaagaccatgagattaaggttataggagggaactgaattctgctaaaatgttggcacagtttctataatccctgactgctccgatgtcatttggcaagagtttacaaaagttgtaactaattgctcctatagataacatcactattgtagaacgtgagattggtcttttgagatgtttctcattcttttgcattctggcaaccggctgacctcatccatacctatgactaatggctcagccagtcatgtggtccctacctagagtcagatttaagggcaaacagatcatttccctccgcccacatgattccatcaccaaacaatcagcagtacttattttttagtcctgtgctcctgaaactacccttgaatatctctaacccctgatccactggggaggctgatttgagtaataataaacctctgtcctcctgtttggcagacttggagtcgttaaaatctttcttgactagaaaccaacatttcaataattttttttttttttttttttttttttttttttgtgcaggaggccagaagaacttgcctggcaattatgagtggatggaggaactgcctatccctgtcccattgtcttgtccacaggtcagcctcacaaagggaaagagccctggatgggaatacagtggaagctcattctcttagtgacctggggacattggctcgagatgaagcctggcaggagtggcaactccaggtgatttctgcacctttcctatttcctgggaggtgggccaggccacagtgttagtgggaagggaacagaacagccagcctagtcagagggagtgtctggggaaggcctaggggtgggggaagaagctgtgcaggacagggcttgccagtcagaatgaagtgggaggaagatgagggacacagagaagcagagagaggcagagacaccatggcagtgagcagtgagggagacactgacttcaaaaaccccagggaccaggtgcccccagctccacagtccaggaccaaagagccctgagaaccctccagtggccaaagagcttcagaattacatgagctggggtggctttaggggcaagaggtagtggggggatgaaacatgggtgtcagcctctgaaggacaagggacaggtgtggctagaaactcctaggattctgcatgcaaattcagtctctaaagaggttttggatcattcatttcattccattccttcatttgttatgtgagagctcctgagtgtgtgtctgtctcgctgggcctgtgctggtgtagggtgtgagtggggaaagaaaaggtcctctccttgatcctctcatgacagtgacatggacactttgggaaacacaggatttcaggttcagtgatgggggctaagatctgagggggaggcctggacatgttttttccactgactctgatggttgaggcaggtgatttagttctggagtacagactaatcagttgaccattttctctcactcctctgaggtttggatgcctaagaagagaggttttgagccaataaatgactatggggtgcttggaagccagtgagccctcacttctggtggaggagaggatgagcctgtggctgcggacacacctcatgtgaccctgatctcccctttgtgattgtgtgactctggctcagggactgtgtcttcctgtacctcagttttctgtcaatcagataagctaaatggcaaatggacagtggcttttcatgctatctgtgaataaatgttaaatgattcacagtcacctgacctaatgcttggcacagtggaggtttcacacaaatagcatttattattaatttgcttccatgagaaagcccctttgcgtcagatccctgtgggcaagctgctaccaggtacatcttctctcttgtgtttctgcttctggggacattagactttctatggactggcctaagcctcctaaggcagttgtctgatggcctacaaagcttgtctttctgtcctctccactctgagtgtcaggtgaagaaaactctgtccttgcccagatgaggctctgagggctgagccctggctggtgaacagctccaggagacacagtcctctgacagctggtaaatcctcggtcccagtaagccctgcccaagaagccacaacccagccccagcacaggctcctcagatttatctggagcaaggatttagggacactgttctgggggtgaggcttctagggctgagcttctctgagagtatctcaggggctcctcaggccaagccctactcagttctccagggtctttctcagggtcaaatttatgaagagggcatgaggtgcttgtctgagactgatctcctcctgctgagtccccccatcagactgtccttcctctgcagcgagtgtctgcagggtctggatgcgggaaaggaattctgatctgttgaaatttgtctcctctgtgtgtgtcctgcactaaatgcccaaaccccagcatgggacataatgcagagagggacacaggcaatgtccaggcctgacaatcctgtgtgtgtgaagtagaagtgacccctgtcccccaacacccagggatcatgtggaatcactcacgatataaggtgaaggtgaaatgtccagttactcctctattctcatcacctcccattatgatgtgtaaggtgtaggatcctgcgtcttcctgggtgacattctggatcagcagggatgcattggaatatattgtttctcgtccactgtatgcaggcccatatataattatttgaccgtctactacatatgatgtaatgtaatggtagaggtccctgatttgccctttgtaccagatgtagccagtaagattctggggcaaattgtggacaagtagaagaacatccttcccctcagaaactttggttggctgggcttcaatcgtgacttgggcagtcgtgggtgggttccagaagtttaaaagtgatgctaggaggtggagagagcatcagtcaatattgagagctatgtattggtgtgaaaacatggggccctgggtcctgagaagttctcttcagtcctcagccttgaagacacagacacacacacatacaaacacacgcacacacacacacaaaagcggcatgtgtgtctgtgtgtgtgtatgtgtgtgtgtcctactatcctactaggtcaaggtcagccccatgacccccattccttcaacacttctgaccttggcatttttctgtttgcaatcctcttccccaggggtccgcatggccccctccacactgccctcaggtcctgctcacatcagggcatccttagatttctttcctgacacctccttcagataccctgggtcttccctttctgacctttccctgctctgctccctccagggttcttctcaacacctgaccttacattctagatctctttgcatgtctgtcttcccctccatgacagcgtgagctccatgaggacagggatttttgtgatcttggttgcaccccagtgcccagaacaggctgcagactcctgtagatgtgagagttctcagggccctccacgcccttggtgtttttttttccccccaattgttgaggtttcttgctgaggacagtgtttcatgccctgtgtatatttttatgtgaagtgtcatctgatacagttattattatcatatttcaaaatgtggtggcccctgatgattaatcaggaaaacagaacacaagattttcctacctcttaccaattctggttcctgtgactttcctgttttgacccctgtccctctctggtgtatttccccctatccaggctccaatagagccttctttcctttttctcttttttctctttttttttttttgagatggagtctcatactgtctcccaggctggcgtgcgatggcactatctcagctagctgcaacttctgcctcctgggttcacgtgattcttctgcctcagcctcccgagtagctaggattagaggagcacaccacaatatctggttaaatttttgtatttttagtagagacagggcttcactgtgttggccagactgatcttgaactcctgatctcatgatccacctgcctcagcctcccaaagtgctggcttctttcattttttagtaccccatactctcaaggagaccccatccagtcactctgcttcctcctcctgtcctctcccaggaggttctctcctcacctgtgagcaggagccccttccaggtgatgcgctgtgtgcagggaggggctgagaggagccccatggtctctgctgtctgtgtgttctcctctgtggagatgagcctaggatccagaagcttcctgagcacagctctcagcagtgctgtcctgcctccttctg

SEQ ID NO: 2089 - DNA, 18876 bp, Homo sapiens
ctgaacttgtgcagataactttattaccataaacatatgaatactcctgaatagtttcccaattctggggcacttagggagcaaaagcaaatgtttcaatttttgtttacaaaagtatactttaccaattgctgaagaaaaaaagtgcataaatctggagaataaaacattcaaagaatcagcacattttcaaatagaaaattatgaaaacattgttttgactatttagtccaataaaattgggtttttttctttgtcttgaatttcatgaagtatcagcctgttcattaaaattttgaaagttcttagtccagtggtatgatcttgaagttatcaggaacttgtattcaagagtccttgtcagagtcttttcataaatctccttgaacaaaaagcaattttggactgtagctgatggtaaatactttgaggaagaatgaaagcaactgtctgggaatgacaaagatttaaaatgactatggttaaaaatctaatgagaatttattatggtaaagacacagctcacaaaatctagttacttctgtggcatatgacactatgataacatatttgatttccagaaatttcatataatttttagaatactcattaaaaaaattttttttttgagacggagtctcactctgtcacccaggctggagtgcagtggtgcgatcccagttcactgcaagctccgcctcccgggttcctgccattctcctgcctcagcctcctgagtagctgggactacaggtgcctgccaccaagcccggctaattttgtttttgcatttttagtagagatggggtttcaccgtgttagccaggatggtctcgatctcctgaccttgtgatccgcccacctcggcctcccaaagtgctgggatgacaggcgtgagccatcgcacccagcctagaatactcatattattaacattcccataaatattatttagaggaggtttagcatcacttatcacttatttgaaaatgctttctatataatttaacttatcaaataaagtggcttttccattcagcttctgtttgttaactggattactgagttcttggtgtagcccattcataaatagggccaaaaaagtatagtcttatgtatgttgaaaaaggtccttaggtaattccagtacttccagctgaacatcattgatttagttttaagttctacctattacaacaagagttctccatccttgttacatgttagtagtgtcagggaagacttaaaaattaccaatgcctgggtccctctccagacctttaaactggaactaatgggtggggcttgagcatccacttttaaaaatgttttccagtgattccaatgtgtagctctatttcccatcagatttctctgatttcttgtggcattcaattttttctattttggtatcatgattattttcaggtctcatttcctgtcttaggctttatgtctcctggcgtagggaccttgccttcatcatttctgtatcttttttaaacacatgaactggtcatcaggaaaagatctcaaccacacataggttgtgttctgagtctcaggttcacatgttaatcctaaagtcttagttctccacgaggtcagatgttgcttgtgatgaagggtgtggttaagtctgcagtgcagatggtagaggggatttcactctgttttcagacatagcattggaactaagaattttatatctatatgggtgaagggacaggggtgtgtaggaagacagttctaattaggatggaggaattatactaggaagtagcggtaaaggaagtgagaaggcttagtaaatagaagaaatgtgaacttatcaaagtggctagagtagacccctggagattcttgattaagtgaattaactagattttagaaaggtaatgaggcagtcatatgcaaggaagatttcaaagtctggagacaagaagtcaagcaatactttgagaagtggttgagctttatgggaatggagagaattacactattgagagatgttaaaaataatgaagagggtttcaccatgtgaaattgtgtttttcatttgaatctgagaaacaaatgagcagagagagaggctggagataattatgtctaaaagacagtggggtacagggagcataaaggccagggagaaagggaactgcaggaattagtgctgagaagcaggagttagtggaggaaggaggagatccagtcccagatacaggcaaataagtcttttccctctcccaagcatggcagttagccctgcaggaaccaggataagaggaaaggtcatcatacctgccagtcttcctgaaatacagaaatgacatcacggctgctataatggattaaggccaggaagatgtcctgttcctgaaggagctgtcatggaaaaaaaagaaaagaaggaatgaagatgatgttattttacatgggggagcctcaggaacaagcatgtaacatgaggtactctataattgtttcttcaaggactacgttatttctgttggaaaattgataggagatgattatattcttgcagtttttttttccctctcaccctgtttctcagttggtgatcagtcctctgtcaattctctactgtgctcagatatttggaaggctttcagatgtgagaaaggctgattgctattttctatgtcattagaacttgccacctttgcaccttttcatggttgcatctttttctcagtgtctctgttgtggcagtcatgaatgagaccctgccaggtctccatggcagagacttgattgacagaaggcccaggtcagtgcatttcaaattcaccacctcctttgcacagaaagcttctttcctacaggctcccagcaagggcgtgaaagcaagtctagttctctgaggctctctttaactctaatgggtgactggttggaggattccccatcagccttgcaaaaactcttataattgaattggtacctaaaacttctttctctttctttttcacaggaatcagctctgcatagtggtctgtgggttctcccgtactaccttcatgcctgccccacattccctcacaggtgtcttccctgataagttatcttgtatgtctaatcccatcttggatgcatctcagtcagtaaaaactaacataccaggcttgattctttgcacttagctttttttctttctctcccacaagtagtcagtaaccatgtcctagtgttttatgtgttacctctttttccatatatatatatatggaaaaaggaaggtactgttgaggggcacttcctatgtgccaggccctgtgctaaatactttccctgtatctcatttaatccacacaataaccctgtgaggtagacattatttccattttgccgatgaaaagacagaagcttagagtggtgtaaaactttcctggtgtcatatggctagtgacaggtggatctgagatttgattctaggactatttgacctctaggctaatgatgatggtagtcatatagcagctgacattggttccactgtgtgtggcatctcgttttattgactgcattaaacctttaaaagaaaggtatgaagaaagcactcttattgcagttttcaggtgaggtatcagaggttcagagaaattgagtcttgtgcaagaaatttataactgtaaactcttacattaaaaaagaagaaagatctcaggtcaacaacctactttaatacttcaggatatgaaagaagaacaaactaaacccaagcacagtgaatgagggaaaaataaggattagagtggatataaataaaatggagaatggaaaaagaatagaggaaattaatgaaaccaaaagttgattcttcaaaataaaatcaacaaaattgacaaccattaactagattgactaagaaaaaaagagaaaagtttaaaattcctaaaatcagaaatgaaaatggactctgagcatggtgggtcatgttttaatcctagcactttgggaagtcacagcagaaggatttcttgagaccaggtgtttggaccagcataggtaacctggggagaccctgtctctacaaaaaaataaaaaagccaattagctgcgcatggtgacatgcacctgtagtcctagcatcttgggaggctgaagaaggagaattacttgagcccaggaggttgaggctgcagtgagccataatcacaccactgtattccatcctgggctggcctacagagtgagagcctgtctctctctcttcaacaacaacaaccaaaaaaaaaaaaaaaaaaagaaaaaagaaaaatgaagcgattactaccaattctaataaactaatgattatgaaagtactataaataattgtatgccaataaattggataacctagatgaagtagacaaacccctagaaacacacaaaaatatgaatggaactataatcagtaataagattgaatcaataaaacatttgatgaaattcaatattttttcataataaaaactttctaagaagggaaggaaaccacctcaacgtaaaggcaatatgtgaaaaacccaatgctaacatcatactcaacggagaaagactgaaagctttccctgtatgagcaggaacaagacaagggtgcctgcttttgacacttttattcaacatagtattgaaaggtctagtcagaaaaattaggcaagaatttaaaaaaagacgttaaaattggaaggaaggagtaaaattatttctgtttacagataacttgaacttatatgtagaaaatcctaaagatggaacaaacctattagaattaataaataaattcagtaatgttgcacaatacaaaatcaacattcaaacatcagttgtatttcaatacactaaccatgaacaatctgaagggaaattaagaaaaaaaatttcaatttatattaacatcaaaaagaataaaatatttaggaatgagtttaaccaaagaggtaaaatgattatacctgaaatctacaaaatatggctgaaagaaatgaaagatgacatcaataaattgaaagacattttgttttcatgaattggaagactcaatattgttaggaggacagtgctacctgacgtgagctgcagattcaataaaattcctatcagaatctcagtgacatttttgcagtaaaaaaaaatctgtcctaaaatttatattgcatctcatgactctaaatagacacacagctttgaagaggaagaatgaagctggaggactcacacttcctgatttcagcatttactacaaagccccagtaatcaatacactgtggtactggcataaaggaggacatagaaattaatgaaatataataacccagaaagaaatgcttgcatatatggccaaatgattttcatcgagtgtgccaagatcgttcaatggggaagggaccgttttctcaccaaatgatattgggaaaggtggatatccaagggcaagaacagtggaacctttacctaacaccatgtacaaaaagtaacccacaatagatcaaagatctaaatgtaagggcaaaaactattcaactcttagaagaaaagcttcatgatactggatttcacaatgatttcctggttgtaacaacaaaagcataggcaacaaataaaatggataaatcggacttcataaaaatcaaaaccttttatatatcaaagaacactatcaagaaagtaaaaagcaacccacgaaatgataaaaatatttgcaaattatatgtgtgataagaaattaatttccagaatacatgaaaagctacaagtcaacaacagcaaacatccaaaaacccaattaaaaaatgaacaaaggattaaaatggagttttctccaaggaagatatacaaatatcaaataagcccatgcaaagttcctcagcatcaggaatacttggagatatgcaaatcaaaaccacattgttacaccacctcacacactttaggatggttttgataaacaacaacaatgacagcaacacaaaacaacaggtgttttcaagtagatggaaaaattggagctctagtgcattgctgatgggaatgggaaatgttatagccactgtaagaagtggtgtggctctctctcaaaaaattaaacaataaattaccatttgatccagcaattccacttctggacataatccccatagaattgaaagaaatttgaacaaatatttgtaaactgatgttcagagaagcattactcacactagccaaaaaatggaaacaactgaaaagtccattgaaagataagtgggtaggcaaatgaggtgtatctatacattgaaatgttgttcaaccttaacaaggaataaaattccaatacatagtgcaaagtggatgaaccttgaagatattatgctaactgaaataagccagacacaaaaggataattattatataattccatttataaaagatagttagaatagccagttacatagagacagaaagtagaatggtgggtgctaaggtttagggggagaaggagtgagagttactgtttattggctacagaggtttaatatggtaagaggaaaaagttctggaaatggatagtgtgatggttacacaacactaaattgcacacttagaaatagttaatggtaagtcttatattagatatatataaagtgtccagtagtcttaccctctctataattacacactttttggcactgcccctttcctgccatgcagagccctaggggtgaatctccctatttctccagctctgcatcagtcactgtcctccgtgctgtgtcccaggtgctgtgcccacagcctcatacagccggtgacttcagagccaggacacagctcaggagtctgccctgaggctccctctctttttgtttccctgcagcctggcccgggggaggcttggcttcaactggcaactcgatttagccaaattcaggacaggccaccagggctctttctccacagatgctggtcccacccaggtggagtcaggcagggccagtcaccagaggagcctggagcagagcaggaagcagagtctgagctgctcctccctcacccaaggggcttcctcctctcatctgggggaaaagtgtcagcttgtttcaaagcctcggatgttccttgtagctcatagaataggtacaagaaaacaaagacgtggcagaaggggatgtgttggtgacagcaagaagcaacttgatcttgaggactctccttcttgtccctctctgaatcctcttctaccacatagggctcagggctgataaagcccgctccgtacctttctcaggccagacacaaggtcagccatgagaaaacagaaaaacaaggagaagagagtctgtagagacaaattgggagggttcaggaggagaatttgggatttgcttgtgcccatgggacacaggctgggaataaaaatgttttcctgactcttctctgaaagccagagagactccacctaaaactctattgccaagcatgctgggatccacttaccagagactttgactgtcatggatttggagctttccatgccagtggctgagttacgaacagagcaagcatagagcccgctatgctttgtagtaatctgggggataaagagcttttgtcctgatagctgaaacttcccattaattgtccaagaatattctgctggtgggttagagtccgcgaagcaggacaagtagaggttttctcctgaatggtaataggtgaatgaagggtaaattctggggaggtctggaccatctggagcaaagagaataaagccacaggtgatgtcatccgagggaaggggatgctcctggtctcttaaagggacacagtgaccctctgagccaagacacaccctcaagtgccagccaaaccccctctatgttcactgagctgaagcctgaggtattcccctgtttctcccatcacaagctgtgggccccaagtctcccatgacaagagcgtcccctccccttatattcttggttaaggctgtgcctacccagatcttcccagggcaggaagttatggccagctcggatgtccagaagtaatggtatctatacttggaccagagagagagtgagaggcctggcctctggtcgttttgatttaagctggtgtcctggcccacagaggaacaaaagatactcacagaggacattcagggtgactgggtaactgcggatgccaccatatcggtcctgtatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaaggctaagacatccttattctccctggggtttaagttgttgatggtgatgtagggcttgggcagcttcgctgtgtggataacagagagaagattgtcctgtgtggcacctttgattcctccactggcatccttcaatcagagttggcatctcccacctctcagcccacccgagtccttgaaagccaatagctggtgcgtgtgtcacaagacagatgcatgatgatctaagggctcaaagactgtgaggccagctgctctgtcttagggaagcacagactttctcaagtgtcaattgagcagcagtgttgggtcatggacagacacgtcaatgggagtcacagcccctggtacccctcccagtccctccataatcagttgactggctggctcaccctgggttccttacctggaatgtgcaactggtgggccccttccaaattccatcctactttgcccccatagatgtgatttctctgcaacttccatttccaaggacattctagagatgagtaataatgggacttcccatggccctgaaaccctgaagatactgagcagcctggcctgggactggatgtttcagcagaaataacacaggggagaccagaatcaagcctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggtgacaggcaagagctggtggctttggagcagaagcatgttccctgtcttgggttctttaagtttcctctccttctgcagagggcaggtgaggaccatgtggatctttccagaaatacatgtggacatttgcaaatgcagcactgactggtggaaagggtgggaatgaactgctggaaatctggtcctcatggaccatatgtgtttgatggatatgagacaaatttggagagaagttttgcaaatattttctttcattggacattctactcaatgattccatgggttcgactactctagggacctcatgtaagtggattccagagtgaatatgagaagagactgctggttgccaggagctgggagtggggagaatcagaagttgttcatgggtgggcagtttcagttattcaaggtggggaggttctagagatctgctgtagagcttgatgcctatagttcacacagattgagtatttcttatgcataagacttaggacaaaaagtgttttggatttctgacattttttgattctgaaatatttgtcatatacttactggtttagcatcccaaatctgaaagactcaaaatctaaaatgcttcagtgagcatttcttttcagcatcagattagtaggcaaaagtgggaggtgataagccaaagatattcttgccctttttttttctctcaccacttttctagcttggtgattagttttcggtgaattccatactggccatgctgcacttgtatatttttgaaggccttgggatgtgagaaaggctgattgctattttctatgtcatcagaactttccaccttttcatggttgcctctttttctcagtgtatctgttgtggcagtcattaataagagcctgtcaggtgagatttaggacagtgttttctaattctgcaaaaaatgttactgggattctgttaggtgttacattgaatccgcaactcactttgggaatattatctttctaacaatattgattcctccaatccatgaaaatgaaatgtgtttccatatattgatatcgtctttaacttgtttcagcaatcttttgtagttttcagggtataatcatttgactttttggttaaacttatttcaaaatattttattccttttgatgttaatgtgaactgaaattctttccttaatttcctttcagattgttcattgttagtgtatagtctaaagaatgatctagaaagagtgaaggggacaggcaaaagctggtggttttggagcagaaacatattccctgtcctgggtttttgattttccctctccctttgcagagggcaggtggctcttccctgatagctagatagacttcactggaaaacatagtgccaatgctccagggatccacttaccagggactatgatcctcttgattatgagatttgttccagcagtggctgagttatggatgaaacagacatagacccctctatatgttttagtgatttgggggataaagaacacttgtgctgattgctggaacttcccatcaatcagccaagaatgctctgccagtgggtgagagtctgtgaggcaggagagcttgggggcttcccctgtatggtaataggtgtatgaggaggaaatggtgggggcatccaggccatgtggagcaaagagaataatgtcataggtggtattgtcagagggaagggaaaatcctggtctgtggaagggccacagtgaccctgtgagccaagttgcaacactgaagtcccagccaaatccctgctgtgttcactgatctggagcctgagacagtcacctgttttgcccatcacaagctgtggacgctgagtctcccatgacaggagcagcctcttttctcctattgttgatcaagcctaggcctactctggtttgcctggggcagaaagtcatggccaggtttgatgtccaggggtaaaggtctctgtacttggacctgagagggactgagaggcctggcctctggccacgtgtatttgggatggcagactggctcacagaggaacaggagatactcacggaggagattcagggtgactgggtcactgcggctggcactcactgggttccgtatttcacattcatagggtcctgcagtgtactttgtgacaccaaatagaaagagggtccttttgtttttggacaactgcaagctgtgagtcatagggaggctctgaccattcatccaccacaggtagcttgcgtccggagtctcaggatcacaggttaagctcacagcctccatgtcctccctggggtataagttgctgctggagatggagggcttgggagtctccactgtgcagaaaacagagagaagattgccctgtgtggcacctttgattcctccaaaggcatttttcaatcagagttggcatttcccacctctcagcccacccaagtccttaaaagcccatggcaggtgtgtgtgttacaagacagatgcatggcaatctgagggctcagagattgtgaggctgcctgcttcgtgtgggagaagcacagactttcttaactgtgaattgagcagcagcattgggtcacggaaagacacaggaccagcagtcacagcccctggtgcctctctgagtccctccatctcgaagtgcctgcctggcccaccttgtggtcctcacttggagcatgcagtgctggaatcttcttagtttcagtcttactttgccgcccgaggtatgttttctctgcagcttcccttgccaaggacatcctagagatgggtgatggaacttccaattgtctttaaaccctttggatactggaaagcctgacctgggactgggtacttcagcagaaataacacaggggagaacagagtcaagtccggagttcagttcagtcatcaggcagtggagccacaaggtggggcagttttcccaggtgtctcatagtggctgacttgagccagtgacctctaaagatagagcagagtccaaggaatgacctacaaagagtgaaggggacaggcaagagctgatagctttggaccaagaccacgttccctgttctgggtccatgatgctcccttccccctgtagagggcaggtgaggaccatgtggatctttttggaaatacatgtggatgtttgcaaatgcagaaccgactggtggaaagggcgaacatgaacagatgatggaagtctggccctcatggaccatatgtgtttggtggatattagaccaatatttgggaagaagccttgcagatactttctctcattagacattctactctctgattctgaatttgactactctatgtacctgatatcagtggattccagagtgaatcagagtgtagaatagtagtttccaggagctgggatcaggggaatagggcgttgttctgtgggtgtgcggtttcagttatgcaggatgaggaggttctagagatctcctgtacagcttcatgcctatagttcatacagataaagtgctccttattcagaaagcttaaaaccaagtgttttggatttctaattttttttattttggaatatttacagtacatgtactggtttagcatcccaaatctgaaaaatttaaaatccacaatgcgccagtgagcacttctttttagcatcacatcagtggtcagaagggttgagttttggagcatttcagattgtggatttctggatttccgatgctcaatttgtaatactgtaattttcccataaaaatttgtcaggagtttagaccttatgttctgactctagtaacaacaacagcaaaaaatttggaggaaacattgaaatgttttcataagtggaaatttttactgatgatccaaacatctaagatcaattgctggtagtagtatttctcttgagaccaaaataaggtttaggtgtgccgtgaattccagcaggatcacattatgctcaaagaaagatgccaaaggtgatttgaaattagcaactccttaagtagagagagtcccgttaaaaggacagaactggttagtgtgtcaattgcataaagggaggaaggatgccaaactaaaagaagtgatgtgtgttatgttagtaaatatagaaagaacctgcttctaatttctgtgcagagttaggaaaaatggggaggaccccaaaacaggtatgtgaaatgctttcttcattttctcttaagctcaggaaacaccactagtgtttaagtttgtgtgaattagaaagagtctaagtgagatgccaatggtttgtgtgtctccccacacgcagaactccaacttatgaaaacggcatcatcatgaggaaacagttgtatgtggcacaggcagtaaagccatcagatagcacccacctggccacctccacctggtccccaaaaccaccagtattcccattacgtgtatcttatagcctttgtagttgtcccacagctacaaaatttaaaaattgctattgtcaaatcaaaatattaaatatgaagttgaaatgttgttccactttttttccccactcttgttgaactttcctgtttcagttttggaagtttctattgacatatcctcaagctagggattctttcctcagctatgttcagtctaccagtaagtatcaaaagcattcttcatgtctctaaaaacatttttttttttctgagacagagtctcgctctgtcacctaggctggagtgcagtggcatgatctcatctcactgcaagctccacctcctgggttcatgccattctcctggcttggcctcccaaatagctgggactacaagcgcctgccaccacgtccagctaattttttgtatttttagtagagacggggtttcaccatgttagccaggatggtctccatctcctgaccttgtgcctgcctcggcctcccaaagtcctgggattataggcatgagccactgtgcccagccatctctgagggattttaatgagttgttgacttttgagtttgttcagctttttacttagtgttagaaccgaggaacaaatttcaagcttgttatatgcctgacaggaagccagaagtctctaggaagtgaccggagaatgtgagctttatagcaggttgaggatggagtcacaagtgaaatgggtgaaatgagcccatggggtttggggactgcaggcctgtccagcctctgacactctggtgagtcagtgctaagattacaacagtgacagcaaactagcatggctgagtccatctggtatctagtctcaggctggctgtcctcactcattcctgggcataggccaggctaaccttgggaggaatttagtttattgtttaactttgaagcaagaatgataattgttcctctgtaaaagtaacacccttactttgcccagggactgcctttgtaaaactagtgaaagaccatgagattaagattataggagggaactgaattctgctaaaatgttggcagagtttttataatccttgactgctcaaatgtcgttgggccagagtttacaaaatttgtaactaattgctcctatagataacatcactattgtagaacgtgagattggtcttttgagatgtttctcattcttttgcattctggcaaccggctgacctcatccatacctatgactaatggctcagcccgtcatgtggtccctacctagaggtggattcaagcacaaacagatcatttccctccgcccgcatgattccatcaccaatcagcagtactcattttttagtcctgtgcccctgaaactatccttgaaaatctctaagccctgatccactggggaggctgatttgagtaataataaacctccatcctcctgtttggcagacttggagtcattaaaatctttctttactacaaaccaccatttcaatacatttgtgtgtgtgtgtgtgtgtgtgtgtgtgtgtgtgtgtgtgtgtgtgtgcaggaggccagaagaacttgtctggcaattataagagtggatggagaaactgcctatccctgtcccatggtcttgtccacaggtcagcctcacaaagggaaagagccctggatgggaatacagtggaaactcattctcttagtgacctggggacattggctctagaggaagcctggcaggagtggcaactccaggtgatttctgcacctttcctatttcctgggaggtgggccaggccacagtgttagcgggaagggaactgaacagtcagcctagttagagggagtgtctggggaagacctaggggtgggggaagaagctgtgcaggacagggcttgccagtcagaatgaagtgggaggaagatgagggacacagagaagcagagagaggcagagacaccatggcagtgagcagtgagggctacactgacttcagagaccccagggaccaggtgcccccagttccacagtccaggaccaaggagccctgagaaccctccggtggccaaagagcttcagagttacatgaggtggggttgctttagggtcaagaggtagtggggggatgaaacgtgggtgtcagcctctgaaggacaagggacaggtgtggctagaacctcctaggattctgcatgcaaattcagtctctaaagaggttttggatcattcatttcttcattccatttcttcatttgttatgtaagagctcctgagtgtgtctgtctcgctgggcctatggtggtgtagggtgtgagtggggaaagaaaacaaggtcctctccttgatcctcttgtgacagtgacatggacactttgggaaacacaggatttcaggttcagtgatggtggttaagatctgagggggaggcctggacatgttttttccactgactctgacggttgaggtaggtgatttagttctggaatacagactaatcagttgaccgtttgctctcactcctctgaggtttggatgcctaagaagagaggatttgagccaataaatgactatagggtgattggaacccagtaagccctcacttctggtggaggagagggtgggcctttggctccagacacacctcatgtgaccctgatctcccctttgtgtttgtgtgactctggttcagtgactgtggcttcctgtgcctcagttttctctcaaacaaataagctaaatggcaaatggactgtggcttttcatgctatctgtgaataaatgttaaatgattcacagtcacgtgacctaattcttggcacagtggaggtttcacacaaacagcatttattattaatttgcttccatgagaaagcacctttatgtcagatgcctgtggacaagctgctacctggtatatcttctctcctctgtttctgcttctggggacattagactttctatggactggcctaagcctcctaaggcagttgtctgatggcctacaaagcttgtctttctgtcctctccactctgagtgtcaggtgaagaaagctctgtccttgcccagatgaggctctgagggctgagccctggctggtgaacagctccaggagacacagtcctctgacagctggtaaatccttggtcccagtaagccctgcccaagaagcgacaacccagccccagtacaggctcctcagatttatctggagcaaggatttagggacatggttctgggggtgaggcttctagggctgagcttctctgagagtatttcatggggcccctgaggccaagccctactcagtttgccagggtctttctcagggtcaaatttatgaagagagcatgaggtgcttggctgagactgatctcctcctgctgagtccccccatcagactgtccttcctctgcagcgagtgtctgcagggtctggatgcgggaaaggaattctgatctgttgaaatttgtctcttctgtgtgtgtcctgcactaaatgcccaaaccccagcatgggacataatgcagagagggacacaggcacaatccaggcctgacaatcctttgtgtgtgaagtaaagaccccatcccccaacacccagtgatcacgtggagtcactcacggtataaggtgaaggtgaaatgtccagtttctcctctagtcccatcacctcgctttacgatgtgtaaggtgtaggatcctgcgtcctcccgggtgacattctggatcagcagggatgcattggaatatactgtttctcgtccactgtatgcaggcccatatataattatttgaccatctactacgtatgatgtaatgtaatggtagaggtccttcatttgccctttgtaccagatgtagccagcaagattctggggcaaattgtggacaagtagaagaacgtccttccccttggaaactttggttggctcggcttcaatcgtgacttgggcagtggtaggcaagttccagaagtttaaaagtaatgctaggaggtggagagagcatcagtcaatattgagacctatgcattggggtgaaaagatgtggccctgggtcctgagaaggtctcttcaatcctcagctttgaagagacacacacacacacatacaaacacacacacacacacaaaaggggcatgtgtatatgtgtttgtgtcctactctcctactaggtgaaggtcagcaacatgacccccattccttcaacacttctgaccttggcatttttctgtttggaatcctcttccccaggggtccgcacggccccctccacactgccctcaggtcctgctcacatcagggcatccttagacttctttcctgacgcctccttcagagaccctgggtcttccctttctgacctttccctgctctgctccctccagggttcttctcaacacctgacctcacattctagaactctttgcatgtctgtcttcccccccatgacagcgtgagctccgtgaggacagggacttttgtgatcttctttgcaccccagtgcctggaacaggctgcagactcctgtagatgtgagagttctcagggccctccatgccctgggtgttttttcttcccccagttgttgaggtttttttgctgaggacagtgtttcatgccctgcttatatttttatttgaagtgtcatctgatatagttattattatcatttttcaaaatgtggtggcccctgatgattaatcaggaaaacagaacacttaagattttcctacctcttaccaattctggttcctgtgactttcctgttttgacccctgtccctcttgggtgtattttcccctatccaggctccaacagagacttctttcctttttttcttttttctttccattcttttttttttttgagacggagtcttgtactgtcgcccaggctggcgtgcagtggcactatctcggctcactgcaatttcttcctcccgggttcacgtgattctcctgcctcagcctcccgggtagctaggattactggagcacaccacaatatctggttaaatttttgtatttttagtagagacagggcttcactgtgttggccagactgatcttgaactcctgatctcgtgatccaccctcctcagcctccctaagtgctggcttcttttattttttagaaccccaggagtctctccaggagaccccatccagtcactctgcttcctcctcctgtcctctcccaggaagttctctcctcacctgtgagcaggagccccttccaggtgatgcgctgtgtgcagggaggggctgagaggggccccatggtctctgctgcctgcgtgttctcctctgtggagctgagcctaggatccagaaacttcctgagcatggctctcagctgtgctgtccttcctccttctgcgctgagcctcttcccggggcaggagcacttctc

SEQ ID NO: 2090 - DNA, 18723 bp, Homo sapiens
ctgaagttgtgcaaataactttattaccataaacatatgaatactcatgaatagtttcccaattctggggcactcagcaaaagcaaatgtttcaatttttgtttacaaaagtatactttaccaattgttcaaggaaaaaagttcataaatctggagaataaaacattcaaagactcagcacattttcaaatagaaaattatgaaaacattatccttttgattatttattccaataaaattgagttttttttcttctttgtcttgaatttcatgaaggtatcagcctgttcattaaaattttgaaagttcttagtccagtggtatgatcttgaagttatcaggagcttgtattccagagtccttgtcagagtcttttccataaatctccttgaagaaaaagcaattttggactgtagctgatggtaaatactttgaggaagaatcaaagcaactgtctgggaatgacaaagatttaaaatgactatggttaaaaatctaatgagaatttattatggtaaagacacagctcacatagaaatctagttacttctgtggcataagacactatgataacatatttgatttccagaaatttcatataatttttataatactcattaaaaaaattttttttgagatggagtgtcactctctcacccaggctggagtgcagtggtgcgatctcagttcactgcaagctccgcctcctgggtccatgccattctcctgcctcagcctcctgagtagctggggctacaggtgcctgccaccacacctggctaattttgtttttgcatttttagtagagatggggtttcaccgtgttagccaggatggtctcgatctcctgacctcgtgatctgcccacctcggcctctgaaattgctgggattacaggcgtgagacatcacgcccagcctagaatactcatattattaacattcccataaatattatttagagaaggtttagcatcaattatcccttatttgaaaatgctttctataaatttaatatataaaataaggtggattttccgttcagcttctgtttctcaagaggattactgagttgttggtgtagcccattcataaataggaccaaaaaagtatagtcttatgtatgttgaaaaaggtccttaggtaattccagtacttccagcagaaaatcattgatttagttttaagttctacctattacaataagagttctccatccttgttacatgttagtagtgtcagggaagacttaaaaattaccaatgcctgggtccgtctccagacctttaaactggaactaatgggtggggcttgagcatccacttttaaaaatgttttccagtgattccaatgtgtagctctatttcccatcagatttctctgatttcttgtggcattcaattttttctattttggtatcatgattattttcaggtctcatttcctgtcttaggctttatgtctcctggcgtagggaccttgccttcttcatttctgtatcttttttaaacacatgaactggtcatcaggaaaaggtctcaaccacacataggttgtgtcctgagtctcaggttcacatgttaatcctaaagtctttgttctccacgaggtcagatgttgcttgtgatgaagggtgtggttaagtctgcagtgcagatggtggaagggatttcactgtttttagacatagcattggaactaagaattttatgtctatatgggtgaaggggcagggatgtgtaggaagacagttctaattaggatgaaggaattatactaggaagtagaggtaaaggaagtgagaaggcttagtaaatagaagaaatgtgaacttatcaaagtggctagagtagaccactggagattcttgattaagtgaattaactagattttagaaaggtaatgaggcagtcatatgcaaggaagatttcaaagtctggagacaagaagtcaagcaatactttgagaagtggttgagctttatgggaattgagagaattacagtattgagagatgttaaaagtaacgaagagggtttcatcatgtgaaattgtgtttctcatttgaatctgagaaacaaatgagcagaggctggagataattatgtctaaaagacagtggggtacagggagcataaaggccagggagaaagggaactgtaggaattagtgctgagaagcaggagtttagtggaggaaggaggagatgcagtcccagatacaagcaaataagtcttttccctctcccaagcatggcagtcagccctgcaggaaccaggataagagaaaaggccatcatacctgccagtcttcctgaaatacagaaatgacatcaccgctgctctattggagtaaagaaaggaagacgtcctattcctggaggagctgtcatggaaagaaaagaaaagaaggaatgaagatgatgttattttacatgggggagcttgaggaacaggcatgtagcatgaggtactctataattgtttcttcaaggactacattatttctgttggaaaattgatgggagatgattatattcttgcagttttttttccctcttaccatacttctaggttggtgatcagtcctctgtcaattctctactgcactcagatattttggaaggctttcagatgtgagaaaggctgattgctattttctatgtcattagaacttgccacctttgcacctttccatggttgcatctttttctcagtgtctctgttatggcagtcacgaatgagaccctgccaggtctccatggcaggcacctgatttacagaaggcccagatcagtacatttcaaattcaccacctcctttgcacagaaagcttctttcctacaggctcccaggaagggtgtgaaagcaagcctagttctctgaggatctctttaactccaatgggtgactggttggaggattccccatcagccttgcaaaaactcttagaattgcattggtacctaaaacttatttctctttccttttcacaggaatcagccctggatagtggtctgtgggttctcccatactaccttcatgcctgccccacattccctcagaggtgtcttccctgataaattatcttgtatgtctaatcccatcttggatgcatctcaattggtaaaaactaacataccaggcttgattctttgcacttagctttttttctttctctcccacaagtagtcagtagccatgttctagtgttctatgtgttacctctttttccatatgtatggaaaaaggaaggtactgttgaggtgcacttcctatgtgccaggccctgtgctcaatactttacctgtatctcatttaagccacacaataaccctgtcaggtagacattatttccattttggcaatgaaaagacagaagcttagcgtggtgtaaaatctttcctggtgtcatatggctagtgacaggtggatctgagatttgattctaggactatttgacctcaaggctaatgataatggtagtaatatggtagctgacattggttcctctgtgtgtggcatcttgtttcattgactgtattaaacctttaaaagaattgtatgaagaaagtagcctcattgcagttttcaggtgaggaatcagaggttcagagaagttgagtcttgtgcaagaaatttataactgtaaactcttacattaaaaaagaagaaagagctcaggtcaacaacctactttaatacttcaggatatgaaagaagaacaaactaaacccaagcacagtgaatgagggaaataataaggattagagtggatataaataaaatggagaatggaaaaataatagaggaaattactgaaaccaaaagttgattcttcaaaataaaatcaacaaaattgacaaccattaactagattgactaagaaaaaaagagaaaagtttaaaattactaaaatcagaaatgaaaatggactctgagcatggtgggtcgtgttttaatcctagcactttgggaggtcacagcggaaggatttcttgagaccaagtgtttgggccagcatagttaaccctgggagatgctgtctctacaaaaaataaaaaaccaattagctgggcatggtgacatgcacctgtagtcctagcatcttgggaggctgaagaaggagaattgcttgagcccaggaggttgaggctgcagtgagccatagacacaccactgtattccatcctagggtggcctacagagtgagagcctgtccctctctcttcaaaaaaaaaaaaaaaaaaaaaaaaagaaaaatgaagcgattactaccaattctaataaaataatgattatgaaagtagtataaataattgtatgctaataaattggataacctatatgaagtagacaaactcttagaaacacacaaatatatgaatagaactataatcagtaataagattgaatcaataaaagtaattgatgaaattcagtattttttcataataaaaacattctaagaatggaaggaaaccacctcaacataaaggcaatatgtgaaaaacccaatgctaacatcatactcaatagagaaagactgaaagctttccctgtatgagcaggaagaagacaaggatgcctgcttttgacacttttattcaatataatattgaaaggtctagtcagaaaaattaggcaagaattttaaaaaagacattcaaattggaaggaaggagtaaaattatttctgtttacagataacttgaacttatatgtagaaaatcctaaagatggaacaaatctattaggactaataaataaattcagtaatgttgcacaatacaaaatcaacattcaaacatcagttgtatttcaatacactaaccatgaacaatctgaagggaaattaagaaaaaaaaattcaatttctattaacatcaaaaagaataaaatatttaggaataagtttaaccaaagaggtgaaatgattatacccgaaatctacaaaatattgctgaaagaaatgaaagaagacatcaataaattgaaagacattttgttttcatgaattggaagactcaatttggttaggaggacagtgctacccaaagtgagctgcagattcaatacaattcttatcagaatctcagtgacatttttgcagaaaaagaaaaatctgtcctaaaatttatattgcatctcatgactctaaatagacacacagctttgaagaggaagaatgaagctggaggactcacacttcctgatttcagcatttactacaaagccccagtaatcaatacagtgtggtactggcataaaggaggacatagaaattaatgaaatataataacctagaaagaaatgcttgcatatatggccaaatgattttcatcgagtgtgccaagatcgttcaatggggaagggacagtgttctcaccaaatgatattggaaaagctggatatccaagggcaagaagagtggaacctttacctaacaccatgtgcaaaaattaacccacaatacatgaaagatctaaatgtaagagcaaaaactatacaactcttagaagaaaaggtccatgatactggatttcacaatgatttcttggttgtaacaacaaaagcataggcaacaaataaaattgataaattggacttcacaaaaatcaaaaccttttgtatatcgaagaacattatcaggaaggtaaaaaggcaacccatgaaatgataaaaatatttgcaaattatatgtgtgataagaaattaatttccagaatacatgaaaagctacaagtcaacaacagcagacatccaaaaacccaattaaaaaatgaacaaaggattaaaatggagttttctccaaggaagatatacaaatatccaataagcccatgcaaagttcctcagcatcatgaatagttagagatatgcaaatcaaaaccacaatgttacaccacctcacacacttgatgggaatgggaaatgttatagccactgtaaaaagtggtgtggctgtttctcaaaaaattaaacaataaattaccatttgatccagcaattccacttctggacatactccacatagaattgaaagaaatttgaagaaatatttgtactctgatgttcagagaagcattactcacactagccaaaaaatggaaacaaccaaaaagtccattgaaagataagtgggtaggcaaatgaggtgtatctacaattaaaatgttattcaaccttaacaaggaataaaattccaatacatcgtgcaaaatggatgaaccttaaagatattatgctaactgaaataagccagacacaaaaggataattatcatataattccatttataaaagatagttagaatagccagttacatagagacagaatgtagaatgttgtgtgctaagggttatggggagaaggagtgagttactgttcattgggtacagaggtttaatatggtaagaggaaaaagttctggaaatggatagtgtgatggttacacaacactaaattgcacacttagaaatagttaatggtaagtcttatattagatatatataaagtgtttggtagtcttaccctctctataattacacactttttggcactgcccctttcctgcgatgcagagccccaggggtgaatctccctatttctccagctctgcatcagtcactatcctccgtgctgtgtcccacatgctgtgcccacagcctcatacagccggtgacttcagagccaggacgcagctcaggagtctgccctgaggctccctctcttcttatttccctgcagcctggcccgggggaggcttggcttcaactggcagctcgatttagccaaattcaggacaggccaccagggctctttctccacacatgctggtcccaccccaggtggagtcaggcagggccagtcaccagaggagcctggagcagagcaggaagcagagtctgagctgctcctccctcacccaaggggcttccccgtctcatttgggggaacagtgtgagcttgtttcaaagcctcagatgttccttgtagctcatggaagaggtacaagaaaacaaagacgtggcagaaggggatgtgttggtgacatcgagaagcaacttgatcttgaggactctccttctcatccgtctctgaagtctcttctaccacatagggctcagggctgataaagccccctccctaactttcttaggccagacacaaggtcagccatgagaaaacaaaaacaagaagagagtctgtagagacaaattgggagggttcaggaggagaatttgggatttgcttgtgcccatgggacacaggctgggaataaaaatgttttcctaactcttctctgaaagccagatagactccacctaaaaccctattgccaaggatgctgggatccacttaccagagacttcgactgtcatggatttggagctttccttgccagtggctgagttacgaacagagcaagcatagagccctctatgctttgtagtaatttgggggataaagagcttttgttctgattgctgaaacttcccattaattgtccaagagtactatgccggtgggttacattccgcgaagcaggacaagtaaaggttttgtcctgaacggtaataggtgaatgaagggtaaattctggggaggtctggaccatctggagcaaagagaataaagccacaggtgatgtcatccgagggaaggggatgctcctggtctcttaaagggacacagtgaccctctgagccaagacacaccttcaagtcccagccgaaccccctctatgttcactgagctgaagcctgaggtattcacctgtttctccccaatcacaagctatgggcaccaagtctcccatgacaagagcgtcccctccccttatattcttggttaaggctgtgcctacccaggatttcccagggcagggagtcatggccagctcggatgtccagaagtaaaggtgtctatacttggaccggagaaagactgagaggactggcttgtggtcatttagagttaagctggtgtcctggcccacagaggaacaaaagatactcacagaggacattcagggtgactgggttactgcggatgccaccatatcggtcccgtatttcacattgatagggtcctgtttcatttctcgtgacactgggtagaatgaggatcctgttttcaatgggtcactttaccctgggactgactgggaggctctgaccatttagccaccacgtgtaggtgtagttctcacttttagggtcacaggtgaagggtaagacatccttattctccctgggttttgagttgttgatggtgatgtagggcttgggcagcttcgctgtgtggataacagagagaagattgtcctgtgtgacacctttgattcctccacaggcatccctcaatcagagttggcatctcccacctgtcatcccacgcgagtccttgaaagccaatagctggtgcatgtgtcacaagacagatgtatgatgatctaagggctcaaagactgtgaggccgcctgctctgtcttagggaagcatagactttctcaagtgtcaattgagcagcagtgttgggtcatggacagacacatcagtaggagtcacagcccctggtacccctcccagtccctccctaatcagttgactggctggctcaccttgggttccttacctggaatatgcaactgctgggccccttccaaattccatcctactttgtccccctagacgtgatttctctgcagcttccatttccaaggacattctagagatgagtaataatgggacttcccattgtcctgaaaccctgaatatactgagcagcctggcctgggactggatgtttcagcaaaaataagacagcagagaccatagtcaagcctggaggtcagttcagtctacaggcagtggaggcaaaaggtggggcagttttttgcaggtgtttcatgatgacttacttgaaccagtgacctctaaagatagagcagagtgcaaggaatgatctagaaagagtgaaggggacaggcaagagctggaggctttggagcagaaccatgttgcctgtcctgcgttcaagtttcctctccttctgcagagggcaggtgaggaccatgtggatctttccagaaatacatgtggacatttgcatatgcagaactgattggtggaaagggtgggaatgaactgctggaaatctggtcctcatggaccatgtgtgtttgatggatatgatacaaatttagagagaagttttgcaaatattttatttcattggacattctactctctgattccatgggttcgactactctagggacctcatgtaagtggattccagagtgaatatgagaagagactgctggtttccaggagctgggagtggggagaatcagaaattgttcatgggtgtgcagtttcagttatgcaaggtggggaggttatagagattggctgtcgagcttgatacctatagttcacacagattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgccctttttttttctctcaccacatttctagcttggtgattagtttttggtcaattccatactggccatgctgcactcgtatgtttttgaaggttttgggatgtgagaaagcctgattgctattttctgtgtcatcagaactttccaccttttcatggctgcatcatctttttctcagtgtttgtgttgtggcagtgattaataacagcctgtcaggtcagatttaggacagagttttctgattctgcaaaaaattttactgcgattctgctaggggttgcattgaatctgcaactcactttgggtagtattgtctttctaacaatattgactcttccaatccatgaaaatgaaatgtctttccatatattgatattgcatttaatttctttcagcaatgttttgtagtcttcagtgtataatcatttgacctttttggttaaacttattccaaaatagtttattccttttgatgttaatgtgaattgaaattcttttcttaatttcccttcagatagttcattgttagtgtatagtgtaaagaatgatctagaaagagtgaaagggacaggaaaagctggtggttttggagcagaaacatattccctgtcctgggtttttgattttccctctccctttgcagagggcaggtggctcttccctgatagctagatagacttcactggaaaacatattgccagtcctccagggatccactcaccagggactatgatcctcttgattatgagatttgttccaccaatggctgagttatggatgaaacagacatagacccctctatatgttttggtgatttggggtataaataacacttgtgctgattgctggaacttcccatcaatcagccaagaatgctctgctagtgggtgagagtctgtgaggcaggagagcttggggacttcccttgtatggtaataggtgtatgaggaagaaatggtgggggcatccaggccatctggagcaaagagaataaggtcacaggtgatattgtcagagggaagggaaaatcctggtctgtggaagggccacagttgccccgtgagccaagtcgcaacactgaagtcccaagaaaatccctgctgtgttcactgatctggagagtgagacattcacctgtttctcccatcacaagctctggaccatgagtctcccatgacaggagcagcctcttttctcctattgtggatcaagcctaggcctactcttgttttcctggggcagaaagtcatggccagttttgatgtccagggataaaggtctctgtacttggacctgagagggactgagaggcctggcctctggccatgtgtatttgggatggcagcgtggctcacagaggaacagaagatagtcacggaggagattcagggtgaatgggtcactgcggctggcactcactgggttccgtatttcacattcatagggtcctgcagtatactttgtggcaccaaatataaagagggtcctgttggttttggacagctgcaacctttgagtggtagggaggttctgaccattcatccaccacaggtagcttgcgttcggagttgcaggatcacagattaagatcacagcctccatgatctccctggggtttaatttgctgctggagatggagggcttgggagtctccactgtgcagaaaacagggagaagattgccctgtgtggcacctttgattcctccaaaggcatttttcaatcagagttggcatttccaacctctcagcccacccgagtccttaaaagcccatggcaggtgtgtgtgttacaagacagatgcatggcaatctgagggctcagagattgtgaggctgcctgcttcatgtgggagaagcacagactttctcaagtgtgaattgagcagcagcattgggtcatggaaagacacaggaccagcagtcacagcccctggtgcctctctgagtccctccatctccaactgcctgcctggcccaccttttggtcctcacttggagcatgcagtgctggaatcttcttagcttcagtcttactttgcccccgaggcatgttttctctgcagcttccctttccaaggacatcctagagatggatgatggaacttcccattgtccttaaaccctttgggtactggaaagcctggcctgggactgggtacttcagcagaaataacacaggggagaccagagtcaagcctggaggtcagttcagtcatcaggcagtggagccacaaggtggggcagttttcccagatgtctcatagtgactgacttgagccagtgacctctaaagatagagcagagtccaaggaatgacctacaaagagtgaaggggacaggcaagagctgatagctttggacgaagaccacgttccctgttctgggtccatgatgctcccttccccctgtagagggcaggtgaggaccatgtggatctttctggaaatacatgtggatgtttgcaaatgcagaactgactggtggaaagggcaaacatgaactgatgatggaagtctggccctcatggaccatatgtgtttggtggatattagaccaatatttgggaagaagtcttgcagatactttctctcattagacattctactctctgattctgagtttgactactctatgtacctgatatcagtggattccagagtgaatcagagagtagaatagtagtttgcaggagctgggatcaggggaatagggcgttgttccgtgggtgtgcggtttcagttatgcaggatgaggaggttctagagatctcctgtgcagcctcgtgcctatacttcatgcagatacagtgctccttatgcagaaagcttaaaacaaagtgttttggatgtctaattatttttttattttggaatatttgcagtacatgtactggtttagcatcccaaatctgaaaaatttaaaatccacaatgcgccagtgagcacttctttttagcatcacatcagtggtcagaagtgttgagttttgagcatttcagattgtggatttctggatttcagatgctcaatttgtaatactgtaattttcccataaaaagttttcaggactttagacctcatgttatgttctgactctagtaacaaaaaaaaatttggaggaaacattgaaatgttttcataagtgggaatttttactgatggtccaaacatctgagatcaattgctggtagtagtatttctcttgaggccaacataaggtttaggtgtgccatgaattccagcaggatcacattatgctcaaagaaagatgccaaaggtgatttgaaattagcaactccttaagtagagagagtcccgttaaaaggacaaaactgggtagtgtgtcaattacataaagggaggaatgatgccaaattaaaagaagtgatgtgtgttatgttagtaaatatagaaagaactccctgcttctgctttctgtgccgagttaggaaaaatcgggaggagcacaaagcaggtatgtgaaatactttcttcgttctctcttaagttcaggaaataacactagagtttaagtttgtgtgaattaggaagagtctaagtgagatgccaatggctcgtgtgtctccccacaggaagaactcgaacttatgaaagcagcatcatcatgaggaaacagttgtatgtggcacaggcagtaataccatcagatagcacccacctggccacctccagctggtccccaaaaccaccagtattcccattacatgtaggttacagcctttgtagttgtcccacaacaaagaaatttaaaaattgctattgtcaaaacaaaatattaaatatgaaggcgaatatgttgttccactttttttccccactctttttgacctttcttgtttcagttttggaagtttctattgacacatcctcaagctagggattctttcctcagctctgtgcagtctaccagtaagcatcaaaagcattcttcatttctctaacagcattttttattttctgagacagagtctcactctgtcaccccggctggagtgcagtggcatgatctcagctcactgcaagttccgcctcgcgggttcatgccattctcctgcctcaacctcccaagtagctggcactacaggtgcccaccaccaagcccagctaattttttgtatttttagtagagacggggtttcaccatgttagccaggatggtctctatctcgtgaacttgtgcccgccttggcctcccaaagtgctgggattataggcatgagccactgtgcccagccatctctgaaggattttaacgagttgttgacttttgagtttgttcagtttttacttagcgttagaaccgagtgacaaatttcaagcttgttatatgcctgacaggaagccagaagtctctaggaagtgactggagaatgtgagctccacagcaggttgaggatggagtcacgagtgaaatgagcccatgggctttggggactgcaggcctgtccagcctctgacaccctggtgagtcagagcaaagattacaacagtgacaggaaactagcgtggctgactccatctggcatctagtctcaggctggctgtcctcactcattcctgggcataggccaggctaacattgggaggaatttagtttatggtttaactttgaaacaagaaagataatagtacctccataaaactaacacccttactttgcccaggggctgcctttctaaaactagtgaaagaccatgagattgagattataggagggaaccgaattctgctacaatgtaggcacagtttctataatccctgactgatcaaatgtcatttggccagagtttacaaaatttgtaactaattgctcccatagataacatcactattgcagaacgtgagattagtcttttgagatgtttttcattcttttgcattctggcaactggctgacctcatccatacccatgactaatggctcagccagccatgtggtccctacctagaagtggattcaagcacaaacagttcatttccctccgcccgcatgattccatcaccaaacaatcagcagtactcattttttagtcctgtgtccctgaaatcatccttggaaatgtctaacacctgatccactggggaggctgatttgagtaataataaacctctgtcctcctgtttggcagacttggagtcattaaaatctttctttactacaaaccaccatttcaataattttttttttgtgtgtgtgtttgtgtctgtgtgtgcagaaggccagaagaacttgtctggcaatgataacagtggatggagaactgcctatccctgtcccatggtcttgtccacaggtcagcctcacaaagggaaagagccctagatgggaatacattggaagctcattctcttagtgacctggggacattggctggagataaagcccggcaggagtggcaactccaggtgatttctacacctttcctatttcctgggaggtgggccaggccacagtgttagcaggaagggaacagaactgccagactaattagagggagtgtctggggaaggcctaggtgtggaggaagaagctgtgcaggacagggcttgccagtcagaatgaagtgggaggaagatgagggacacagagaagcagagagaggcagagacaccatggcagtgagcagtgagggagacactgacttcagagaccccaggtaccaggtgcccccatttcctcagtccaggaccaaggagccctgagaaccctccggtggccaaagagcttcagagttgcatgaggtggggtggctttaggggcaagaggtagtagggggatgaaacatgggtgtcagcctctgaaggacaagggacaggtgtggctaggacctcctaggattctgcatccaagatccagtctctaaagaggttttggatcattcatttcttcatttgattccttcatttgttatgtgagagctcctgagtatgtgtctctggctgggcctgtgctggtgcagggtgtgagtggggaaagaaaacaaggtcctctccttgatcctctcatgacagtaacatggacactttgggaaacacaggatttcaggttcagtgatgggggttaagatctgagggggaggcctggacattttttttgcactgactctgatggttgaggcaggtgatttagttctggagtacagactaatcagctgaccatttgctctcactcctctgaggtttggatgcctaagaagagaggatttgagccaataaatgactatggggtgcttgaaacccagtaagccctcacttctggtggaggagaggatgggcctgtggctgcagacagacctcatgtgaccctgatctcccctttgggtttgtgtgactctggttcaaagactgtgccttcctgtgcctctgttttctctcaatcaaataagttaactggcaaatggactgtggcttttcatgctatctgtgaataaatgttaaagtattcacagtcacctgacttaatgcttggcacagtggaggtgttcacacaaacagcatttattattaatttgcttccatgagaaagcacatttatgtcagatccctgtggacaagctgctaccagttacaccttctctcttctgtttctgcttccgggaacattagactttctatggactgtcctgagcctcccaaggcagttggctgatggcctacaaagcttgtctttctgtcctctccactctgaatgtcaggtgaagaaagctctgtccttgcccagatgaggctctgagggctgagccctagctggtgaacagctgcaggagacacagtcctcagacagctggaaaacccttggtcccagtaagccctgcccaagaagccacaacccagccccagtacaggctccttagatttatctgcagcaaggatttagggacaagggtctggggttgaggcttctagggctgagcttctctgagagtatctcaggtggcctctcaggccaagccctactcagttatccagggtctttctcagggtcaaatttatgaagagggcatgaggtgcctggctgagactgatctcctcctgctgagtccccccatcagactgtccttcctctgcagcgagtgtctgcagggtctggatgtgggaaaggaattctgatctgttgaaatttgtctcctctgtgtgtgtcctgcactaaatgcccaaactccagcatgggacataatgcagagggggacacaggcacagtccaggcctgacaatcctgtgtgtgtgaagtagaagtgacccctgtcccccaacacccagggatcatgtggaatcacttacggtataaggtgaaggtgaaatttccagttactcctctagtcccatcacctcgctgtatgatgtgtaaggtgtaggatactccgtcctcccgggtgacattctggatcagcagggatgcattggaatatactgtttctcgtccactgtatgcaggcccatatgtaattctttgaccgtctactacatatgatgtaatgtaatggtagaggtcccttatttgccctttctaccacatgtaaccagtaagattctggggcaaattgtggacaagtagaagaacatccttcccctcggaaactttgggtggctgggcttcagtcgtgacttgggcaatggtaggtgggttccagaagtttaaaagtgatgctaggaggtggagagagcatcagtcaatattgagacctgtgtattggtgtgaaaacatggggccctgggtcctgagaaggtctcttcagtcctcagccttgacaacacagacacacacacacatacaaacacacacacacacacacaaaagcggcatgtgtgattgtgtgtgtgtatgtgtgtgtgtcctactgtcctactaggtcaaggtcagcagcatgacgcccattccttcaacacttctgaccttggcatttttctgtttggaatcctcttccccaggggtccgcatggccccctccacactgccctcaggtcctgcttacatcagggcatcgttagacttctttcctgatgcctgcttcagagaccctgggtcttccctttctgacctttccctgctctgctccctccagggttcttgtcaacacctgacctcacattctagatctctttgcatgtctgtcttcccccccatgacagcgtgagctccgtgaggacagggacttttgtgatcttggttgcaccccagtgcctggaacaggctgcagactcctgtagatgtgagagttctcagggccctccatgccctgggtgttttttttctcccaattgttgaggttttttgctgaggacagcatttcatgtcctgcttatatttttatttgaagtgtcatctgatatagttattattatcatttttcaaaatgtgctggcctctgatgattaatcaggaaaacagaacacttaagattttcctacctcttaccaattccggttcaatgtgactttcctattttgacccctgtccctctctggtgtattttcccctatccaggcatcaacagagcgttctttccttttttttttctttttttctttttttttttttttgtgacggattctcgtactgtcgcccgggctggcattcagtggcactatctcggctagctgcaacttctgcctcccgggttcaggtgattctcctgcctcagcctcccgagtggctaggattacaggagcacaccaccatacctggttaaatttttgtatttttagcagagacagggcttcactgtgttggccagactgatcgtgaactcctgatctcctgatccactcgcctcagcctcccaaagtgctggcttctttcattttttagaaccccatcctctccaggagaccccatccagtcactctgcttcctcctcctgtcctctcccaggaagttctctcctcacctgtgagcaggacccccttccatttgatgtgctgtgtgcagggaggggctgagaggggccccatggtctctgctgcttgtgtgttctcctctgtggagatgagcctaggttccagaaacttcctgagcacggctgtaggctgtgctgtccttcctccttctgc

SEQ ID NO: 2091 - DNA, 12515 bp, Homo sapiens
caggtatactacagtttttattttccacataatttttccctctatgggcatctctacttttaccaatgataatttcagtagaataagtttgtttgcaaaataggtggagtttcttcaaatgtggtctgattgtttacataagtgcagcaagagtagcaatggaccatgtaggctgtcttctaaaattttcttttctctaagtttttataaggaatctgagattaaatcttcacaaacctcttgagaataggaagccaaaccaaggctgacttcagactttgcctgcagttcatattggttcattctatctatgtttttaatataacatccgaatcaaagcattggtaatataaccaatgatttcaaatgtgtcatgttacaaagaaagcagattgttactgtacttgtgcaaatatgtgtattaccataaacatatcaattctcatgaatagttgcccaattctggggcagtcaggtagaaagcaaaagtaaatgtttcaattacggttcccagaagtatagtttattgaactgctataagctgtagatagattaaaagagaaaaattccatcaatgtagaaaacaaaccatttaaagaatcagcaaattttcaaataaaaatcataaaaacattatcttcattattatcaattatttcaatgaaatcaatgttcttcctgcttggtctaggctgggaatattatgaagatatcagcctgtttgttaaagttttcgaagttcttagacaaatttggagggttcaggaggagaatttgggatttgcttgtgcccatgggacacaggctgggaatacaattgttttcctgactcttctctgaatgccagatagactccacctaaaaccctattgccaacgatgctgggatccacttaccagagacttcgactgtcatggatttggagctttccttgccagtggctgagttacgaacagagcaaacatagagcccgctatgctttgtagtaatatggcggataaagagcttttgtcctggtagctgaaacttttcattaattgtccaagaatactgtgccggtgggttagagtccgcagaacaggacaagtagaggacttctcctgaacggtaataggtgaatgaagggtaaattctggggaggtctggaccatctggagcaaagagaataaagccacaggtgatgtcatctgagggaaggggatgttcctggtctcttaaagggacacagtgaccctctgagccaagacacaccctcaagtcccagcccaaccccctctatgttcactgagccgaatcctgaggtattcccctgtttctcccatcacaagctgtgggccccaagtctcccatgataagagcatcccctccccttatattcttggttaaggctgtgcctacccaggatttcccagggcagggagtcatggccagctccgatgtccagaagtaaaggtgtctatacttggaccggagagagactgagaggcctggcatctggtggtttggatttaagctggtgtcctggcccacagaggaacaaaagatactcacagaggacattcagggtgactgggtcactgcggatgccaccatatcggtcccgtatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaagtttaagacatccttattctccctggggtttaagttgttgatggtgatgtagggcttgggcagcttcgctgtgtggataacagagagaagattgtcctgtgtggcacctttgattcctccacaggtatccttcaatcagagttggcatctcccacctctcattccacccgagtccttgaaagccaatagctggtgcttttgtcacaagatagatgcatgatgatctaagggctcaaagactgtgaggccgccttctctgtcttagggaagcacagactttctgaagtgtcaattgagcagcagtgttgggtcatggacagacacgtcagtgggagtcacagcccctggtacccttcccaggccctccctaatcagttgactggctggctcaccttgggttccttacctggaatatgcaactgctgggccccttccaaattccatcctactttgtccccctagatgtgatttctctgcagcttccatttcaaaggacattctagagatgagtaataatgggacttccctttgtcctgcaaccctgaagatactgagcagcctggcctgggactggatgtttcagcagaaataacacaggggagaccagaatcaaggctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggggacaggcaagagctggtggctttggagcagaagcatgttccctgtcttgggttctttaagtttcctctccttctgcagagggcaggtgaggaccatgtggatctttccagaaatacatgtggacatttgcaaattcagaactgactggtagaaagggtgggaatgaactgctggaaatctggtcctcatgaaccatgtgtgtttgatggatatgagacaaatttggagagaggttttgcaaatattttatttcattggacattctactctctgattccatgggttcaactactctagggacctcatgtaagtggattccagagtgaatatgagaagagactgctggttgtcaggagctgggagtgggtagaatcagaagttgttcatgggtgtgcagtttcagttatgcaaggtggggaggttctagagaactgctgtagagcttgatgcctatagttcacacagattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgcccttttttttctctcaccacgtttctagcttggtgatcagttttcggtgaattccacagtggccatgctgcactcgtatatttttgaaggccttgggatgtgagaaaggctgattgctattttctatgtcatcagaactttccaccttttcatggttacctctttttctcagtgtttgtgttgtgtcagtcattaataagagcctgtcatgtgagatttaggacagtgttttctaattctgcaaaaaatgttactgtgattctggtaggggatgcattgaatctgcaactcattttgggtaatgttgtctttctaacaatattgattcttccaatccatgaaaatgaaatgtctttccatatattgatatcgtctttaatttctttcagcaatggtttgtagttttcagggtataatcatttgacttttttggttaaacttactccaaaatattttattccttttgatgttaatgtgaattgaaattatttccttaatttcctttcagattgttcattgttagtgtatagtctaaagaatgatctagaaagagtgaaggggacaggcaaaagctggtggttttggagtagaaacatattccctgtcctgggtttttgattttccctctccctttgcagagggcaggtggctcttccctgatagctagatagacttcactggaaaacatattgccaatgctccagggatccacttaccagggactatgatcctcttgattatgagatttgttccaccagtggctgagttatggatgaaacagacctagatccctgtatatgttttagtgatttggggtataaagaacacttgtgttgattgctggaacttcccagcaatcagccaagaatgctctgccagtggatggagtctgtgaggcaggagagcttggggacttcccctgtatggtaataggtgtatgaggaagaaatggtgggggcatccaggccatgtggagtaaagagaataatgtcacaggcactattgtcagagggaagggaaaatcctggtctgtggaagggccacaatcacagtgaccctgtgagccaagtcacaacattgaagtcccagccaaatccccactgtgttcacagatctggagcctgagaccttcacctgtttctcccatcacaagctgtggaccctgagtctcccatgacaggagcagcctcttttctcctattgttgatgaagcctaggtctactctggtttgcctggggcacaaagtcatggccaggtttgatgtccaggggtaaaggtctctgtattggacctgagagggacagagaggcctggcctctggccacgtgtatttgggatggcagcctggctcacagaggaacagaagatactcacggaggagattcagggtgactgggtcactgcggctggcactcactgggttccgtatttcacattcatagggtcctgcagtatactttgtgacacccaatagaaagagggtcctgttggtttcggacagcttcaagctgtgagtcatagggaggctctgaccattcatccaccacaggtagcttgcgtctggagtctcagggtcacaggttaagctcacagcctccatggtctccctgggatttaagttgctgctggagatggagggcttaggagtctccactgtgcagaaaacagggtgaagattgccgtgtgtggcgcctttgattcctccaaaggcatttttcaatcagaattggcatttcccacctctcagcccacccaagtccttaaaagcccatggcaggtgtgtgtgatacaagacagatgcatggcaatctgagggctcagagattgtgaggctgcctgcttcatgtgggagaagcacagactttctcaagtgtgaattgagcagcagcattgggtcatggaaagacacaggaccagcagtcacagcccctggtgcctctgtgtgtccctccgtctccaactgcctgcctggcccaccttgtggtcctcacttggagcatgcagtgctggaatcttgttagtttcagtctcactttgcccactgaggtatgttttctctgcagcttcccttgccaaggacatcctagagatggatgatggaacttcccattgtccttaaaacctttgggtactggaaagcctggcctgggactgggtattctagcataaaacaggggagaccagagtcaagcctggaggtcagttcagtcatcaggcagtggagccacgaggtggggcagttttcccaggtgtctcatagtgactgagttgagctagtgactctaaagatagagcagagtccaaggaatgacctacaaagagtgaaggggataggcaagagctgatagctttggaccaagaccatgttctctcttctgggtccatgatgctcccttccccctgtagagggcagttgaggaccatgtggatctttctagaaatacatgtggatctttgcaaatgcagaactgactggtggaaagggcgatcatgaactgatgacggaagtctggccctcatggaccatatgtgtttggtgaatattagaccaatatttgggaagaagtcttgcagatactttctctcattagacattctactctctgattctgagtttgactactctatgtacctgatatcagtggattccagagtgaatcagagagtagaatagtagtttgcaggagctgggatcaggggaatagggtgttgttccgtgggtgtgcagtttcagttatgcaggaagaggaggttctagagatctcctgtacagcctcatgcctatacttcatacagataaagtgctccttatgcagaaagcttgaaactaagtgttttggatgtctaattatttttttattttggaatatttgcagtacatgtactggtttagcatcccaaatctgaaaaatttaaaatccacaatgcgccagtgagcacttctttttagcatcacatcagtggtcagaagtgttgagttttgagcatttcagattgtggatttctggatttccgatgctcaatttgtaacagtgtaatttttccgtaaaaatttgtcaggagtttagacctcatgttatattctgactctagtaacaaaaaaaatttggaggaaacattaaaatgttttcataagtggaaatttttactgatggtccaaacatctaagatcaattgctggtagtagtatttctcttgagaccaaaataaggtttaggtgtgccgtgaattccagcaggatcacgttatgctcaaagaaagatgccaaaggtgatttgaaattagcagctccttaagtagagagagtcccattgaaaggaccgaactggtcagtgcatcaattacataaagggagaaaggatgtcaaattaaaagaagtgatgtgtgttatgttagtaaatatagaaagaactccctgcttctaaattctgtgcagagttaggaaaaatggggaggacctcaaaacaggtatgtgaaatgctttcttcattttctcttaagctcaggaaacaccactagagtttaagtttgtgtgaattaggaagagtctaagtgagatggcaatggctcttgtgtctccccacacgaagatctccaacttatgaaaatgacatcatcatgaggaaacagttataggtggcacaggcagtaaaaccatcagataacacccacctggtcaactccaactagtccccaaaaccaccggtattcccattacgtgtacattacagtctttgtagttgtcccacagctacaaaatttaaaaattgctattgtcaaaacaaaatattaaatatgaagttgaatatgttgttccactttttttccccactctttttgaactttcctgtttcagttttggaagtttctgttgacacatcctcaagctaggtattctttccacagctgtgtgcagtctaccagtaagcatcaaaagcattcttcatttctctaacagggttttttttttctgagacagagtctcgctctgtcaccccggctgcagtgcagtggcatgatctcagctcactgcaagctctgcctcctgggttcacaccattctcctgccttggcctcccaagtagctgggactacaggggcccgccaccatgcctggctaattttttgcatttttagtagagacggggtttcaccatgttagccaggatggtctctatctcttgaccttgtgcccgcctcggcctcccaaagtgctgggattataggcgtgagccactgtgcgcagccgtctctgagggagtttaatgagttgttgccttttgagtttgttcagctttttacttagtgttagaaccgagtgacaaatttcaagcttgttatacgcctgtcaggaagctagaactctctagaaagtgaccggagaatgtgagctccatagcaggttgaggatggcgtcatgagtgaggatggggtcaagagtccactcagagatggagtgcccagccatctctgagggattttaacaagttgttgacttttgagtttgttcagctttttacttagcgttagaaaccagtgacaaatttcaagcttgttatatgcctgacaggaagccagaagtctataggaagtgactggagaatgtgagctccttagcaggttgaggctggagtcacaggtgaaatgagcccatggggtttggggacagcaggcctgtccagcctctgacaccctggtgagtcagtgcagagattacaacagtgacagcaaactagcatggctgactccatctggcatctagtctcaggctggctgtcctcactcattcctgggcataggccaggttaaccttgggaggaatttagtttatggtttaaacttgaagcaagaatgataatagttcctccataaaactaacacccttactttgtccagggactgcctttgtaaaactagtgaaagaccatgagattaagattataggagggaactgaattttgctaaaatgtaggcacagtttctataatccctgactgctccagtgtcattgggacagggtttacaaaatttgtaactaattgctcctatagataacatcactattgtagaacgtgagattggtcttttgagatgtttctcattcttttgcattctggcaaccggctgacctcatccatacctatgactaatggctcagccagtcatgtggtccctacctagaggcagattcaagcacaaacagatcatgtccccctgcccccatgattccatcaccaaacaatcagcagtactaattttttagtcctgtggccctgaaactatccttgaaaatctctaagccctgatccactggggaggctgatttgagtaataataaacctctgtcctcctgtttggcagacttggagtcattaaaatctttctttactgcaaaccgccatttcaattattttattttatttatttatttgtttttttttttttttgtgcaggaggccagaggaacttgtctggcaattatgagagtggatggaggaactgcctatccctgtcccatggtcttgtccacaggtcagcctcacaaagggaaagagccctggatgggaatacagtggaaggtcattctcttagtgacctggggacattggctcgagaggaagcctggcaggagtggcaactccagatgatttctgtgcctttcctctttcctgggaggtgggccaggccacagtgttagtgggaagggaactgaacagccagagtggttagagggagtgtctagggaaggcctagaggtggaggaagaagctgtgcaggacagggcttgccagtcagaatgaagtgggaggaagatgagggacacagagaagcagagagaggcagatacaccatggcagtgagcagtgagggagacactgtcttcagaaactccagggaccaggtgcccccagttccatagtccaggaccaaggagccctcgagaaccctccggtggcttaagagcttcagaattacatgaggtggggtggctttaggggcaagaggtagtggggggatgaaacatggatgtcagcctctgaaggacaagggacaggtgtggctagaacctcctaggattctgcatccaagatccaatctctaaagaggttttggatcattcatttcttcattccattccttcatttgtcatgtgagagctcctgagtgtgtgtctctctcgctgggcctgtggtggtgtagagtgtgagtggggaaagaaaacaaggtcctctccttgatcctctcatgacagtgacaaggacactttgggaaacacaggatttcaggttcagtgatggtggttaagatctgaggaggaggcctggacatttttttgcactgactctgatggttgaagcaggtgatttagttctggagtgcagactaatcagctgaccatttgctctcactcctctgaggtttggatgcctaagaagagaggatttgagccaacaaatgactatggggtgcttggaacccagtaagccctcacttctggtggagtagaggatgggcctgtggctacagacagacctcatgtgaccctgatctcccctttgtgtttgtgtgactcttgctcagtcactgtgccttcctgtgcctcagttttctctcaatcaaataagctaaatggcaaatggactgtggcttttcatgctatctgtgaataaatgttaaattattcacagtcacctgacctaatgcttggcacagtggaggtttcacacaaacagcatttattattaatttgcttccatgagaaagcacctttacgtcagatccctgtggacaagctgctacctggtacatcttctctcttctgtttctgcttctggggacattagtctttctatggactatcctaagcctcctaaggcagttgggtgatggcctacaaagcttgtctttctgtcctctccactctgagtatcaggtgaagaaagctctgtcctggcccagatgaggctctgagggctgagccctggctggtgaacagctccaggagacacagtcctctgacagctggtaaatccttggtcccagtaagccctgcccaagaagccacaacccagtcccagcacaggctcctcagctttatctggaacaaggatttagggacaagggtctggggttgaggcttctagggctgagcttctctgagagtatctcagggggcccctcaggccaagccctactcagttatccagggtctttctcagggtcaaatttatgaagagggcatgaggtgcttggctgagactgatctcctcctgctgagtccccccatcagactgtccttcctctgcagcgagtgtctgcagggtctggatgcaggaaaggaattctgatctgttgaaatttgtctcctctgtgtgtgtcctgcactaaatgcccaaatcccagcatgggacataacgcagtgagtgacacaggcagagtccaggcctgacaatcctgtgtgtgtgaagtagaagtgacccctgtcccccaacacccagggatcatgtggaatcacttacggtgtaaggtgaaggtgaaacgtccagttactcctctagtcccatcatctccctttatgatgtgtaaggtgtaggatcctgcgtcctcccgggtgacattctggatcagcagggatgcattggaatatgctgtttctcgtccactatatgcaggcccatatataattatttcaccgtctactacatatgatgtaatgtaatggtagaggtccctcatttgccctttgtaccagatgtagccggtaagattctggggcaaattgtggacaagtagaagaacatccttcccctcggaaactttggttggctcggcttcaatcgtgacttgggcagtggtgggcaggttccagaagtttaaaagtgatgctaggaggtggagagaacatcagtcaatattgagacctatgtattggtgtgaaaacatggggccctgggtcctgagaaggtctcttcagtcctcagccttgacaacacagacacacacacacatacaaacacacacacacacacacacacaaaagcggcatgtgtgattgtgtgtgtgtatgtgtgtgtgtcctactgtcctactaggtcaaggtcagcagcatgacgcccattccttcaacacttctgacgttggcatttttctgtttggaatcctcttccccaggggtccgcatggccccctccacaatgccctcaggtcctgcttacatcagggcatcgttagacttctttcctgatgcctgcttcagagaccctgggtcttccctttctgacctttccctgctctgctccctccagggttcttgtcaacacctgacctcacattctagatctctttgcatgtctgtcttcccccccatgacagcgtgagctccgtgaagacagggacttttgtgatcttggttgcaccccagtgcctggaacaggctgcagactcctgtagatgtgagagttctcagggccctccatgccctgggtgttttttttcccccaattgttgaggtttcttgctgaggacagtgtttcctgccctgtttatatttttatttgaggtgtcatctgctatagttattattatcatttttcaaaatatggtggcccctgatgattaatcaggaaaacagaacacttaagattttcctacctcttaccaattccggtccaatacgactttcctgttttgacccctgtccctctctggtgtattttcccctatccaggctccaacagagccttctttcctttttttcttttttctttttttttttttgagatggagtcttgtactgtcgcccaggctggcatgcggtggtgctatctcagctatctgcaacttctgcctcccgggttcacgtgattctcctgcctcagcctcccgagtagctaggattataggagcacaccaccatacctggttaaatttttgtattttcagtacagacagggcttcactgtgttggccagactgatcttgaacttctgatctcatgatccacccacctcagactcccaaagtgctggcttctttcattttttagaaccccatcctctccaggagaccccatccagtcactctgcttcctcctcctgtcctctcccaggaagttctctcctcacctgtgagcaggagccccttccatttgatgcgctgtgtgcagggaggggctgagagggttcccatggtctctgctgcttgtgtgttctcctctgtggagataagcctaggatccagaaactctctgagcacggctgtcagctgtgctgtccttcctctttctgtgctgagcctcttcccagggcaggagcaattctcaagctc

SEQ ID NO: 2092 - DNA, 13260 bp, Homo sapiens
agtattagcaaaggtggtacatgttttattctgctagaatgtcttactgtcacgttttacaatgtatctcttaggaaacggcaagagccatccacacaatgtggatttaaaggggactctattataatttcagctttcctacgtcttcatacaaaccatcttctctgcaaacacacaggcaatatctctgtgttcatttctattgggagccctgtatgcaaggtggagagagccacatttccccctgagatgttatgtaaaagtttgaggttgagatgacatatctgacactctgttgttactctcagaagctactacatgtgaaattctaatgactgcattatcctgccaagtgaaagaggcaggcatgagcaaggacagttaagaggggggagagcctcatcatgatggggagtcttgttctgacatcttgggaaaaactgtccacagtgtgaagtcatccacttgttgtcctggtttacagtttgagcatctgttgttatggtgtcgaatattttggtgagttctgagtggctcatgcttcacgtacaagggttttcccatgaaatttacattgagttgtccacctccagcttatagggcttctggaacagagtgggtcttgctcttagtgattccatgggagaaaatggaattggaggtactagtagaattcagggaactgtccagtctacaggtggataataaaaacacagaaacaatgaacagagctgcagtctcataacaggtatactacagtttttattttccacataatttttccctctatgggcatctctacttttaccaatgataatttcagtagaataagtttgtttgcaaaataggtggagtttcttcaaatgtggtctgattgtttacataagtgcagcaagagtagcaatggaccatgtaggctgtcttctaaaattttcttttctctaagtttttataaggaatctgagattaaatcttcacaaacctcttgagaataggaagccaaaccaaggctgacttcagactttgcctgcagttcatattggttcattctatctatgtttttaatataacatccgaatcaaagcattggtaatataaccaatgatttcaaatgtgtcatgttacaaagaaagcagattgttactgtacttgtgcaaatatgtgtattaccataaacatatcaattctcatgaatagttgcccaattctggggcagtcaggtagaaagcaaaagtaaatgtttcaattacggttcccagaagtatagtttattgaactgctataagctgtagatagattaaaagagaaaaattccatcaatgtagaaaacaaaccatttaaagaatcagcaaattttcaaataaaaatcataaaaacattatcttcattattatcaattatttcaatgaaatcaatgttcttcctgcttggtctaggctgggaatattatgaagatatcagcctgtttgttaaagttttcgaagttcttagacaaatttggagggttcaggaggagaatttgggatttgcttgtgcccatgggacacaggctgggaatacaattgttttcctgactcttctctgaatgccagatagactccacctaaaaccctattgccaacgatgctgggatccacttaccagagacttcgactgtcatggatttggagctttccttgccagtggctgagttacgaacagagcaaacatagagcccgctatgctttgtagtaatatggcggataaagagcttttgtcctggtagctgaaacttttcattaattgtccaagaatactgtgccggtgggttagagtccgcagaacaggacaagtagaggacttctcctgaacggtaataggtgaatgaagggtaaattctggggaggtctggaccatctggagcaaagagaataaagccacaggtgatgtcatctgagggaaggggatgttcctggtctcttaaagggacacagtgaccctctgagccaagacacaccctcaagtcccagcccaaccccctctatgttcactgagccgaatcctgaggtattcccctgtttctcccatcacaagctgtgggccccaagtctcccatgataagagcatcccctccccttatattcttggttaaggctgtgcctacccaggatttcccagggcagggagtcatggccagctccgatgtccagaagtaaaggtgtctatacttggaccggagagagactgagaggcctggcatctggtggtttggatttaagctggtgtcctggcccacagaggaacaaaagatactcacagaggacattcagggtgactgggtcactgcggatgccaccatatcggtcccgtatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaagtttaagacatccttattctccctggggtttaagttgttgatggtgatgtagggcttgggcagcttcgctgtgtggataacagagagaagattgtcctgtgtggcacctttgattcctccacaggtatccttcaatcagagttggcatctcccacctctcattccacccgagtccttgaaagccaatagctggtgcttttgtcacaagatagatgcatgatgatctaagggctcaaagactgtgaggccgccttctctgtcttagggaagcacagactttctgaagtgtcaattgagcagcagtgttgggtcatggacagacacgtcagtgggagtcacagcccctggtacccttcccaggccctccctaatcagttgactggctggctcaccttgggttccttacctggaatatgcaactgctgggccccttccaaattccatcctactttgtccccctagatgtgatttctctgcagcttccatttcaaaggacattctagagatgagtaataatgggacttccctttgtcctgcaaccctgaagatactgagcagcctggcctgggactggatgtttcagcagaaataacacaggggagaccagaatcaaggctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggggacaggcaagagctggtggctttggagcagaagcatgttccctgtcttgggttctttaagtttcctctccttctgcagagggcaggtgaggaccatgtggatctttccagaaatacatgtggacatttgcaaattcagaactgactggtagaaagggtgggaatgaactgctggaaatctggtcctcatgaaccatgtgtgtttgatggatatgagacaaatttggagagaggttttgcaaatattttatttcattggacattctactctctgattccatgggttcaactactctagggacctcatgtaagtggattccagagtgaatatgagaagagactgctggttgtcaggagctgggagtgggtagaatcagaagttgttcatgggtgtgcagtttcagttatgcaaggtggggaggttctagagaactgctgtagagcttgatgcctatagttcacacagattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgcccttttttttctctcaccacgtttctagcttggtgatcagttttcggtgaattccacagtggccatgctgcactcgtatatttttgaaggccttgggatgtgagaaaggctgattgctattttctatgtcatcagaactttccaccttttcatggttacctctttttctcagtgtttgtgttgtgtcagtcattaataagagcctgtcatgtgagatttaggacagtgttttctaattctgcaaaaaatgttactgtgattctggtaggggatgcattgaatctgcaactcattttgggtaatgttgtctttctaacaatattgattcttccaatccatgaaaatgaaatgtctttccatatattgatatcgtctttaatttctttcagcaatggtttgtagttttcagggtataatcatttgacttttttggttaaacttactccaaaatattttattccttttgatgttaatgtgaattgaaattatttccttaatttcctttcagattgttcattgttagtgtatagtctaaagaatgatctagaaagagtgaaggggacaggcaaaagctggtggttttggagtagaaacatattccctgtcctgggtttttgattttccctctccctttgcagagggcaggtggctcttccctgatagctagatagacttcactggaaaacatattgccaatgctccagggatccacttaccagggactatgatcctcttgattatgagatttgttccaccagtggctgagttatggatgaaacagacctagatccctgtatatgttttagtgatttggggtataaagaacacttgtgttgattgctggaacttcccagcaatcagccaagaatgctctgccagtggatggagtctgtgaggcaggagagcttggggacttcccctgtatggtaataggtgtatgaggaagaaatggtgggggcatccaggccatgtggagtaaagagaataatgtcacaggcactattgtcagagggaagggaaaatcctggtctgtggaagggccacaatcacagtgaccctgtgagccaagtcacaacattgaagtcccagccaaatccccactgtgttcacagatctggagcctgagaccttcacctgtttctcccatcacaagctgtggaccctgagtctcccatgacaggagcagcctcttttctcctattgttgatgaagcctaggtctactctggtttgcctggggcacaaagtcatggccaggtttgatgtccaggggtaaaggtctctgtattggacctgagagggacagagaggcctggcctctggccacgtgtatttgggatggcagcctggctcacagaggaacagaagatactcacggaggagattcagggtgactgggtcactgcggctggcactcactgggttccgtatttcacattcatagggtcctgcagtatactttgtgacacccaatagaaagagggtcctgttggtttcggacagcttcaagctgtgagtcatagggaggctctgaccattcatccaccacaggtagcttgcgtctggagtctcagggtcacaggttaagctcacagcctccatggtctccctgggatttaagttgctgctggagatggagggcttaggagtctccactgtgcagaaaacagggtgaagattgccgtgtgtggcgcctttgattcctccaaaggcatttttcaatcagaattggcatttcccacctctcagcccacccaagtccttaaaagcccatggcaggtgtgtgtgatacaagacagatgcatggcaatctgagggctcagagattgtgaggctgcctgcttcatgtgggagaagcacagactttctcaagtgtgaattgagcagcagcattgggtcatggaaagacacaggaccagcagtcacagcccctggtgcctctgtgtgtccctccgtctccaactgcctgcctggcccaccttgtggtcctcacttggagcatgcagtgctggaatcttgttagtttcagtctcactttgcccactgaggtatgttttctctgcagcttcccttgccaaggacatcctagagatggatgatggaacttcccattgtccttaaaacctttgggtactggaaagcctggcctgggactgggtattctagcataaaacaggggagaccagagtcaagcctggaggtcagttcagtcatcaggcagtggagccacgaggtggggcagttttcccaggtgtctcatagtgactgagttgagctagtgactctaaagatagagcagagtccaaggaatgacctacaaagagtgaaggggataggcaagagctgatagctttggaccaagaccatgttctctcttctgggtccatgatgctcccttccccctgtagagggcagttgaggaccatgtggatctttctagaaatacatgtggatctttgcaaatgcagaactgactggtggaaagggcgatcatgaactgatgacggaagtctggccctcatggaccatatgtgtttggtgaatattagaccaatatttgggaagaagtcttgcagatactttctctcattagacattctactctctgattctgagtttgactactctatgtacctgatatcagtggattccagagtgaatcagagagtagaatagtagtttgcaggagctgggatcaggggaatagggtgttgttccgtgggtgtgcagtttcagttatgcaggaagaggaggttctagagatctcctgtacagcctcatgcctatacttcatacagataaagtgctccttatgcagaaagcttgaaactaagtgttttggatgtctaattatttttttattttggaatatttgcagtacatgtactggtttagcatcccaaatctgaaaaatttaaaatccacaatgcgccagtgagcacttctttttagcatcacatcagtggtcagaagtgttgagttttgagcatttcagattgtggatttctggatttccgatgctcaatttgtaacagtgtaatttttccgtaaaaatttgtcaggagtttagacctcatgttatattctgactctagtaacaaaaaaaatttggaggaaacattaaaatgttttcataagtggaaatttttactgatggtccaaacatctaagatcaattgctggtagtagtatttctcttgagaccaaaataaggtttaggtgtgccgtgaattccagcaggatcacgttatgctcaaagaaagatgccaaaggtgatttgaaattagcagctccttaagtagagagagtcccattgaaaggaccgaactggtcagtgcatcaattacataaagggagaaaggatgtcaaattaaaagaagtgatgtgtgttatgttagtaaatatagaaagaactccctgcttctaaattctgtgcagagttaggaaaaatggggaggacctcaaaacaggtatgtgaaatgctttcttcattttctcttaagctcaggaaacaccactagagtttaagtttgtgtgaattaggaagagtctaagtgagatggcaatggctcttgtgtctccccacacgaagatctccaacttatgaaaatgacatcatcatgaggaaacagttataggtggcacaggcagtaaaaccatcagataacacccacctggtcaactccaactagtccccaaaaccaccggtattcccattacgtgtacattacagtctttgtagttgtcccacagctacaaaatttaaaaattgctattgtcaaaacaaaatattaaatatgaagttgaatatgttgttccactttttttccccactctttttgaactttcctgtttcagttttggaagtttctgttgacacatcctcaagctaggtattctttccacagctgtgtgcagtctaccagtaagcatcaaaagcattcttcatttctctaacagggttttttttttctgagacagagtctcgctctgtcaccccggctgcagtgcagtggcatgatctcagctcactgcaagctctgcctcctgggttcacaccattctcctgccttggcctcccaagtagctgggactacaggggcccgccaccatgcctggctaattttttgcatttttagtagagacggggtttcaccatgttagccaggatggtctctatctcttgaccttgtgcccgcctcggcctcccaaagtgctgggattataggcgtgagccactgtgcgcagccgtctctgagggagtttaatgagttgttgccttttgagtttgttcagctttttacttagtgttagaaccgagtgacaaatttcaagcttgttatacgcctgtcaggaagctagaactctctagaaagtgaccggagaatgtgagctccatagcaggttgaggatggcgtcatgagtgaggatggggtcaagagtccactcagagatggagtgcccagccatctctgagggattttaacaagttgttgacttttgagtttgttcagctttttacttagcgttagaaaccagtgacaaatttcaagcttgttatatgcctgacaggaagccagaagtctataggaagtgactggagaatgtgagctccttagcaggttgaggctggagtcacaggtgaaatgagcccatggggtttggggacagcaggcctgtccagcctctgacaccctggtgagtcagtgcagagattacaacagtgacagcaaactagcatggctgactccatctggcatctagtctcaggctggctgtcctcactcattcctgggcataggccaggttaaccttgggaggaatttagtttatggtttaaacttgaagcaagaatgataatagttcctccataaaactaacacccttactttgtccagggactgcctttgtaaaactagtgaaagaccatgagattaagattataggagggaactgaattttgctaaaatgtaggcacagtttctataatccctgactgctccagtgtcattgggacagggtttacaaaatttgtaactaattgctcctatagataacatcactattgtagaacgtgagattggtcttttgagatgtttctcattcttttgcattctggcaaccggctgacctcatccatacctatgactaatggctcagccagtcatgtggtccctacctagaggcagattcaagcacaaacagatcatgtccccctgcccccatgattccatcaccaaacaatcagcagtactaattttttagtcctgtggccctgaaactatccttgaaaatctctaagccctgatccactggggaggctgatttgagtaataataaacctctgtcctcctgtttggcagacttggagtcattaaaatctttctttactgcaaaccgccatttcaattattttattttatttatttatttgtttttttttttttttgtgcaggaggccagaggaacttgtctggcaattatgagagtggatggaggaactgcctatccctgtcccatggtcttgtccacaggtcagcctcacaaagggaaagagccctggatgggaatacagtggaaggtcattctcttagtgacctggggacattggctcgagaggaagcctggcaggagtggcaactccagatgatttctgtgcctttcctctttcctgggaggtgggccaggccacagtgttagtgggaagggaactgaacagccagagtggttagagggagtgtctagggaaggcctagaggtggaggaagaagctgtgcaggacagggcttgccagtcagaatgaagtgggaggaagatgagggacacagagaagcagagagaggcagatacaccatggcagtgagcagtgagggagacactgtcttcagaaactccagggaccaggtgcccccagttccatagtccaggaccaaggagccctcgagaaccctccggtggcttaagagcttcagaattacatgaggtggggtggctttaggggcaagaggtagtggggggatgaaacatggatgtcagcctctgaaggacaagggacaggtgtggctagaacctcctaggattctgcatccaagatccaatctctaaagaggttttggatcattcatttcttcattccattccttcatttgtcatgtgagagctcctgagtgtgtgtctctctcgctgggcctgtggtggtgtagagtgtgagtggggaaagaaaacaaggtcctctccttgatcctctcatgacagtgacaaggacactttgggaaacacaggatttcaggttcagtgatggtggttaagatctgaggaggaggcctggacatttttttgcactgactctgatggttgaagcaggtgatttagttctggagtgcagactaatcagctgaccatttgctctcactcctctgaggtttggatgcctaagaagagaggatttgagccaacaaatgactatggggtgcttggaacccagtaagccctcacttctggtggagtagaggatgggcctgtggctacagacagacctcatgtgaccctgatctcccctttgtgtttgtgtgactcttgctcagtcactgtgccttcctgtgcctcagttttctctcaatcaaataagctaaatggcaaatggactgtggcttttcatgctatctgtgaataaatgttaaattattcacagtcacctgacctaatgcttggcacagtggaggtttcacacaaacagcatttattattaatttgcttccatgagaaagcacctttacgtcagatccctgtggacaagctgctacctggtacatcttctctcttctgtttctgcttctggggacattagtctttctatggactatcctaagcctcctaaggcagttgggtgatggcctacaaagcttgtctttctgtcctctccactctgagtatcaggtgaagaaagctctgtcctggcccagatgaggctctgagggctgagccctggctggtgaacagctccaggagacacagtcctctgacagctggtaaatccttggtcccagtaagccctgcccaagaagccacaacccagtcccagcacaggctcctcagctttatctggaacaaggatttagggacaagggtctggggttgaggcttctagggctgagcttctctgagagtatctcagggggcccctcaggccaagccctactcagttatccagggtctttctcagggtcaaatttatgaagagggcatgaggtgcttggctgagactgatctcctcctgctgagtccccccatcagactgtccttcctctgcagcgagtgtctgcagggtctggatgcaggaaaggaattctgatctgttgaaatttgtctcctctgtgtgtgtcctgcactaaatgcccaaatcccagcatgggacataacgcagtgagtgacacaggcagagtccaggcctgacaatcctgtgtgtgtgaagtagaagtgacccctgtcccccaacacccagggatcatgtggaatcacttacggtgtaaggtgaaggtgaaacgtccagttactcctctagtcccatcatctccctttatgatgtgtaaggtgtaggatcctgcgtcctcccgggtgacattctggatcagcagggatgcattggaatatgctgtttctcgtccactatatgcaggcccatatataattatttcaccgtctactacatatgatgtaatgtaatggtagaggtccctcatttgccctttgtaccagatgtagccggtaagattctggggcaaattgtggacaagtagaagaacatccttcccctcggaaactttggttggctcggcttcaatcgtgacttgggcagtggtgggcaggttccagaagtttaaaagtgatgctaggaggtggagagaacatcagtcaatattgagacctatgtattggtgtgaaaacatggggccctgggtcctgagaaggtctcttcagtcctcagccttgacaacacagacacacacacacatacaaacacacacacacacacacacacaaaagcggcatgtgtgattgtgtgtgtgtatgtgtgtgtgtcctactgtcctactaggtcaaggtcagcagcatgacgcccattccttcaacacttctgacgttggcatttttctgtttggaatcctcttccccaggggtccgcatggccccctccacaatgccctcaggtcctgcttacatcagggcatcgttagacttctttcctgatgcctgcttcagagaccctgggtcttccctttctgacctttccctgctctgctccctccagggttcttgtcaacacctgacctcacattctagatctctttgcatgtctgtcttcccccccatgacagcgtgagctccgtgaagacagggacttttgtgatcttggttgcaccccagtgcctggaacaggctgcagactcctgtagatgtgagagttctcagggccctccatgccctgggtgttttttttcccccaattgttgaggtttcttgctgaggacagtgtttcctgccctgtttatatttttatttgaggtgtcatctgctatagttattattatcatttttcaaaatatggtggcccctgatgattaatcaggaaaacagaacacttaagattttcctacctcttaccaattccggtccaatacgactttcctgttttgacccctgtccctctctggtgtattttcccctatccaggctccaacagagccttctttcctttttttcttttttctttttttttttttgagatggagtcttgtactgtcgcccaggctggcatgcggtggtgctatctcagctatctgcaacttctgcctcccgggttcacgtgattctcctgcctcagcctcccgagtagctaggattataggagcacaccaccatacctggttaaatttttgtattttcagtacagacagggcttcactgtgttggccagactgatcttgaacttctgatctcatgatccacccacctcagactcccaaagtgctggcttctttcattttttagaaccccatcctctccaggagaccccatccagtcactctgcttcctcctcctgtcctctcccaggaagttctctcctcacctgtgagcaggagccccttccatttgatgcgctgtgtgcagggaggggctgagagggttcccatggtctctgctgcttgtgtgttctcctctgtggagataagcctaggatccagaaactctctgagcacggctgtcagctgtgctgtccttcctctttctgtgctgagcctcttcccagggcaggagcaattctcaagctc

SEQ ID NO: 2093 - DNA, 5017 bp, Homo sapiens
tgaaataatcagactcaaaaagacaactactacatgattccacttaacagaggtgcgtaacgtcatgaaatgcataggcagaaaatgaaaaggtggttgtcagcggctggagggagggggaaagaggagttggtgtttaatgggtacagaattccagttggggaatatgaaaaagttctgggtggggatggacagtggtggtggttgaacaacaacctaaatgtacttcctgccactggatgtacacttaaaagtggttaaaatgggccgagcgaggtggcttgcgtctaatcccagcactttgggaggtcgaggtgggcagatcatgaggtcaggagattgagaccatcctggctaacatgatgaaatctccgctctactaaaaatacaaaaaattagctgggcatggtggcatgcacctgtagtcccagctactcaggaggctgaagcaggagaagtggttgaacccgggaggtgaagtttgcagtgagctgagatcatgccattgcattccagcctgggtgacagaagaggaacccttctcaaaaaaaaaaaaaaaaaagacagaaaaaaaagaaaggaaaaaaatggttaaaatggtgaattctatgttatatatatttcacaataatttacaataattcctattgttttgcataaaacagctgtagaaagctttgcaggtcatgaacagcacagctggccactggggctggcgtggggctaggacctgggtgcatagggaacagggatgagacacaggctcttcatgcctgcacacatatacagatacacacagatggaaattactgagccatctaaatacaacacctattcaaaaaatcaaacagaaaaaggaaatgtaatggggctgaaggatgagggtaggtggggtggctgctcaggaggactgtggaggccacatcgcctaaccttcgaggcctctcttagcagctggagtgcatcccggggacttgggagctctggaaagaggagcaggaaagggccatggccggaggaggcctgaaaaagatcatctctgccacagagaagaagctggctcggatgctgctggcccctatggagacagggagacccggggagacaactgtattcattcaaggaggaatgggtggtgatgcaaacttgggtggaggccacagggtgcagaagacaggacacagcagagagagatgtaggacatggaagggacagaaaggagtgaccacaggacataaaggggcaaggaaagtggaagcatgataacatctgctgggcatccggctgaggggttgggtgcctagggtgcccttccctaagggagaaccccaggagcagattcagagaaaaccgcccagctcactccagcaagaatcagaaaaggaccggttaaaggagagggtaggaaggtcaccaagctccaagggccctcatgaatccggcttggaggccacagggcccagggcaaggacaaaccacaggcacaggacagctccggtcaagatcttctggctactgcaggaggcagaaaccacaccctgcaccctgcactgctgaggctggcgctggagtccagaagcttctacaccagaagcttcggtcccccatccctgctcaaaaaattaaaacaaaaacaataacaaatcggtgtcatgcaccctctgcttcctggtgctgttcgggaccctgagtctttcacgggagcacctgatggggaaagcctggacccgtgtcggtgtccctcctgcaaggagtgctgggaaaatgaactttccagcttcctccttgcgaaggcagaacattccccatgtgtactggtggcatttaaaaactgcagggcagccagagaacatggactgtgttccaccgggagagttcctggcgggatgtcccggtgcagaagcccgtcccaaggtgggtatttgagctgaggaactgagaagccggtttctgcctagagttagagatccgagaggcatcagcacatggaagggagggaatctacgatgcctcgagggtgggagatcagatgaaccaggagaggcagggcccgggaggaaccccggggagcagcctcctttaaagcctgggggaagtagcttcagagaaggtggggtaggttgggtgggggttgctggaaaaatataattaagaaacaaatttctgctcagcccagaaacccccctcacatccatagaagtaaaagaaacttgtcttatgattgagtaagcattaagccaaaatgtgatgcaatctgctaagagatgacaaagacagaaagaaatcccacctttgtatccagccaagcaggtgcaacccgttacacacatggtctccagatagatggtgactagttcccagttgagaggactcaacggcaccatttgtcacacgtagttcatcctaaattcacccagtaactgtgttgattctctgtgtggttaattggctttatccacaggaaaaagaaacctctcatctatgacaggaggtagttttgcaactgggagtgagatgcccccagaactgaggttccttccttctcacagaaactgggagacaggggtgctttctgcccggatgcctgcctttcaaagagaggtctcctatggccttgaggaggagaattctgggttgtgaggcaggcaagatacttatgtatgctttagaaagctttgcatacatcttcaagggatagagaaagagttttcaattacacctcttctaaaaaaaatgatctcaaagtccagcctaggcaacacagcaagatcctatctccacacacacaacaataataataaatttgctggacatggtggggtgtgcgtgtagtcccagctactcaggaggctaaggagggaggatcacctgagcccaggatgttaaggctgcagtaagcttagatggcagcactgcactccagcctgggtgacagagtgagactctgtcaatgaatgaatgaatgaataaatgaatgaatagaaaatgctctgagtgaaaagaggagagtctctttatctttttgcaacaggctaaacaaagtttttaaaaatgtatatttgcctcacagagattattccaggaaaagaagtggccctcagtgtcaaaggatgcaaaactaacctctgagttcctggcaggtttagcaataaaggaggatgttgctgatctcagtacaagcaatgttagagaaaggggaagatggaagtggacaaggacgagtgagtggaaggtgacaaatggaagcaaagaaacgtatccagaccattgaagatgcttgagcgagaagaaagaggcggtggagggaatggaagcccgaggaagtcatatgttgcaataaggggcctcagagcacgtgtagagtgtggagcagagcccttgcagaggggctgtggaaggctggcagggtgcaggtggccccactctccgtcaccctgaggagtgtgtggtcagagttaaagctcagtctgtttctgggatcaggtaagaggtgagcgtccggagaagacaggcggatcttcagatcctgcagacctccaccgtgccctctgtccctctcgactgctttttctccatctccattgtctggctcacattggtgtcactttttcatttctccctgcccgtcttttctcttttctcctctctttttcttaacccttgtacctttggaagtcccactaacagaatttaaacagcttttcaagttggttttttgttcccagaaattgattttagactctccatgaataatgtggaaatcaaatgagtataagctggttcatctctctgcaaataaacaaataaaatctacattccaatgtttcttcttccagagtagcccgcacttgattttttttttaattactgtcacttgcaatagatttttaattcctgtaacctggctacacaaataccatggggcaaaagccttacttcctgtgagaggaaaccaggcttgactagcctcatgctggctttgaagaagtaaaatcaggggttgatgaatttgcatagggtaaatatcaaaggtcaaaagtaaacaataggtggtagagggaataccccaaattataaaagaacaaactgtttaagccacaacagaattatcgtagaaataaaccacggtccttcctgctaaaatattccacttagaattgtaaaatattcttctcaataactcctggaagagcctactcataaattaatgaggctgggagcagtggctcacacctctaattccagcactttgggaggcctagacgggcagatcgcttgaggttaggagtttgagaccagcctggccaatatggtgaaaccccgtctctactaaaaatacaaaaattacccaggcatcgtggcaggcacctgtaatcccagctacttgggaggctgaggcaggagaatcgcttgaacccaggaggtggaggttgcagtgagccaagatggcaccactgcactccatcctggatgacagagtgaaactccatctcaaccaaaaaaaaaaaaaaaaagaaattaatgaatgtaagagcatctatgttccaaatgcagtgtattattttatgcaggctttcacaagctccaaaagattcaccgtgcagaactggacgttctagagaaagaccacgcctcctcctgcaggtaactcttcattcaggaagcagctcttggcttatccctgggcttagtggaattggaatacctgaccataggacaccaagggctttaggacctgagtggcacatcgtgtcctggtgacatctgagttacctggggcgtgcacagcagcctccagcatcccagggagagctgtgtatggggtcaggctcaagcaggtcccagggcaccagtgacccaatgggtgaatcagactcccgtggcacctgctccttctgtatctccctctgccatatatatgagctcatgggaagcactgtaacctcttacagaggaggaaagttcatggacttctagcttctagaactgtgatacaataaactcctgttgcttatct

SEQ ID NO: 2094 - DNA, 13260 bp, Homo sapiens; identical to SEQ ID NO: 2092

SEQ ID NO: 2095 - DNA, 18824 bp, Homo sapiens
taaacttgtgcaaataactttattaccataaacatatgaatattcatgaatagattcccaattctggggcactcagagagcaaaagcaaatgtttcaatttttgtttacaaaagtatactttaccaattgctgaagaaaaaaattcataaatctggaggataaaacattcaaaaaatcagcacattttccaataaaaaattatgaaaacattatccttttgttatttagtccaatgaaatggagttcttttcttctttgtcttgaatttcatgaaggtatcagcctgttcatcaaaattttgaaagttcttagtccagtggtatgatcttgaagttatcaggaacttgtattcaagagtccttttcatagtcttttccataaatctccttgaagaaaaagcaattttggactgtagctgattttaaatactttgaggaagaatcaaagcaactttctgggaatgacaaagatttaaaatgactatgtttaaaaatctaatgagaatttattatggtaaagacacagctcacatagaaatctagttacttctgtggcttatgacactatggtaacatatttgatttccagaaatttcatataatttttagaacactcatttttttaaattttttttgagatggagtctcactctgtcatccagactggagtgcagtggtgcaatctcagttcactgcaagctctgcctcccgggttcatgccattcttctgcctcagcctcctgagtagctgggactacaggtgcctgccaccacacccagctaattttgtttttgcgtttttggtagagatggggtttcactgtgttagccaggaaggtctggatctcctgaccttatgatccacccacctcagtctcccaaagtgctgggattacaggcatgagccatcgcacccagcctagaatactcatattattaacattcccataaatattatttagagaaggtttagcatcacttatcccttatttgaaaatgctttctatataatgtaatatataaaataaggtggcttttccattcagcttctgtttctcaagaggattactgagttcttggtgtagcccattcataaatagggccaaaaaggtatagtcttatgtatgttgaaaaagatccttaggtaattccagtacttctagctgaaaatcattcatttagttttaagttctacctattgcaacaagagttctccatccttgttacatgttagtagtgtcagggaagacttaaaaattaccaatgcctgggtccgtctccagacctttaaactggaactaatgggtggggcttgagcatcctcttttaaaaatgttttccagtgattccaatgtgtagctctatttcccatcagatttctctgatttcttgtggcattcaattttttctattttggtatcatgattattttcaggtctcatttcctgtcttaggctttgtgtctcctggggtggggcccttgccttcttcatttctgtatgttttttgaacacatgaactgatcatcaggaaaagatctcaaccacacataggttgtgtcctgagtctcaggttcacatgttaatcctaaagtctttgttctccacgaggtcagatgttgcttgtgatgaagggtgtggttaagtctgcagtgcagatggtggaagggatttcactctgtttttagacatagcattggaactaagaattttatgtctatatgggtgaaggggcagggatgtgtaggaagacagttctaattaggatggaggaattatactaggaagtagaggtaaaggaagtgagaaggcttagtaaatagaagaaatgtgaacttatcaaataggctagtgtatacccctggagattcttgattaagtgaattaactagattttagaaaggtaatgaggcagttatatgcaaggaacatttcaaagtctggagacaagaagtcaagcaatactttgagaagtggttgagctttatgggaatggagagaattacactattgagatatgttaaaaataatgaagaaggtttcaccatgtgaaattgtgtttctcatttgaatctgagaaacaaatgagcagaggctggagataattatgtctaaaagacagtggggtacagggagcataaaggccagggagaaagggaactgcaggaattagtgctgagaagcaggagttagtggatgaaggaggagatccaggcccagatacaggcaaataagtcatttccctctcccaagcatggcagtcagccctgcaggaaccaggataagagaaaaggtcatcatacctgccagtcttcctgaaatacaaaaatgacatcacggctgctacgttggattattgaaagcaaaagttcctaatcctggaggagctgtcatggaaagaaaagaaaagaaggaatgaaggtgatgttattttacatgggggagcgtcaggaacaagcatgtaacatgagatactgtataattgtttcttcaaggactacattatttctgttggaaaattgatgggagatgattatattcttgcagttttttttccctctcaccatgtttctcagttggtgatcagtcctctgtcaattctctactgcactcaggtattttggaaggctttcagacgtgagaaaggctgattgctattttctatgtcattggaacttgtcacctttgcaccttttcatggttgcatctttttctcagtgtctctgttgtggcagtcatgaatgagactctgtcagatctccatggcagggacctgattgacagaaggcccaggtcagtgcatttcaaattcaccacctcctttgcacagaaagcttctttcctacaggctcccaggaagggtgtgaaagcaagcctagttctctgaggctctctttaacgctaatgggtgactggttggaggattcctcatcagccttgcaaaaactcttagaattgcattggtacctaaaacttctttctctttctttttcacaggaatcagctctgcatagtggtctgtgggttctcctgtactaccttcatgcctgccccacattccctcacaggtgtcttccgtgataaattatcgtttaggtctaatcccgtcttggatgcatctcagttggtaaaaactaacataccaggcttgattctttgcagttagctctttatctttctctcccacaagtagtcagtagccttgttctagtgttttatgtgttacctctttttccatatatatatatatatatatatatggaaaaaggaaggtactgttgaggggcacttcctatgtgccaggccctgtgctaaatactttacctgtatctcatttaatccacacaataaccctgtgaggtagacattatttccattttgccaatgaaaagacagaagcttagcgtgctgtaaaaactttcctggtgtcatatggctagtgacaggtggatctgagatttgattctaggactatttgacctcaaggttaatgatgatgatagtaatatagtagctgacattggttcctctgtatgtggcatcttgtttcattgactgcatgaaacctttaaaagaatggtacgaagaaaacactctcattgcaattttcaggtgaggaatcagaggttcagagaagttgagtcttgtgcaagaaatttataactgtaaactcttacattaaaaaagaagaaagatctcaggtcaacaacctactttaacacttcaggatatgaaagaagaacaaactaaacccaagcacagtgaatgagggaaataataaggattagagttgatataaataaaatggagaatggaaaaagaatagagaaattaatgaaaccaaaagttgattcttcaaaataaaatcaacaaaattgacaaccattaactagattgactaagaaaaaaagagaaaagtttaaaattactcaaatcagaaatgaaaatggactctgagcatggtgggtcatgttttaatcctagcactttgggaggtcacagcagaaggatttcttgagaccaggtgttttgaccagcataggtaacctggggagatactgtctctacaaaaaaattaaaaagccaactagctgcgcatggtgacatgcacctgtagtcctagcatcttgggaggctgaagaaggagaattgcttgagcccaggaggttgaggctgcagtgagccataatcacaccactgtattccatcctgggctggcctacagagtgagagtctgtctctctctcttaaaaaaaaaaaaagaaagaaaaatgaagcgattactaccaattataataaaataatgattatgaaagtactataaataattgtatgccaataaattggataacctagatgaaatagacaaactcctagaaacacacaaaaatatgaataaaactataatcagtaacaagattcaatccataaaagcatttgatgaaattcaatattttttcataagaaaaacattctaagaatggaaggaaaccacctcaacataaaggcaatatgtgaaaaacccaatgctaacatcatactcaatggagaaagactgaaagcttcccctctatgagcaggaacaagacaaggatgcctgcttttgacacttttattcaacatagtattgaaaggtctagtcaaaaaaattaggcaagaattttaaaaaagacattcaaattggaaggaaggagtaaaattatttctgtttacagataacttgaacttatatgtagaaaatcctaaaggtggaacaaacttattagaattaataaataaattcagtaatgttgcacaatacaaaatcaacattcaaacatcagttgtatttcaatacactaaccatgaacaatctgaagggaagttaagaaaaataatttcaatttatattaacctcaaaaagaataaaatatttaagaataaccaaagaggtgaaatgattatacctgaaatctgcaaaatattgctgaaagaaatgaaagacaatatcaataaatggaaagacattttgttttcatgaattggaagactcaatattgttaggaggacagtgctacccaaagtgagctgtggattcaatgcaattccttcagaatctcagtgacatttttgcagaaaaagaaaaatctgtcctaaaatttatattgaatctcatgactctaaatagacacacagctttgaagaggaagaatgaagctggaggactcagacttcctgatttcagcatttactacaaagccccagtaatcaatacagtgtggtactggcataaaggaggacatagaaattaatgaaatatcatagcccagaaagaaatgcttgcatatatggccaaatgattttcatcgagtgtgccaagatcattcaatggggaagggacagtgttctcaccaaatggtattgggaaagctggatatccaagggcaagaagagtggaacctttacctaacaccatgtacaaaaattaacccacaataaatcatagatctaaatgtgagagcaaaaactatacaactcttagaagaaaagcttcatgatactggatttcacaataattccttggttgtaacaacaaaagcataggcaacaaataaaatcaataaatcggacttcacaaaaatcaaaaccttttatatatcaaagaacattatcaagaaagtaaaaaggcaacccatgaaatgataaaaatatttgcaaattatatgtgtgataagaaattaatttccagaatacatgaaaagctacaagtcaacaacagcagacatccaaaaacccaattaaaaaatgaacaaaggattaaaatggagttttatccaaggaaggaacacaaatatccaataagcccatgcaaagttcctcagcatcatgaatacttagagatatacaaatcaaaaccacaatgttacaccacctcacaaaatttaggatggttttgataaacaataacaatgacagcaacacaaaacaacaggtgttttcaagtagatggaaaaattggagctctagtgcattgctgatgggaatgggaaatgttacagccactgtaaaaattggtgtgctgtttctcaaaaaattaaacaatgaattaccatttgatccagcaattccacttctggacatactccccatagaattgaaagaaatttgaacaaatatttgtacactgatgtttagagaagcattactcacactagccaaaaaatggaaacaactgaaaagtccattgaaagataagtgtgtaggcaaaggaggtgtatctatacattgaaatgttattcaaacttaacaaggaataaaattccaatatatcgtgcaaaatggatgaaccttgaagatattatgctaactgaaataagccagacacaaaaggtaattattatataattccatttataaaagatagagtagccagttacatagagacagaaagtagaatggtgggtgctaagtgttagggggagaaggagtgagagttactgtttattgggtacagaggtttaatatggtaagaggaaaaagttctggaaatggatagtgtgatggttacataacactaaattgcacacttagaaacagttaatggtaagccttatattagatatatatagtgtctggtagtcttaccctctctataattacacactttttggcactgcccctttcctgccatgcagagccccaggggtgaatcttcctatttctccagctctgcatcagtcactgtactcagtgctgtgtcccacgtgctgtgcccacagcctcatacagccagtgacttcagagccaggacgcagctcaggagtctgccctgaggttgcttctcttcttatttccttgcagcctggcccgggggaggcttggcttgaactggcagctcaatttagccaaattcaggacaggccaccaggactctttctccacacatgctggtcccaccccaggttgagtgaggcagggccagtcaccagaggagcccggagcagagcaggaagcagagtctgagctgctcctccctcacccaaggggcttcctcctctcatttgggggaaaagtgtgagcttgtttcaaagcctcagatgttccttgtagttcatggaagaggtacaagaaaacaaagacgtgacagaaggggatgagttggtgacagtgagaagcaactcgatgttcagcactctccttcttgtccctctgtgaagcctcttctaccacatagggctcagggctgataaagccccctccctacctttctcaggccagacacaaggtcagtcatgagaaaacagaaaaaaaaggagaagagagtctgtagagacaaattgggagggttcaggaggagaatttgggatttgcctgtgcccatgggacacaggctgggaataaaaatgttttcctgactcttctctgaaagctagatagactccacctaaaaccctattgccaaggatgctgggatccacttaccaatgactctgattgtcaaggatgtggagctttcctcgccagtggctgagttacgagcagagcaagcatagagcccattatgctttggagtaatctgagggataaagagcttttgtcctgatagctgaaacttcccattaattgtccaagaatactgtgctggtgggttagagtttgcgaagcaggacaagtcgaggttctctcctgaatagtaagaggtgactgaagggaaaattctggggaggtctggaccatctggaggaaagagaataaagccacagttgatgtcatctgagggaaggggaagctccttgtctcttaaagggacacagtgaccctctgagccaagacacaccctcaagtcccagccaaaccccctctatgttcactgagctgaagcctgaagtattcacctgtttctcccaccacaagctgtgggccccaagtctcccatgacaagagcatcccctctccttatattcttggttaaggctgtgtctacccaagttttcccagggcagggagtcatggccacctcggatgtccaaaagtaaaggtgtctgtacttggaccggagagagactgagaggcctggcccctggtcgtttggatttaagctggtgtcctggcccacagaggaacaaaagatacagaggacattcagggtgactgagtcactgcggatgccaccatatcggtcccgtatttcacattgatagggtcctgtttcatttctcgtgacactgggtagaatgaggatcctgttttcaatgggtcgctttaccctgggactgaccgggaggctctgacaatttagccaccaaatgtaggcatagttctcactcttaggttcacaggtgaaggttaagacatccttattctccctggggtttaagttgttgatggtgatgtagggcatgggcagctttgctgtgtggataacagagagaagattgtcctgtgtggcacctttgattcctccacaggcatccttcaatcagagttggcatctcccacctctcagcccacccgagtccttgaaagccaatagctggtgcgtgtgtcacaagacagatgcatgatgatctaagggctcaaagactgtgaggccgcctgcttcatcttaggaaagcacagactttctgaagtgtcaattgagcagcagtgttgggtcatggacagatacgtcagtgggagtcacagcccctggtacccctcccagtccctccataatcagttgactggctggctcaccttgggttccttacctggaatgtgcaactgctgggccccttccaaattccatcctactttgcccccctagatgtgatttctctgcagcttccatttccaaggacattctagagatcagtaataatgggacttcccattgtcctgaaaccctgaagatactgagcagcctggcctgggactggatgtttcagcagaaataacacaggggagaccagagtcaagcctggaggtcagttcagtcatcaggcagtggaggcagaaagtggggcagtgttttgcaggtgtttcatgatgacttacttgaaccagtgacctctaaagatagagcagagcgcaaggaatgatctaggaagagtgaaggggataggcaagagctggtggctttggagcagaaccatgttccctgtcctgggtcctttaagtttcctttccttctgcagagggcaggtgaggaccatgtggatctttccagaaatacatgtggacatttgcaaatgcagaactgactggtggaaagggtgggaatgaactgctggaaatctggtcctcatggaccatatgtgtttgatggatatgagacaaatttggagaaaagttttgcaagtagtttctttcattggatattctactctctgatcccctgggttcgactactctagggacctcatgtaaatggattccagagtgaatatgagaagagactgctggttgccaggagctgggagtggggagaatcagaagttgttcatgggtgtgcagtttccgttatacaagttggggagtttctagagatctgctgtagagcttgatgcgtattgttcacacagattatttcttatgcataagacttaggacaaaaagtgttttggatttctgacattttttgattctgaaatatttgtcatatacttactggtttagcatcccaaatctgaaagattcaaaatctaaaatgcttcagtgagaatttcttttcagcatcagattagtagacaaaagtgggaagtgataagccaaatatattcttgcccttttttttctctcaccacatttctagcttggtgattagttttcggtgaattccatactggccatgctgcactcatatatatttgaaggctttgggatgtgagaaaggctgattgctattttctatgtcatcaaaactttccaccttttcatggttgcatctttttcacagtgtttctgttgtggcagtcattaataagtgcctgtcaggtcagatttaggacagagttttctaattctgcaaaaaatgttactgggattctagtaggggttgcattgaatctgcaactcactttgggtagtattgtctttctaacaatattgattcttccagtccatgaaaatgaagtgtctttccatataatgatattgtctttaatttctttcagcaatgttttgtagttttcaaggtataatcatttgacctttttggttaaacttattccaaaatattttattccttttcatgttaatgtgaattgaaattctttccttaatttcctttcagattgttcattgttagtgtatagtctaaagaatgatctagaaagagtgaaggggacaggcaaatgctggtggttttggagcagaaacatattccctgtcctgggtttttgattttccctctccctttgcagagggcaggtggctcttccctgatagctagatagacttccctggaaaacatagtgccaatgctccagggatccacttaccagggactatgatcctcttgattatgagatttgttccaccagtggctgagttatggatgaaacagacatagacccctctatatgttttagtgatttggggtatgaagaacacttgtgctgattgctggaacttcccaccaatcagccaagaatgctctgccagtgggtgagtgtctatgagacaggagagcttggggacttcccctgtatggtaataggtgtatgaggaagaaatggtgagggcatccaggccatctggagcaaagagaataaagtcacaggtgacattgtcagagggaagggaaaatcctggtctgtggaagggccacagtgaccctgtgagccaagtcgcaagactgaagtcccagccaaatcctcgctgtgttcactgatctggagcctgagacattcacctgtttctcccatcacaatctgtggaccctgagcctcccatgacaggagcagcctcttttctcccactgtggatcaagcctaggcctactgtggtttgtctggggcagaaagtcatggccagctttgatgtccagtggtaaaggtctctgtacttggacctgagagggactgagaggcctggcctctggccatgtgtatttgggatggcagcctggctcacagaggaacagaagatactcacggaggagattcagggtgactgggtcactgcggctggcactccctgagttccatatttcacattcatagggtcctgcagtatactttgtgacaccaaatagaaagagggtcctgttggtttcagacagctgcatcctatgagtcatagggaggctctgaccattcatccaccacaggtagcttgcgtccggagtctcaggattacaggttaagatcacagtctccatggcctccctggggtttaagttgctgctggagatggagggcttgggagtctccactgtgcagaaaacagagagaagattgccctgtgtggcacctttgattcctccaaaggcatttttcaatcagaattggcatttgccacctctcagcccacccgagtccctaaaagcccatggcaggtgtgtgtgttacaacacagatgcatggcattctgaaggctaagagattgtgaggctgcctgctttatgtgggagaagcacagactttctcaggtgtgaattgagcagcagcattgggtcatggaaagacacaggaccagcagtcatagcccctggtgcctctctgagtccctccatctccaactgcctgcctggcccaccttttggtcctgacttggagcatgcagtgctggaatcttcttagtttcagtcttacttttccccccaaggtatgttttctctgcagcttcccttgccaaggacatcctagagatggatgatggaacttcccattgtccttaaaccctttgggtactggaaagcctggcctgggactgggtacttcagcagaaataacacaggggagaccagagtcaagcctggaggtcagttcagtcatcaggcagtgcagccacaaggtggggcagttttcccaggtgtctcatagtgactgacttgagccagtgacctctaaagatagagcagagtccaaggaatgacctacaaagagtgaaggggacaggcaagagctgatagctttgaaccaagaccatgttccctgttgtgggtctatgatgctcccttcccccagtagagggcaggtgaggaccatgtggatctttctggaaatacatgtggatgtttgcaaatgcagaactgactggtggaaagggcaaacatgaactgatgatggaagtctggccctcatggaccatatgtgtttggtagatattagaccaatatttgggaagaagtcttgcagatactttctctcattagacattctaccctctgattctgagtttgactactctatgtacctgatatcagtggattccagagtgaatcagagtgtagaatagtagtttccaggagctgggatcaggggaattgggtgttgttccgtgggtgtgcggtttcagttatgcaggacgaggaggttctagagatctcctgtacagattcatgcctatagttcatacagataaagtgcttcttatgcagaaaggttaaaacaaagtgttttggaattctaattttttttattttggaatatttgcagtacatgtactggtttagcatcccaaatctgaaaaatttaaaatccacaatgcgccagtgagcacttctttttagcatcacatcagtggtcagaagtgtaaagttttggagcatttcagattgtggatttctggatttgggatgctccatatttaatactgtaattatcccataaaaagttgtcaggagattagacctcatgttgtgttctgactctagtaacaaaaaaaaaatttggaggaaacattaaaatgttttcataagtggaaatttttactgatggtctaaacatctaagatcaattgctggtagtagtatttctcttgagaccaacataaggtttaggtgtgccatgaattccagcaggatcacattatgctcaaagaaagatgccaaaggtgatttgaaattagcagctccttaagtagagagagtcccgttaaaaggacagaactggtcagtgcatcaattacataaaaggaggaaggatgccaaattaaaagaagtgatgtgtgttatgttagtaaatatagaaagaacttcctgcttctaatttctgtgcagttaggaaaaatggggaggaccccaaaacaggtatgtgaaatgctttcttcattttctgttaagctcaggaaacaccactagagtttaagtttgtgtgaattagaaggagtctaagtgagatgccaatggctcatgtgtctccccacacgaagaactccaacttatgaaaacggcatcatcatgaggaaacagttgtatgtggcacaggcagtaaaaccatcagatagcacccacctggccacctccaactagtccccaaaaccaccagtattcctcttaagtatgtgttacagcctttgtagttgtcccacagctacaaaattttaaaaatgctattgtcaaaacaaaatattaaatatgaagttgaatatgttgatccactttttttccctactctttttggactttcctgtttcagttttggaaatttctattgacacatcctcaagctagggattccttcctcagctgtgtgcagtctaccagtaagcatcaaaagaattcttcatttctcttacagcatttttattttttctgagagagactcttgctctgccaggctggagtgcagtggcatgatctcagctcactgcaagctccacctcccgggttcacaccattctcctgcctcgacctcccaagtagctggtactacaggtgcccaccaccatgcccagctaattttttgtatttttagcacagatgggctttaaccatgttagccaggatggtctccatctcctgaccttgtgcctgccccagtctcccaaagtgctgcgattataggcatcagccactgtgcccagccatctcaaagggattttaatgagttgttgacttttgagtttgttcagctttttacttagtgttagaaccgagtgacaaatttcaagcttgtcatatgcctgacacgaagccagaagtctctaggaagtgatcagagaatgtaagctccatagcacgttgacgatggagtcatgagtgaaacaggtgaaatgagctcatgggctttggagactgcaggcctgtccagcctctgacaccctggtgagtcagtgcagagattacaacagtgacagcaaactagcatggctgactccatctggcatctagtctcaggctggctgtcctcactcattcctgcacatagacaaggctaaccttgggagaaatttagtttatggtttaactttgaagcaagaatgataatagttcctccataaaactaacacccttactttgcccagggactgcctttgtcaaactagtgaaagaccatgagatttagattataagagggaactgaattctgctaaaatgtatgcacagtttctataatccctgactgctgcaatgtcatttggcaagggtttacaaaatttgtaactaattgctcctatagataacatcactattgtagaacgtgagattggtcttttgagatgcttctcattcttttgcattctggcaaccagctgacctcatccatacctatgactaatggctcagcccgtcatgtggtccctacctagaggcagattcaagcacaaacagatcatttccctccgcccgcatgattccatcaccaacaatcagcagtactcattttttagtcctgtgcccctgaaactatccttgaaaatctctaagccctgatccactggggaggctgatttcagtaataataaacctctgtcctcctgtttggcagacttggagtcattaaaatctttctttactaaaaatcaccatttcaataaatttgtgtgtttgtgtgtgtgtgtgcaggaggccagaagaacttgtctgacaatgataagagtggttggagggacttcctatccctgtcccatggtcttgtccacaggtcagcctcacaaaggggaagagcccttgatgggaatacagtggaagctcattctcttagtgacctggggacattggctcgagatgaagcctggcaggagtggcaactccaggtgatttctgcacctttcctatttcctgggaggtgggccaggccacagtgttagcgggaagggaatagaacagccagcctagttagagggagtgtctggggaaggcctaggggtgggggaagaagctgtgcaggacagggcttgccagtcagaatgaagtgggaggaagatgagggacacagagaagcagagagaggcagagacaccatggcagtgagcagtgagggagacactgacttcagagcccccaggaaccagctgcccccagttccacagtccaggaccaaggagccccgagaaccctctggtggccaaagagcttcagagttacatgaggtggggtggctttaggggcaagaggtagtggggggatgaaacatgggtgtcagcctctgaaggacaagggacaggtgtggctagaacctcctaggattctgcattcaagatccagtctctaaagaggttttggatcattcatttcttcattccattccttcatttgttatgtgagagctcctgagtgtgtgtctctcgctgggcctgtgctggtgtagggagtgagtggggaaagaaaacaaggtcctctccttgatcctctcatgacagtgacatggacactttgggaaacacagagtttcaggttcagtgatgggggttaagatctgagggggaggcctggacattttttttgcactgactttgatggttgaagcaggtgatttagttctggagtatagactaatcagctgaccatttgctctcactcctctgaggtttggatgcctaagaagagaggatttgagccaataaatgactatggggtgcttggaacccagtaagccctcacttctggtggaggagaggatgggcctgtggctgcagacagacctcatgtgaccctgatctcccctttgcgtttgtgtgactctgattcagtgactgtgccttcctgtgcctcagttttctctcaatcagataagttaaatggcaaatggactgtggcttttcatgctatctgtgaataaatgttaaattattcacagtcacctgacctaatgcttggcacagtggaggtgttcacacaagcagcatttattattaatttgcttccatgagaaagcacctttacgtcagatccctgtggacaagctgctaccaggtacatcttctctcttctgtttctgcttctgaggacattagactttctatggactgtcctaagcctcctaaggcagttggctgatgacctacaaagcttgtctttctgtcctctccactctgagtgtcaggtgaagaaagctctgtccttgcccagatgaggctctgagggctgagccctggctggtgaacagctccaggagacacagtcctcagacagctggtaaattcttggtcccagtaagccctgcccaagaagccacaacccagccctggaacaggctcctcagctttatctggaacaaggatttaggtacagagttctgggtttgaggcttctagggctgagcttctctgagagtatctcaggggcccctcaggtcaaattctactcagttctccagggtctttctcagggtcaaatttatgaagagggcatgaggtgcttggctgagactgatctcctcctgctgagtccccccatcagactgtccttcctctgcagcgagtgtctgcagggtctggatgcgggaaaggaattctgatctgttgaaatttgtctcctctgtgtgtgtcctgcactaaatgcccaaaccccagcatgggacataatgcagagagggacacaggcaatgtccaggcctgacaatcctgtgtgtgtgatgtagaagtgacccctgtcccccaacacccagggatcatgtggaatcacttacggtataaggtgaaggtgaaatatccagttactcctctagtcccatcacctcgctttatgatgtgtaaggtgtaggatcctgcgtcctcccgggtgacattctggatcagcagggatgcattggaatatactgtttctcgtccactgtatgccggtccatatataattatttgaccgtctactacatatgatgtaatgtaatggtagaggtccctgatttgccctttgtaccagatgtagccagtaagattctggggcaaattgtggacaagtagaagaacatccttcccctcggacactttgggtggctgggcttcaatcatgacttgggcagtggtaggcaagttccagaagtttaaaagtaatgctaggaggtggagagagcatcagtcaatattgagacctatgtattggggtgaaaagatggggccctgagtcctgagaaggtctcttcaatcctcagccttgaagacacacacacacacacacacacacatacaaacatacacacacagaaaaggggcatgtgtgtttgtgtatgtgtatgtgtgtgtgttctactgtcctactaggtcaaggtcagcagcatgacccccattccttcaacacttctgaccttggcatttttctgtttggaatcctcttccccaggggtccgcatggccccctccacactgccctcaggtcctgctcacatcagggcatccttagacttctttcctgacacctccttcagggactctgggtcttccctttctgacctttccctgctctgctccctccagggttcttgtcaacacctgacctcacattctagatctctttgcatgtctgacttcctccccatggcagcatgagctccgtgaggacagggacttttgtgatcttggttgcaccccagtgcctggaacaggctgcagactcctgtagatgtgagagttctcagggccgtccacgccctgggtgtttttttttttttccccaattgttgaggttttttattgaggacagtgtttcatgccctgtttatttttatttgtagtgtcatctgatatagttattattatcatttttcaaaatgtggtggcccctgatgattaatcaggaaaacagaacacctgtttcctacctcttaccaattccggttcaatgtgactttcctgttttgacccctgtccctcttgggtgtattttcccctatccaggcatcaacagggccttctttcctttttttttttttttttctctttttttttttttttttttttttgagatggagtctcgtactgtcacccagcctggcgtgcagtggcactatctcagctcactgcaacttccgccaccctggttcacgtgattctcctgccttggcctcctgagtagctaggattacaggagcacaccaccatacctggttaattttttgtacttttagaagagacagggcttcactctgttggctggactgatcttgaactcctgatctcgtgatccacccacctcagcctccctaaatgctggcttttttattttttagaaccccaggagcctctccaggagaccccatccagtcactctgcttcctcctcctgtcctctcccaggaagttctctcctcacctgtgagcaggagccccttccatttgatgtgctctgtgcagggaggggctgagaggggccccatgatctctgctgcgtgcatgttctcctctgtggagatgagcctaggatccagaagcttccagagcacggctgtcagctgtgctgtccttcctccttctgcgctgagac

SEQ ID NO: 2096 - DNA, 13048 bp, Homo sapiens
attagcaaatgtagtacatgttttattctgctagaatcagtcttactgtcacgttttacaatgtatctcttaggaaatggtgagagccatccacacaatgtgcatttaaaggggagtctactataatttcagctttcctactctttatagaaaccatcttctctgcaaacacacaggcaatatctctgtgttcatttctattgggagccctgtatgcaagatggagagagccacatttcctcctgagatgttatgtaaaagtctgaggttgagatgacatatctgacactctgttgttaccctcagaagctcctatactacatgtgaaattctaatgactgcattatcctgccaagtgaaagaggcaggcacaagcaaggacagctaagaggggtgagagcctcatcatgatggggagtcttattctgacatcttgggaaaagctgtccacagtgtgaagtcatcaacttgttttccttgtttacagtttgagcagctgttgttatggtgttgaacattttggtgagttctgagtggctcagacatcaggtacaaggattttcccatgaaatttacattgagttgtccaactctgacttatagggcttctggaacagagtgggtcttgctctttgaggttccatgggagaagatggaattggaggaactagtagaattcagggtaatgtccagtctacagtggataataaaaacacagaaacaatgaacagagctgcaatctcataacaggtgtactacggttttattttccacataatttttctctctatgggcatctctagttttaccaatgataatttcagtagaataagtttgtttgcaaaataggttgagtttcttcaaacttggtctgattgtttacataagtgcagcaagagtagcaatggactatgtaggctctcttttaaaattttctttgctgtaagtttttataaggaatctcagattaaacctttacaaaactcttgagaataggaagccaaaccaaggctgacttcagagtttgcctgcagttcatactggttcattctagctatattcttaaatataacatcccagtcaaagccttggtaatataaccaatgatttgaaatgtgtcctgttacaaagagagcaggttgttactctgtttgtgcaaatatctgtattaccataaacatatcaatactcatgaatagttgcccaattctggggcattcaggtagagagcaaaagtaaatatttcaattatcattcccagaagtatagtttattgaaccactataagctagagatagattaaaagacaaatttccataaatctagaaaactatccacataaagaatcagcatattttcaaataaaaatcataaaaacattatcctcattattatcaattatttcaatgaaatcaatgtttttcctgcttggtctaggctgggaatgttatgaagatatcagcctgtttgttaaagttttcgaagttcttagacaaatttggagggttcaggaggaaaatttgggatttgcttgtgcccatgggacacaggctgggaatacaaatgttttcctgacttttctctgaaagtcagatagactgcacctaaaaccctattgccaaggatgctgggatccacttaccagagactctgactgtcacggatttggagctttccttgccagtggctgagttacgaacagagcaagcatagagcccgctatgctttgtagtaatctgggggatagaaagcttttgtcctgatagctgaaacttcccattaattgtccaagaatactgtgccggtgggttagagtccgcaaagcaggacaagtagaggttttgtcctgaatggtaataggtgaatgaagggtaaattctggggaggtctggaccatctggaggaaagagaataaagccacaggtgatgttatccgagggaaggggatgctcctggtctcttaaagggacagagtgaccctctgagccgagacacaccctcaagtgacagccaaatcccctctatgttcactgagccgaagcctgaggtattcacctgtttctcccatcacaagctgtgggccccaagtctcccatgacaagagcgtccactccccttatattcttggttaaggctgtgcctacccaggttttcccagggcagggagtcatggccagctcggatgtccagaagtaaatatgtctatacttggaccggagagagactgagaggactggcctctggtcgtttggagttaagctggtgtcctggcccacagaggaagaaaggatactcaaggatactcacagaggacattcagggtgactgggtcactgcggatgccaccatatcggtcccgtatttcacattgatagggtcctgtttcatttctcgtgacactgggtagaatgaggatcctgttttcaatgcgtcgctttaccctgggactgaccgggaggctctgaccatttagccaccaaatgtaggtgtagttctcactcttaggttcacaggtgaaggttgagacatccttattctccctggggtttaagttattgatggtgatgtagggcttgggcagcttcgctgtgtgaataacagagagaagattgtcctgtgtggcacctttgattcctccacaggcatccttcaattagagttggcatctcccacctgtcaacacgtgtgagtccttgaaagccaatagctggtgtgtgtgtcacaaggtagatgcatgatgatctaagggctcaaagactgtgaggccacctgctcagtcttagggaagcatagactttctcaagtgtcaattgagcagcagtgctgggtcatggacagacatgtcagtgggagtcacagcgcctggtacccctcccagtccctcactaatgagttgactggctggctcaccctgggttcattacctggaatgtgcaactgctgggccctttccaaattgcatcctactttgcccccctagatgtgatttctctgcaacttccatttccaaggacattctagagatgagtaataatgggacttcccattgtcctgaaaccctgcagatactgagcagcctggcctgggactggatgtttcagcagaaataacacaggggagaccatagtcaagcctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggggacaagcaagagctggtggttttggagcagaagcatgttccctgtcctgggttctttaagtttcctctccttctgcagagggcaggtgaggaccatgtggatctttccagaaatacatgtggacatttgcaaatgcagaactgactggtggaaagtgtgggaatgaactgctggaaatctggtcctcatggaccatgtgtgtttgatggatataagacaaatttggagagaagttttgcaaatattttctttcactggacattctactctctgattccttggggttgactactctagggacctcatgtaagtggattccagagtgaatatgagaagagactgctggttgccaggagctgggagtggggagaatcagaagttgttcatgggtgggcagtttcttttatgcaagatggggagtttctagagatctgctgtagagcttgatgcctatagttcacaaagatggagtatttcttatgcctacaacttaggacaaaaagtgttttgcatttctttcattttttgattctgaaatatttgtcatatacttactggttaagcatcccaaatctgatagattcaaagtctaagatgcttcagtgagcatttcttttcagcatcagattagtaggcataagtgggaggtgataagccaaagatattcttgcccttttttttctctcaccacgtttctagcttggtgattagttttcggtgaattccatactggccatgctgcacttgtatatttttgaatgccttggcatgtgagaaaggctgattgctattttctatgtcatgagaactttccaccttttcatggttgcatctttttctcagtgtttttgttgtggcagtcattaagaagagcctgtcagctcagatttaggacagagttttctaattctgcaaaaaatgttactgggatgctggtaggggttgcattgaatctgcaactcactttgcgtagtattttctttctaacaatattgattcttccaatccatgaaaatgaaatgtgtttccatatattgatatcatctttaatttgtttcaggaaggtttgtagttttcagggtataatcatttgacctttttggttaaacttattccaaaatattttattccttttgatgttaatgtgaattgaaattattttcttaatttcttttcagattgttcattgttagtgtatagtctgaagaatgatctagaaagagtgaagggtacaggcaaaacctggtggttttggagcagaaatatattccctttcctgagttttgattttccctctccctctgcagagggcaggtggctcttccctgatagccagatagacttccctggaaaacatattgccaatgctccagggatccacttaccagggactatgatcctcttgattatgagatttgttccaccagtggctgagttatggatgaaagagacatagacccctctatatgttttagtgaattggggtataaagaacacttgtactgattgctggaacttcccatcaatcagccaagaatgctcggccagtggatgagaatctgtgaggcaggggagcttggggacttctcttgtatggtaataggtgtatgaggaaaaaatggtgggggcatccaggccatgtggagcaaagagaataatgtcacaggtgatattgtcagagggaaggtaaaatcctggtctgtggaagggccacagtgaccctgtgagtcaagtcgcaacactgaagtcccagccaaatccccgctgtgttcatgatctggagcctgagacattcacctgtttcttccatcacaagctgtggaccctgagtctcccatgacaggagcagcctcttttctcttattgtggatcaagcctaggcctactctggtttgcctggggcaggaagtcaccaccagctttgatgtccaggggtaaaggtctacatacttggacctgagagggactgagaagcccggcctctggccatgtgtatttgggatggcagcctggctaacagaggaacagaagatactcacggaggagattcagggtgactgggtcactgcggctggcactcactgggttccgtatttcacattcatagggtcctgcagtatagtttgtgacaccaaataggtagagggtcctgttggtttcagacagctgcaagctgtgagtcatagggaggctctgaccattcatccaccacaggtagcttgcatctggagtctcaggatcacaggttaaaatcacagcctccgtggcctccctggggttgaaattgctgctggagatggagggtttgggagtctccactgtgcggaaaacagagagaagattgccctgtgtggcacctttgactcctccaaaggcatttttcaatcagagttggcatttccaacctctcagcccacccaagtccttaaaagcccatggcaggtgtgtgtgttacaagacagatgcatggcaatctgagggctcagagattgtgaggctgcctgctttatgtgggagaagcatggactttctcaagtgtgaattgagcagcagcattgggtcatggaaagacacaggaccagcagtcacagcttctggtgcctctctgagtccctccatctccaactgcctgcctggcccaccttgtggtcctcacttggagcattcagtgctggaatcttcttagtttcaatcttactttgccccctgtggtatgttttctcttcagcttccctttccaaggacatcctagagatggatgatggaacttcccattgtccttaaaccctttgggtactggaaagcctggcctgggactgggtacttcagcagaaataacacaggggagaccagagtcaagcctggaggtcagttcagtcatcaggcagtgcagccacaaggtggcgcagttttcccaggtgtctcatagtgactgacttgagccagtgacctctaaagatagagcagagtccaaggaatgacctacaaagagtgaaggggacaggcaagagctgataggtttggcccaagaccatgttccctgttctgggtccatgatgctccctttcccctgtagagggcaggtgaggaccatgtggatctttctagaaatacatgttgatgtttgcaaatacagaactgactggtggaaagggtgaacatgaactgatgatggaagtctggtcctcatggaccatatgtgtttggtggatattagaccaatatttgggaagaagtcttgcagatactttctctcattagacattctaccctctgattctgagtttgactactctatgtacctcatatcagtggattccagagtgaatcagagagtagaatagtagtttccaggagctgggattaggggaatagggcactgttccgtgggtgtgtggtttcagttatgcaggatgagggggttctagagatctcctgtacagcctcatgcctatagttcatacagataaagtgctccttatgcagaaaggttaaaacaaagtgttttcaatttctaatttttttattttggaatatttgcagtacatgtactggtttagcatcccaaatctgaaaaatttaaaatccacaatgcgccagtgagcacttctttttagcatcacatcagtggtcagaagggttgagttttgagcatttcagattgtggatttctggatttgggatgctcaattcgtaatactgtaattttcccataaaatgttgtcaggagtttagacctcaggttatgttctgactctaataacaaaagaaaaatttggaggaaacattaaaatgttttcattagtggaaatttttactgatggtccaaacatctaagatcaattgctggtagtagtatttctcttgagacgaaaatgaggtttaggtgtgccgtgaattccagcaggatcacattatgctcaaagaaagatgccaaaggtgatttgaattagcagctccttaagtagagagagtcccgttaaaaggacagaactggtcagtgcatcaattacataaagagaggaaggatgccaaattaaaagaagtgatgagtgttatgttagtaaatatagaaagaactgcctgcttataatttctgggcagagttaggaaaaatgcggaggaccccaaaacaggtatgtgaaatgctttcttcattttctcttaagctcaggaaacaccactagagtttaagtttgtgtgaattagtaagaggctaagtgagatggcaatggctcgtgtgtctccccacacgaagaactccaacttatgaaaacggcatcatcatgaggaaacagttgtatgtggcacaggcagtaaaaccatgagatagcacctacctggccacctcgatctggtccccaaaccacctgtattcccattaagggtatgttacagcctttgtagttgtcccacaactacaaaatttaaaaattgctattgtcaaaacaaaatactaaatatgaagttgaaatgttgttccactttttttcccccactctttttgaactttcctgtttcagttttggaagtttctattgacacattctcaagctaggtattctttccacagctgtgtgcagtctaccagtaagcatcaaaagcattcttcatttctcaaacagcattttttttttctgagacagagtctctctttgtcacccaggctggagtgcagtggcatgatctcagctcactgcaagctccgcctcccggtttcactccattctcctgcctcagcctcccgagtagctgggactacaggtgcccaccaccacgtcccactaattttttgtatttttagtagagacggggtttcaccatgttagccaggatggtctgtatctcctgaccttgtgcctgcctcggcctcccaaagtcctgggagtataggtgtgagccactgtgcccagccatctctgagggattttaacgagttgttgacttttgagtttgttcagcgttttacttagtgttagaaccgagtgacaaattccaagcttgttatatgcctgacagaaagccagaagtctctaggaagtgacaaaagaatgtgagctccatagcaggttgagaatggagtcacgagtgaaatgggtgaaatgagcccatgggctttgggaactgcaggcccttccagcctctgacaccctgatgagtccgtgcaaagattacaacagtgacagcaaactagcgtggctgactccatctggcatctagtctcaggctggctgtcctcactcattcctggacataggccaggctatccttgggaagaatttggtttatggtttaactttgaagcaagaatgatgatagttcctccataaaactaacacccttactttgcccagggactgccttggtaaaactagtgaaagaccatgagatttagattataagagggaactgaattctgctaaaatgttggcacagtttctataatccctgactgctccagtgtcatttggcaagagtttacaaaatttgtaactaattgctcctatagataacatcactattgtagaacgtgagattggtcttttgagatgtttctcattcttttgcattctggcaaccggctgacctcatctatacctatgactaatggctcagccagtcatgtggtccctacctagaggcagattcaagcactaacagatcatttccctctgcccacatgattccatcaccaaacaatcagcagtactcattttttagtcctgtgcccctgaaactatccttgaaaatctctaacccctgatccactggggaggctgatttgagtaataataaacctctgtcctcctgtttggcagacttggagtcattaaaatcattctttactacaaatcaccatttcaatatatatatatatatatatatatatatatatatatatatatttttttttttttttggtgtatgtatgtgtgcaggaggccagaagaacttgtctggcaattataagagtggatggaggaactgcctatccctgtcccatggtcttgtccacaggtcagcctcacaaagtgaaagagccctggatggaaatacagtggaagctcattctcttagtgacctggggtcattggctcgagatgaagcctggcaggagtggcaactccaggtgatttctgcacctttcctatttcctgggaggtgggccaggccacagtgttagcgggaagggaacagaacagtcagcctagttagagggagtgtctgcggaaggcctagcagtggaggaagaagctgtgcaggacagggcttgccagtcagaatgaagtgggaggaagatgagggacacagagaagcagagagaggcagagacaccatggcagtgagcagtgagggctacactgacttcagtgaccccagggacaaggtgcccccatttccacagtccaggaccaaggagccctgagaaccctccgtggccaaagagcttcagagttacatgaggtggggtggctttaggggcaagaggtagtggggtgatgaaacatgggtgtcagcctccgaaggacaagggacaggtgtggctagaaactcctgggattctgcatccaagatccagtctctaaagaggttttggatcagtcatttctgcattcaattcctttatttgttatgtgagagctcctgagtatgtgtctctggctgggcctgtgctggtgcagggtgtgagtggggaaagaaaacaaggtcctctccttgatcctctcatgacagtgacatgggaactttgggaaacacaggatttcaggttcaatgatgggtgttaagatctgagggggagacctggacattttttttgcactgactctgatggttgaggcagctgatttagttctggagtgcagactaatcaggtgaccacttgctctcactcctctgaggtttggatgcctaagaagagaggatttgagccaataaatgagtatggggtgcttggaacccagtaagccctcacttctggtggaggagaggatgggcctgtggctgcagacagacctcatgtgaccctgatctcccctttgtgtttgtgtgactctggctcagtgactgtgctttcctgtgactcagttttctctcaatcaaataagctaaatggcaaatggactgtggcttttcatgctatctgtgaataaatgttaaattattcacagtcacctgacctaatgcgtagcactgtggaaatgttcaccaaacagcatttattattaatttgcttccatgagaaagcacctttacgtcagatccctgtggacaagctgctacctggtacatcttctctcttctgtttctgcttctggggatattagactttctatggagtgtcctaggcctcctaaggcagttggctgatggcctacaaagcttgtctttctgtcctctccactctgagtgtcaggtgaagaaagctctgtccttgcccagatgaggctctgagggctgagccctggctggtgaacagctgcaggagacacagtcctcagacagctggaaaattcttagtcccagtaagccctgcccaagaaaccataacccagtcctggcacaggctcctcagctttatctggagcaaggatttagggacaggggtctggggttgaggcttctagggctgagcttctctgagggtctcagggggcccctcaggccaagccctactcagttttccagggtctttctcagggtcaaatttatgaagagggcatgaggtgcttggctgagactgatctcctcctgctgagtccccccatcagactgtccttcctctgcagcaagtttctgcagggtctggatgtgagaaaggaattctgatctgttgaaatttgtctcctctgtgtgtttcctgcaataaatgcccaaaccccagcatgggacataatgcagagagggacacaggcacagtccaggcctgacaattctgtgtgtgtgaagtagaaatgacccctgccccccaacacccagggaccatgtggaatcactcacggtataaggtgaaggtgaaacgtccagttactcctccagtcccatcacctcgctttatgatgtgtaaagtgtaggatcctgtgtcttcctgggtgacattctggatcagcagggatgcattggaatatactgtttctcatccactgtatgcaggcccatatttaattatttgaccgtctactatatatgatgtaacataatggtagaggtccctgatttgtcctttgtaccagatgtggccagtaagattctggggcaaattgtggacaagtagaagaacatccttcccctcggaaacttttggtggctgggcttcaatcgtgacttgggctgtggtgggcgggttccagaagtttaaaagtgatgctaggaggtggagagagcatcagtcaatattgagacctatgtgttgggttgaaaagatgggcccctgggtcctgagaaggtctcttcaatcctcagccttgaagacacacacacacacacacacacacacacacacacacacacaaacacacacacacacatataaaaggggcatgtgtgtttctgtgtgtgtcctactgtcctactaggtcaaggtcagcagcatgacccccattccttcaacactcctgactttggcatttttctgtttggaatcctcttccccaggggtccgcacggccccctccacactgccctcaggttctgctcacatcagggcatccttagacttctttcctgacacctccttcagagaacctgggtctttcctttttgacctttccctgctctgctccctccagggttcttgtcaacacctgatctcacattctagatctctttgcatgtctgtcttcctccccatgacagcatgagctccgtgaggacagggacttttgtgatcttggtcgcaccccagtgcctggaacaggctgcagactcctgtagatgtgagagttctcaggggcctccatgccctgggtgttttttttcctcccaattgttgaggttttttgctgaggacagtgtttcatgccctgcttatatttttatttcaagtgtcatctgatatagttattattttcatttttcaaaatgtggtgacccctgaggattaatcagaaaaacagaacacttaagattttcctacctcttaccaattccggttcaatgtgactttcctattttgacccctgtccctctctggtgtattttcccctatccaggctccaacagagccttctttccttttttttcttttttcctttttttcttttgggacggagtctcatactgtcacccaggctggcatgcagtggtgctatctcggctagctgcaacttctgcctcccgggttcatgtgattctcctgcctcagcctcctgagtagctaggattacaggagcacaccaccatacctggttaattttttgtatttttagtacagacagggctacattgtgttggccagactgatcttgaactcctgatctcttgatccacccacctcagcctcccaaagtgctggcttcttttattttttagaaccccatcctctctaggagaccccatccagtcactctgcttccttttcctgtcctctcccaggaagttctctcctcacctgtgagcaggagccctttccaggttatatgctgtgtgcagggaggggctgagaggggccccatggtctctgctccctgcgtgttctcctctgtggagatgagcctaggatccagaatcttcctgagcacggctgtcagctgtgctgtccttcctccttctgcact

SEQ ID NO: 2097 - DNA, 18824 bp, Homo sapiens; identical to SEQ ID NO: 2095

SEQ ID NO: 2098 - DNA, 18824 bp, Homo sapiens; identical to SEQ ID NO: 2095

SEQ ID NO: 2099 - DNA, 13048 bp, Homo sapiens; identical to SEQ ID NO: 2096

SEQ ID NO: 2100 - DNA, 13048 bp, Homo sapiens; identical to SEQ ID NO: 2096

SEQ ID NO: 2101 - DNA, 18533 bp, Homo sapiens
tgaacttgtgcaaatagctttattaccataaacatatgaatactcatgaatagattcccaattctggggcactcagatagagagcaaaaggaaatgtttcaatttttgtttacaaaagtatactttaccaattgctcaagaaaaaatgttcataaatctggagaatgaaacattccaagaatcagcacattttcaaatagaaaattatgaaatcattatccttttgattatttagtccaataacattgagtatttttcttctttgtcttgaatttcatgaaggtatcagcctgttcattaaaattttgaaagttcttagtccagtggtatgatcttgaagttatcaggagcttgtattcaagagtccttgtaagagacctttccataaatctccttgaagaaaaagcaattttggactgtaggtgattgtaagtagtttgaggaagaatcaaagcaactgtctgggaatgacagagatttaaactgactatggttaaaaatctaatgagaatttattatggtaaagacacagctcacatagaaatctagttacttctgtggcatatgacactatgataacatatttgattttcagaaatttcatataatttttagaatactcattaaaaaaatttttttttcagatggagtctcactctgtcacccagactggagtgcagtggtgccatctgagttcactgcaagctccgcctccgcggttcatgccattctcctgcctcagcctcctgagtagctgggactacaggtgcctgccaccacacccggctaattttgtttttgcatttttagtagagatggggtttcaccgtgttaaccaggatggtctcgatctcctgacctcgtgatctacccacctcggcctcccaaactcctgggattgcaggcgtgagccatcgcgctcagcctagaatactcatattattaacattcccataaatattatttagagaaggtttagcatcacttatcccttatttgaaaatgctttctataaatttaatatataaaataaggtggcttttccgttcagcttctgtttctcaagaggattactgagttcttggtgtagcccattcataaatagggccaaaaatgtatagtcttatgtatgttgaaaaaggtccttaggtaattccagtacttttagctgaaaatcattgatttagttttaagttctacctattgcaacaggagttctccatccttgttacgtgttagtagtgtcagggaagacttaaaaattaccagtgcctgggtccctctccagacctttgaactggaactaatgggtggggcttgagcatccacttttagaaatgttttccagtgattccaatgtgtagctctatttcccatcagatttctctgatttcttgtggcattcaattttttctattttggtatcatgattattttcaggtctcatttcctgtcttaggctttatgtctcctggggtagggaccttgccttcttcatttctgtatgttttttgaacacatgaactgatcatcaggaaaagatctcaaccacacataggttgtgttctgagtctcaggttcacatgttaatcctaaagtctttgttctccacgaggtcacatgttgcttgtgatgaagggtgtggttaagtctgcagtgcagatggttgaagggatttcactctgtttttagacatagcattggaactaagaattttatgtctatatgggtgaaggggcagggatgtgtaggaagacagttctaattaggatggaggatttatactaggaagtagaggtaaaggaagtgagaagccttagtaaatagaagaaatgtgaacttatcaaataggctagagtagacccctgcagattcttgattaaatcaattaaccagattttagaaaggtaatgaggcaatcatatgcaaggaagatttcaaagtctggagacaagaagtcaagcaatactttgagaagtggttgagctttatgggaatggagagaattacactattgagagatgttaaaaataatgaagagggtttcaccatgtgaaattgtgtttctcatttgaatctgagaaacaaatgagcagaggctggagataattatgtctaaaagacagtggggtacagggagcataaaggccagggagaaagggaactgcaggaattagtgctgagaagcaggagtttagtggaggaaggaggagatgcagtcccagatacaggcaaataagtcttttccctctcccaagcatggcagtcagctctgcaggaaccaggataagagaaaaggccatcatacctgccagtcttcctgaaatacagaaatgacatcacagctgctatgttggattaaggagaggaagaagtcctattcttgtagaagctgtcatggaaagaaaagtaaagaaggaatgaaggtgatgttattttacatgggggagcatcaggaacaagcatgtaacatgaggtactctataattgtttcttcaaggaccacattatttctcttggaatattgatgggagatgattatattcttgcagttttttttccctctcaccatgtgtctcggttggtgatcagtcctctgtcaattctctactgcactcagatattttggaaggctttcagatgtgagaaaggctgattgctattttctatgtcattagaacttgccacattttcaccttttcatggttgcatctttttctcggtgtttctgttgtggcagtcatgaatgagactctgtcaggtctccatggcagggacctgattggcagaaggcccaggtcagtgcatttcaaattcaccacctcttgtgcacagaaagcttctttcctacaggctcccagcaagggtgtgaaagcaagcctagttctccgaggctctctttaactctaatgggtgactggttggaggattcctcatcagccttgcaaaaactcttagaactgcattggtacctaaaacttctttctctttgtttttcataggaatcagctctgcatagtggtctgtgggttctcccatactaccttcatgcctgccccacattccctcacagatgtcttccctgataaattatcttgtatgtctaatcccatcttggatgcatctcagttggtaaatactaacataccaggcttgattctttgcccttagctttttttctttctctcccacaagcagtcagtaaccatgtcctagtgttttatgtgttacctctttttccatatatatatatatggaaaaaggtagatactgttgaggggcacttgctatgtgccaggccctgtgctaaatacttccctgtatctcatttaatccacacaataaccctgtcaggtagacattatttccattttggcaatgaaaagacagaagcttagcgtggtgtaaaaactttcctggtgtcatatggctagtgacagggggatctgagatttcattctaggactatttgacctcaaggttgatgatgatgatagtaatatagtagctgacattggttcctctgtgtgtggcatcttgtttcattgactgcattaaatctttaaaagaatggtatgaagaaagcactgtcattgcaatattcaggtaaggaatcagaggttcagagaagttgagtcttgtgcaagaaatttataactgtaaactcttacattaaaaaagaagaaagatctcagatcaacaacctactttaatacttcaggatatgaaagaagaacaaactaaacccaagcacagtgaatgagggaaataataaggattagagtggacataaataaaatggagaacggaaacagaatagaggaaattactgaaaccaaaagttgattcttcaaaataaaatcaacaaaattgacaaccattaactagattgactaagaaaaaaagagaaaagtttaaaattcctaaaatcagaaatgaaaatggactctgagcatggtgggtcatgttttaatcctagcactttgggaggtcacagcagaaggatttcttgagaccaggtgtttggaccagcataggtaacctggggagacgctgtgtgtacaaaaaaataaaaaaccaattagctgggcatgttgacatgcacctgtagtcctagcatcttgagaggctgaagaaggagaattgcttgagcccaggaggttgaggctgcagtgagccataatcacacaactgtattccatcctgggctggcctacagagtgacagcctgtctctctcttttcaacaaaaaaaaaaaaaagaaagaaagaaagaaagaaagaaaaatgaagcgattactaccaattctaataaaataatgattatgaaagtactataaataattgtatgccaataaattggataacctagatgaaatagacaaactcctagaaacacacaaaaatatgaataaaactataatcactaataagattgaatcaataaaagcatttgatgaaattccatattttttcataagaaaaacattgtaagaatggaaggaaaccacttcaacataaaggcaatatgtgaaaaacccaatggtaacatcatacttaacggagaaagactgaaagctttccctgtatgagcaggaataagacaaggatgcccacttttgacacttttattcaacatagtgttgaaaggtctagtcagaaaaattaggcaagaatttaaaaaaagacattcaaattggaaggaaggagtaaaattatttctgtttatagataacttgaacttatatgtagaaaatcctaaaggtggaacaaacctattagaattaataaataaattcagtaacgttgcacaatagaaaatcagcattcaaacgtcagttgtatttcaatacactaaccatgaacagtctgaagggaaattaggaaaaaaatttcaatttatattaacatcaaaaagaataaaatatttaggaataagtttaaccaaagaggtgaaatgattatacctgaaatctacaaaatatggctgaaagaaatgaaagatgacatcaataaattgaaggacattttgttttcatgaattggaagactcaatattgttaggaggacagtgctacccaaagtgagctgcggattcaatacaattcctatcaatcagaatctcagtgacatttttgcagaaaaacaaaaatctgtcctaaaatttatattgcatctcatgactaaatagacacagagctttgaggaggaagaatgaagctggaggactcacactttctgatttcagcatttactacaaagccccagtaatcaatacagtgtggtactggcataaaggaggacatagaaattaatgaagtataatagcccagaaagaaattcttgcatatatggccaaatgattttcatcgagtgtgccaagatcattcaatggggaagggacagtgttctcaccaaatgatattgggaaagctggatattcaagggcaagaaaactagaacctttacataacaccatgtacaaaaatcaacccataatagatcaaagatctaaatgtaagagcaaaaactgtacaactcttagaagaaaagcttcatgatgctggatttcacaatgatttcctggttgtaacaacaaaagcataggcaacaaataaaacggataaatcggacttcataaaaatcaaaaccttttacatatcgaagaacattatcaagaaagtaaaaaggcaacccatgaaatgataaaaatatttgcaaattatatgtgtgataagaaattaatttccagaatacatgaaaagctacaagtcaacaacagcaaacatccgaaaacccaattaaaaaatgaacaaaagattaaaatggagttttctccaaggaggttacacaaatatccagtaagcccatgcaaagttcctcagcatcatgaatacttagagatgtgcaaatcaaaaccacaatgttacaccacctcacacactttaggatggctttgataaacaacaacaatgacagcaacacaaaacaacaggtgttttcaagcagatggaaaaattggagctctagtgcattgctgatgggaatgggaaatgttatagccactgtaaaaattggtgtgctgtttctcaaaaaattaaacaataaattaccgtttgatccagcaattccacttctggacatactccccatagaattgaaagaaatttgaacaaatatttgtgcactgatgttcagagaagcattactcacactagcgaaaaaatggaaacaaccaaaaagtccattgaaagataagtgggtaggcaaatgaggtgtgtctatacgttgaaatgttattcaaccttaacaaggaataaaattccaatacatcgtgcaaaatggatgaaccttgaagatattatgctaactgaaataagccagacacaaaaggataattattatataattccatttataaaagatagttagaatagccagttacatagagacagaaattagaatggtgggtgctaagggttcgagggagaaggagtgagagttactgtttattgggtacagaggtttaatatggtaagaggaaaaagttctggaaatggatagtgtgatggttacacaacactaaattgcacacttagaaatagctaatggtaagccttatattagatatatataaagtgtctggtagtcttaccctctctataattacacactttttggcactgcccttttcctgccatgcagagctccaggggtgaatctccctatttctctagctctgcatcagtcacagtcctccatgctgtgtcccacgtactgtgcccacagcttcatacaaccgctgacttcagagccaggaccaggcttaggagtctgccctgaggctccttctcttctcatttccctgcagcctggcccgggggaggcttggcttcaactggcagctccatttagcgaaattcaggacagtccacaaggggtctttctccacacatgctggtcccaccccaggtggagtcaaacagggccagtcaccagaggagcccagagcagagcaggaagcagagtctgagctgctcctccctcacccaaggggcttcctcctctcatttgggggaaaagtgtgagcttgtttcaaagcctcagatgttccttgtagctcatggaataggtacaagaaaaaaaagacgtggcagaaggggatgtgttagtgacatccagaagcaacttgatcttgaggacactccttcttgtccctctgtgaagcctcttctaccacatagggctcagggctgataatgacccctccctacctttctcaggcgagacacaaggtcagccatgagaaaacagaaaaacaaggagaagagagtttgtagagacaaattgggagggttcaggaggagaatttgggatttgcttttgcccatgggacacaggctgggaataaaaatgttttcctgactcttctctgaaagccagatagactccacctaaaaccctactgccaaggatgctgggatccacttaccagagactttgactgtcaacgatgtggagctttcctcgccagtggctgagttacgaacagagcaaacatagagcccgctatgctttgtagtaatttgggggataaacagattttgtcctgattgctgaaacttcccattaattgtccaagaatactgtgccggtgggttagagttcgcgaagcaagacaagtagaggttatctcctgaacggtaattggtgtatgaagggtgaattctggggaggtctggaccatctggagcaaagagaataaagccacaggtgatgccatctgagggaaggggatgctcctggtctcttaaagggacacagtgaccctctgagacaagacacatcctcaagtcccagcaaaaccccctctatgttcactgagccgaaccctgaagtattcacctgtttctcccaccacaagatgtgggccccaagtctcccacgacaagaccgtccactccccttatattcttggttaaggctgtgcctacccaggttttcccagggcagggagtcatggccagcttggatgtccagaagtaaagttgtctatacttggaccggagagagactgagaggcctggcccctggtcatttggatttaagctggtggcctggcccacagaggaacaaaagatacagaggacattcagggtgactgggtcactgtggatgccaccatatcggtcccgtatttcacattcatagggtcctgtttcatttctcgtgacactgggtagaatgaggatcctgttttcaatgggtcgctttaccctgggactgaccgggaggctctgaccatttagccaccaaatgtaggtgtagctctcactcttaggttcacaggtgaaggctaatacatccttattctccctggggtttaagttgttgatggtgatttagggcttgggcagcttcgctgtgtggataacagagagaagattgtcctgtgtggcacttttgattcctccacaggcatccttcaatcagagttaccatctcccacctctcagcccacctgagtccttgaaagccaataactggtgtgtgtgtcacaagacagatgcatgatgatctaagggctcaaagactgtgaggccgcctgctctgtcttaggaaagcacagactttctgaagtgtcaattgagcagcagtgttgggtcatggacagacatgtcagtgggagtcacagccccagtacccctcccagtctctccctaatcagttgactggctggctcaccttgggttccttacctggaatgtgcaactgctgggccccttccaaattccatcctactttgcccccctagatgtgatttctctgcagcttccatttccaaggacattctagagatcagtaataatgggacttcccattgtcctgaaaccctgaagatactgagcagcctggcctgggactggatgtttcagcagaaataacacaggggagaccagagtcaagcctggaggtcagttcagtcatcaggcagtggaggcacaaggtggggcagctttttgcaggtgtttcatgatgacttacttgaaccagtgacctctaaagatagaacagagtgcaaggaatgatctagaaagagtgaaggggataggcaagagctggtggctttggagcagaagcatgttccctgtcttgggttctttaagtttcctctccttctgcagagggcaggtgaggaccatgtggatctttccagaaatacatgcggacatttgcaaaagcagaactgactggtggaaagggtgggaatgaactgctggaaatctggtcgtcatggaccatgtgtgtttgatggatatgagacaaatttggagagaagtttttcaaatattttctttcattgaacaatctactctgtgattccctgggttcgactactctagggacctcatgtaagtggattccagagtgaatatgagaagagactgctggttgccaggagctgggagtggggagaatcagaagttgttcatgggtgtgcagtttcagttatgcaaggtagggagtttctagagatctgctgtagagcttgatgcctatagttcacacagattgagtatttcttatgcataagacttaagacaaaaagtgtttcggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgcccttttttttctctcaccacgtttctggcttggtgattagttttcggtcaattccatactggccatgctgcactcgtttattttttaaggctttgggatgtgagaaaggctgattgctattttctgtgtcatcagaactttccaccttttcatggttgcatctttttcacagtgtttctgttgtggcagtcattaataagagcctgtcaggtcagatttaggacggagttttctaattctgccaaaaatgttactgtgattctgggaggggttgcattgaatctgcaactcactttgggtagtattgtctttctaacaatattgagtcttccaatccatgaaaatgaaatgtctttccatatattgatatcgtctttaatttctttcagcaatgttttgtagttttcaaggtataatcatttgacctttttggttaaacttattccaaaatattttattccttttgatgttaatgtgaattgaatttctttccttaatttcctttcagattgttcattgttagtgtatagtctaaagaatgatctagaaagagtgaggggacaggcaaaagctggtggttttggagcagaaacatattccctgtcctggggttttgattttccctctccctttgcagagggcaggtggctcttccctgatagctagatagacttcactggaaaacatattgccaatgtttcagggatccacttaccagggactatggtcctcttgattatgagatttgttccagcagtggctgagttatggatgaaacagacatagagccctctatatgttttagtgatttgagggataaagaacacttgtgctgattgctggaacttcccatcaatcagccaagaatgctctgccagtgggtgagtgtctgtgaggcaggagagcttggggacttcccttgtatggtaataggtgtgaggaagaaatggtgggggcatccaggccatctggagcaaagagcataaagtcacaggcactattgtcagagggaagggaaaatcctggtctgtggaagggccacagtgaccctgtgagccaagccgcaacactgaactcccagccaaatccccgctgtgttcactgatctggagcctgagacattcacctgtttctcccatcacaagctgtggaccctgagtctcctatgacaggaggagcctcttttctcctattgtggatcaagcctaggcctattctggtttgcctggggcagaaagtcatggccagctttgatgcctaggggtaaaggtctctgtacttggacctgagagggactgagaggcctggcctctggccatgtgtatttgggatggcagtctggcccacagaggaacagaagatactcacggaggagattcagggtgactgggtcactgcggctggcactccctgagttccgtatttcacattcatagggtcctgcagtatactttgtgacaccaaatagaaagagggtcctgttggtttcggacagctgaaacctatgagtcatagggaggctctgaccattcatccaccactggtagcttgtgtccggagtctcaggatcacaggttaagatcacagtttccatggcctccctggggtttaagttgctgctggagatggagggcttgggagtctccactgtgcagaaaacagagagaagattgccctgtgtggcacctttgattcctccaaaggcatttttcaatcagagttggcatttcccacctctcagcccacccaagtccttaaaagcccatggcaggtgtgtgtgttacaagacagatgcatggcaatctgagggctcagtgattgtgaggctgcctgctttatgtgggagaagcacagactttctcaggtgtgtattgagcagcagcattgggtcatggaaagacacaggaccagcagtcacagcccctggtgcctctctgagtccctccatctcgaagtgcctgcctggcccaccttgtggtcctcacttggagcatgcagtgctggaatcttcttagtttcagtcttactttgccccctgaggtatgttttctctgcagcttcccttgccaaggacatccaagagatgaatgatggaacttcccattgtctttaaaccctttgggtactggaaagcctggcctgggactgggtacttcagcataaataacacaggggagaccagagtcaagcctggaggtcagttcagtcatcaggcagtggagccacaaggtggggcagttttcccaggtgtctcatagtgagtgacttgagccagtgacctctaaagatagagcagagtccaaggaatgacctacaaagagtgaaggggacaggcaagagctgatagcttctgaacaagaccatgtgccctgttctgggtccacaatgctcccttccccctgtagagggcaggtgaggacgatgtggacctttctagaaatacatgtggatgtttgcaaatgcgaaactgactggtggaaagggtgaacatgaactgatgatggaagtctggccctcatggaccatatgtgtttggtggatattagaccaatatttgggaagaagtcttgcagatactttcattagatattctactctgtttctgagtttaactaccctatgtacctcatatcagtggattccagagtgaatcagagagtagaatagtagtttccaggagctgggatcaggggaatagggcgttgttctgtgggtgtgcggttccagttatgcaggataaggaggttctagagatctcctgtacagcctcgtgcctatagttcattcagataaagtgctccttatgcagaaagcttaaaacaaagtgttttggatttctaatttttttattttggaatatttgccgtatatgtactggtttagcatcccaaatctgaaaaatttaaaatccacaatgcgccagtgagcacttctttttagcatcacatcagtggtcagaagggttgagttttgagcatttcagattgtggatttctggatttgggatgctcaattcgtaatactgtaattttcccataaaaagttgtcaggagtttagacctcatgttatgttctgactctagtaacaaaaaaaatttggaggaaatattaaaatgttttcataagtggaaatttttactgatgatccaaacatctaagatcaattgctggtagtagtatttctcctgagaccaaaataaggtttaggtgtgccgtgaattccagcaggatcacattatgctcaaagaaagatgccaaaggtgattggaaattagcagctccttaagtagagagagtcccgttaaaaggacagaactggtcagtgcatcaattacataaagggaggaaggatgccaaattaaaagaagtgatgtgtgttatgttagtaaatatagaaagaactccctgcttctaatttctgtgcagagttaggaaaaatggggaggaccccaaaacaggtatgtgaaatgctttcttcattttctcttaagctcaggaaacaccactagagtttaagtttgtgtgaaataggaagattctaagtgagatgccaatggctcatgtgtctccccacaagaagaactccaacttatgaaaacggcatcatcatgaggaaacacttgtgtgtggcacaggcagtaaaaccatcagatagcacccacctggtcacctccaactggtcctcaaaaccaccagtattcctattacgtgtacgttacagcatttgtatttgtcccacaactacataatttaaaaattgctactgtcaaaacaaaatattaaatatgaagttgaatcagttgttccactttttcttccccactcttcttgaactttcctgtttcagttttggaaatttctattgacacgtcctcaagctagggattccttagcttttttacttagtgttggaaccgagtgacaaattccaagcttgttatatgcctgaccggaagccagaagtctctaggaagtgactggagaatgtgagctctatagcaggttgaggatggagtcacgagtgaaatgggtgatatgagcccatgggcttgggggactgcaggcctgtccagcctctgacaccctggtgagtcattgcagagattacaacagtgacagcaaactagcatggctgactccatctggcatctagtctcaggctggctgtcctcacttattcctgggcataggccaggctaaccttgggaggaatttagtttatggtttaattttgaagcaagaatgataatagttcctccataaaactaacacccttactttgcccagggacggcctttgtcaaactagtgaaagaccatgagattaagattataggagggaaccgaattctgctaaattgttgtcacagtttctataatccctgactgctccaatgtcatttggctggagttgacaaaatttgtaactaattgatcctatagataacatcactattatagaagttgagattggtcttttgagatgtttctcattcttttgcattctggcaactggctgacctcatccatacctatgattaatggctcagccagtcatgtggtccctacctagaggcggattccagcacaaactgatcatttccctccgcccgcatgattccatcaccaaacaatcagcagtactcatttttcagtcctgtgcccctgaaactatccttgaaaatctctaagccctgatccactggggaggctgatttgagtaataataaacctctgtcctcctgtttggcagacttggagtcattaaaatctttctttactacaaatcaccatttcaataatttttttgtgtgtgtgtgcaggaggccagaagaacttgtctgacaatgataagagtggttggagggacttcctatccctgtcccatggtcttgtccacaggtcagcctcacaaaggggaagagcccttgatgggaatacagtggaagctcattctcttagtgacctggggacattggctcgagatgaagcctggcaggagtggcaactccaggtgatttctgcacctttcctatttcctgggaggttggctaggccacagtgttagaaggaagggaacagaacagccagcctagttagagggagtgtctggggaaggcctaggtgtgagggaagaagctgtgcaggacagggcttgccagtcagaatgaagtgggaggaagatgagggacacagagaagcagagagaggcagagacaccatggcagtgagcagtgagggctacactgacgtcagagaccccagggaccagctgcccccagttccacagtccagaaccaaggagccctgagaaccctctggtggccaaagagcttcagagttacatgaggtggggttgctttaggggcaagaggtagtggggggatgaaacatgggtgtcagcttctgaaggacaagggacaggtgtggctaggacctcctaggattctgcatccaacatccagtctctaaagaggttttggatcattcatttcttcattccattccttcatttgttatgtgagagctcctgagtgtgtgtgtctctcactgggcctgtgctgatgcagggtgtgagtggggaaagaaaacaaggtcctctccttgatcctctcatgacagtgacatggacactttgggaaacacagggtttcaggttcagtgatgggggttaagatctgagagggaggcctgctcatgttttttgcactgattctgacagttgaggcaggtgatttagttctggagtacagattaatcagctgaccatttgctctcactcctctgaggtttggatgcctaagaagagaggatttgagccaataaatgacatggggtccttgggacccagtaagccctcacttctggtggaggagaggaagggcctgtggctgcaggcagacctcatgtgaccctgatctcccctttgtgttggtgtgactctggttcagtgactgtgccttcctgtgcctcagttttctctcaatcaaataagctaaatggcaaatggactgtggcttttcatgctatctgtgaataaatgttaaagtattcacagtcacttgatctaatgcttggcacagtggaggtttcacacaaacagcatttattattaatttgcttccatgagaaagcaccgttacatcagatccctgtggacaagctgctaccaggtacatcttctgtcttctgtttctgcttctggggacattagacttcctatggactctcctaagcctcctaaggcagttggctgatggtcttcaaagattgtctttctgtcctctccactctgcctctcctgttttgacctctgtcctctacaccattgcccagatgaggctctgagggctgagccctagctggtgaacagctccaggagacacagtcctcagacagctggtaaatccttggtcccagtaagccctgcccatgaagccacaacccagccctggcacaggctcctaagctttatctggagcaaggatttagggacagggtttggaggttgaggtttctagggctgagcttctctgagagtatctcaggggacccctcaggccaagccctgctcagttctccagggtctttctcagggtcaaatttatgaagagggcatgaggtgcttggctgagactgatctcctcctgctgagtccccccatcagactgtccttcctctgcagcgagtgtctgcagggtctggatgcgggaaaggaattctgatctgttgaaatgtgtctcctctgtgtgtgtcctgcactaaatgcccaaaccccagcatgggacataatgcagagagggacacaggcacagtctaggcctgacaatcctgtgtgtgtgaagtagaaatgacccctgtcccccaacacccagggatcatgtggaatcacttacggtataaggtgaaggtgaaatatccagttactcctctagtcccatcacctcgctttatgatgtgtaaggtgtaggatcctgcgtcctcccgggtgacattctggatcagcagggatgcattggaatatgctgtttctcgtccactatatgcaggcccatatataattatttgaccgtctactacatatgatgtaatgtaatggtagaggtccctgatttgccctttgtaccagatgtagccagtaagattctggggcaaattgtggacaagtagaagaacatccttcccctcggaaacttttggtggctgggcttcaatcgtgacttgggcagtggtgggcaggttccagaagtttaaaagtgatgctaggaggtggagagagcatcagacaatattgagacctatgtattggggtgaaaagatggggccctgggtcctgaggaggtctcttcaatcctcagccttgaagacacacacacacacacacacacacacacacacacacacacacacacacaaaaggggcatgtgtgtttgtatgtgtgtatgtgtgtgtgtactactgtcctactaggtcaaggtcagcagcatgacccccattccttcaccacttgtgaccttggcatttttctgtttggaatcctcttccccaggggtccgcatgaccccatcaggtcctgctcacatcagggtatcctaagacttctttcctgacacctccttcagagaccctgggtcttccctttctgacctttccctgctctgctccctaaagggttcttgttaacagctgacctcacattctagatctctttgtatgtctgtcttcctccccatgacagcatgagctcagtgaggacagggacttttgtgatcttggttgcaccccagtgcctggaacaggctgcagactcctgtagatgtgagacttctcagggccctccacacccttggtgtttttttttttctcccccaattgttgaggttttttgctgaggacagtgtttcacgtcctgcttatatttttatttgaagtgtcatctgatatagttattattatcatttttcaaaatgtggcccctgatgattaatcaggaaaacagaacacttaagattttcctacctcttaccaattccagttcaatgtgattttcctgttttgacccctgtccctctctggtatattttcccctatccaggctccaacagagccttctttccttttatttctttcttctctcttttttttttttttttttttttttttttttttttttgagacggagtctcgtactgtcgcccaggctggtatgcagtggcgctatctcggcacgctgcaacttctgcctcctgggttcacgtgattctcctgccacagcctcctgagtagctggaattacaggaacacacgacaatacctggttaattttttgtatttttagtagagacagggctacactgtgttggccagactgaccttgaactcctgatctcgtgatccacccacctcagcctccctaagtgctggcttctttcattttttagaaccccatcctctccaggagaccccatccagtcactcttcttcctcctcctgtcctctcccaggaagttctctcctcacctgtgaccaggagccccttccatttgatgtgctctgtgcagggaggggctgagaggggccccatggtctctgctgcctgtgtgttctcctctgtggagatgagcctaggatccagaaacttcctgagcacggctgtcagctgtgctgtccttcctccttctgcactgagcctcttcctggggcagcagcaattcccaggctcatgggtggggtcaggcccaggacacctctctgtc

SEQ ID NO: 2102 - DNA, 254154 bp, Homo sapiens
atttagtaaaaacattttattaattcctatgatgttgacattttcattacttgcttttcaaaatgaaatgattgtttcaccacaattcacacaaatcaactgatatactaatccacaccaaaagaaagaactcacaagaaaacagtatcatctaagatggtgggagtcacaggagccactcagtcctaactctcatgatcatgagcatgaaataatgatcctggtccacagaatgaagcccagtgagagggacccacacttgtctcccggtatccacctaccaaaaactgtttatccaaaaaaatgcagttatacagatccagagctaaccaaaagtttataaaccacaattctaatttagtactgactatattttctagtcagtaggttagatgaagaattattaataacatctaaccagaatttaaagaaaaatacgtgaaaagttcctttgataatgtttcctaattaataaaagtccatagaaagtccctacgcaccgtctaatatttctaccctttttttattttttctcctgatcatcacattttttcaagccaactataattcttgctatcacatctgttcttatttttctatcttgccatctaatctttgtccacatgcaaatatatttgctgttataatcacagtgtgctcaatattttgtaaactaaatctttcacttaacagtctgggtctaccatttcatattatggaatcttcaaaattgttttttatggttgccaaatatctcttaatttccttaaccatagcctgactattgaatatttatgatttttccatttttttctgttattaaatgcaattttatatagactgttttcagtcttttaaattgtttccttgatgtagagaaaacaaagatccaagggtgtgaatatttttatggctctttctgtatttaatcattttacaaaaaggttgggttgatttacattgctccagcaatttgtgagtggatcagttttactgagagcatgctatcatttacttttagctttaatttttattataagaattatcaattagtatttcattattaattataagtaggcttaagcattgttctacgtttattctctatgtttacataaattttctatttacattcttaatccattcttctatttccttctattttttaaaaggtatttttaattggctgcttgaaaccctgaaaataagtctcttaacttgacctaaatacgaaaggcaatagaagcaaaatcagcacagacttgccctgttaccttcaagaacttggctgttaccaggccacgttaacagaagaataattcctcccagagaaatactgtctgcttaccctagtcagtcttcggagcgaagtaagaagaaaatatactactgtggatttgagggccacacttcattaggatgctgtaaatttacttttatatcactaaataacattttcaacaaactcagacattggtcactaatgatgaaacaagtaaaatataagcatccaattaaggagtggggaaaacctatgcagctcattaattgcataaacgacctaacatacactgtccagcagtcatacagaaataaaggttacaataatttagatcttgcattttccaaagcattgggtggggacactccccacatgttacttgacatcacacagaagggcaaccccacggagcacccagtgttcaggggtctgggctgtcctgagatccacagcggcaatgtagttcaagtccgttcgaactggcttcttatagatgggacaggagtaaaaccgaggatctcgtaaagctacaaaaaacataaaagaaaagaacttggtgaaatttccactttagagcccaaggagaatgcagagccatgcttctgcattctgtaggtcatttcaaaaacagatgggtttggctgaatgagggacattctttctgaggtcaggcaattcctagatgtgaggcagatgctcccacatggtgccagcagatgtggcaagacacccagacagcctctggtggcctctgctggccccttgccctgaaccatggacagtaactcatgcccacatgcttcctctctctcctttgcacctgtccactcaacatcccctccacctgttctccttcacctcctcaccaaaccttgagcacacacacatctacttttactcaggcatccagcaccagtgggcattactttattatttcaaaatcttcaaccctgcaggccatagtctacatcacattttaaatcccaggacagagggtgcctccccaccccccagctaaatcaggtattgtgaattctccatatatgtagagaaataaaattgctgggacgcagagagtaatggcccaattcacctccctgagactcagtctacctttctggagtagaagaatggatgcagtttccaaaatgacactgcaatgaaaggcaatctatgtatgtccatccttcagagatcctttctaacacatccatctccacccacatgctccctttctctccagccttggaaaccccatactcagagacaggtccaggtctgtggggacttaaacttatacaattcatgagggccctctttaagaaaaggagtaaaatttataaataaaaaagtaggctttggaaggagactctgcctgtgagcagcctgggagtttaagcctcattagcttcttatgaaacccactctgcccacagtagtttatctgcacatctcctaacatgcatctcaggaaatagtatattatttaatattctcttccagattatacattttttgaggacaagagtgtgtctacacccatccctgtactcttccgggaagtcaatattacaaaaaaattaaaaaaccctcacttaactattcaggtgaaattacatttaactaagaggatgctctgcttttgtgaattaatgttacaaacatgggcactgaaacacatcagagttattgaatttatttctcaaaactgacatgctcaaaaatttaccttttccagaaaattacaaaagcaaggcactatcagaaactaaagtctcattatttgatccaatagaacttgtaacctgctgtgccctgtgtttttacatatccactataaatttaattaattgtattagaagaagtgaaacgtttgaatacaataatgttacacataagtttcaatataaaataaataatcctaaagccgtgattcttaaccagggacaattctacttacggaggacatttgccaatatctgaagacatttttggttaacacagccgtaggcttgctgctgacatcttcaggaatagaggtcagggataatgctaacatcctatgatgcacaggacagctcccccaaaacaaagcgttacccagaccaaatatgtcaatagtaccaagagaatgagaaaccttcttctaaaacaacaaagatattttatagtattttaaaaccctgtgtttccctaatctcatgaaagtaatcattaggaacaacctaaaacaacgtgatacctaatttttaagtctgagtgtaatttttccaatttctatgcatatatcactagtgataatcattaggcaaatatatatgaaaaattctgaacaagtaaatgaatgacaatgaatcatgcaatacggttaacgctaactatactcactgatatagttaaatcctttaatcctaggatctttaaacatgtaaaacatataaaagtcattcttcttgctgcagatttgattaaccattttataaaccttgaagtaagcctttggtgccttacatctgaatctcctgataattacaaaaattacaacttgagaagtatttgactacttggattttaatcccaacagaaaaatggagggaaaaaatagcattctcttcaataagcaggtaaaaataattttctgaaatatttatccaattctatttatttttaattgcttcagagctgaaggtgctcatgccaagtcacagcgtgcagcaaatttctgcggcaggattagaagccactgaagatataatttcatagtgaaaacgttgatagatgctaaacaactacataagcagatgattcgaaaccatccccctgcttagacaaataactttgaagacaaaaataggcatgctaggtaggtagaacaaatcacctaagtatgtttaaagccttagggttccagaaggaggaggagagagaagaggttgtgcaaattggcaagccataccctttaggatcttaaaggttttaacaaaacaccttgggggaatttcattttctgactatttaacttccctatcttgcatttttcatctacatgtgagtatacattccatatattccttccaacatccaaaataatcgttacatagagagtctctatagaatcgttaagtcattcctttatttaaccacccttttgctaacaacatttaaattactagacagttcactcttaacatacactatttctttcaatcctttaaaaaccatgtgagctaagcatgttaataaaagtaacaattgaaaaaaatatttattatatgcttcctatgtacataacagtgtcagtttaattctctcaataatcctatatgatgggtactaatatttaatcattttacagattcaaaaactggaacagaaggaggtgagttgtccaagattagagagctatagtgataactgagaatgaaacctagtcagaatggatccgtggcctctccgcttcatctctgcaatactttggaagcactatgcatgtatacctctgcctttgcagaaaacatgaaaatgaaatggacagaactagaaacctgagttcaatttgtggcatatttgagatgcctccaaagccacgtgactaatgactaggatgataaaagccaggagaacaacccgagtatcctggccctcggctcacagtcctctaccggtgaacaggggcacgagcacttttcagcctgtagcatgatggagggaggtatacggagggagagcaccatccgcagagggctctccctgtgccctcccactgcctacagtctaccttagcaggtacctgagaaaaattaactcaggacttcgatattcaagggagctgtcctcattttgagtttagctgtcctcattttcaagtttcatcccaggaactacgaggacatgtaaacacagaatctcaagtagaagattaaccatgggaattcccagaggtttgcatatacctcatgacaaacaaatgtgattctcataccagctttccctgtcagtagccaggaatcatgggcaaattacccagtgtctccaagccttaatttctccatctgcaaaatgaggatgacaaatttgacagagttgttgtaaagattaaataagttaacacatgtatgtgcctggtatagtatgatgcctggaatgtagaaggtgcctaagatagagatgttattcgacacttctttatctctcagtctccacacacacatacacaggcacacatacatacccacacatgcacatgcacatacacacacatgcacacgcacatacacacacatgcatctacttacgcatggaccttttcactaaaacaatttcccagactcatgtttcccatgactttaacagacttccaggttgacaagctgacagtggattaaatcctgtgggctcaggagccaggaggtctctacccctggtcaccacatacggctatccccaccccaggcccaaatctgcacagtctcaggtcagaatgggtcagacggtgttcttagatacactttttccttagcaggaaataaccgttgagacccctcttgcacctgcttagtgaccagaggtatgtagaaggcttgcctcgtccctcgcaaatgttccaatcacggttttccatcacagcagctacagctctgaagttcattgagaatcatcaatctgctcatataataaatctgtgaagacacatatctttcttctatctgtccttttcagcttcctttgagaatagaggatctagacagtgtgtgtgtggctttaccgtcttggtgaatttagtactatttgaatgactttcccgtgattttctagcaagaaacatgatttctttttcaagtttcagggtatatcactcaatttttagaattaaaataaatatctagatttcttcttgtagaaaacaaaccagtcctatatctatattttaatgattatttaaatcaaaaaatttccttcatattaatgtaaaaactgttaactataagaattccaatttttaaatgctgcactttggtcattaatgatgctacacacccctttaagtcaattagagccctgctcaattatcaaaattgagtaaaaattaaatatatcgcatgaaaggggtaacagaatgttagttttccatcactaaagaaacacctcttcaacaacaaagctatttggcaaaccaagtttccaccaactcttactgaaatcaaaaaaagaataaagaactaaagttttcttttaatactttgaaattagccctttttcctttgcttattttattttctcccttacctgctgctaatgagcatcaccactgggctaatacccagcagggtgggtatagttcttctataaaaatctgttcttaaatcataaagaattgccagtattataaaattattactttattactaccatgctgagatgttcaatgtcaaattgccgtggatttttatagtttagtcacaagaaaaaacaggaacatgtaactcaactggaaaaaggtttttatttcattttatatgggaaacatttttacaatatgttgactagatgcaatgatatgacaaagcaatttttctaaaatactatttttggctaaaggaacacttgattattatttctataaaataattactgtcccaagatgtcacactaccctaagaaccagtaaatacaaagccataggcagtatgcttgcctaagcccaggtagacacatttatcattttagattcaactaataaatattgaactacaccatgtgccaagcagtgtgctgagaaccttcgtgttcctaatctgatgctcaactctccccttcacaggctcttcttccttcatgttttaaacactggtcccctcccaaggtaatccttattcccttcaacaaatcacagcctctctagcttgttgtcctcaaagcagaatcatttctctagcaaacttttgtaaagactaaatgagacatggtgtgaaatccacctttaaacattctccataaatatcatttctctcttccaactcccccatttccacgtctacctgaagaacctccttcatgtggaaactttgttatccacctacacactgctaacatccagctaacctggactgggtctgtcttctaaatcccagaactaaactcttcatcaaacccagcacatccattaccacctcatgactttccactcttgcctctgttccaggatattagcatagcctctttctatcacttggatctcagctcaatatttctcacagaactcctaaattatcttacactcaaaccatgtgtatggcttgaatttgtcccctaaaatttcatgtgttgaaaacttaatcactggtgcaaccatatttggaggtagagtctgataaaaggtgattgggtcaaaagggtgaatcccttatgaatgaattaatgtcatcatcatgccagtgagatagttattgcaagagtgggttgctataaaccaagtccagctcctggtgcccctctctgtctcacatgcttacttctaccttctgtctgtgaccatggaatgaccctcaccagatggtggcatcatgcccttggacttcccagcctccagaaccaggagcaaaataaacttctattgtctatcacatgcccagtctgtagtattttgttatagcaacagaaaatggactaagacaccatgcatgtgttttttgcagagaaacaagaagtatctgaaatcagtatgttcatttctagtcaactctcattatacacagtagttatgtcctataaagtcaccatgaatattgaattaacaaacgccaagccatttctcctaggggaaatacagggttagtttcctgcaagcctccggtcacaacatttccatcaagcagtcaatacataatcttgctttatgtgtgtttctgtttaaggatatctttttaatatatatggttgattaccattgcactgaaggcccacagcactataactaatgcctgaagtcagtttgtccaacacatgtgttttctccataaggcacagccttcttgtgctcagaaacagcagacttaaacactacacttgggggccattttaaataggaaaaagtaccccccaaaaattgaaaaacatagtactaaagagacaacaaacaggacacttagttgtaatatgaaagctggaacaagaaggcacagcctcaccttgtttggccccagctagaaatatgtacgtctggcaactccaattgtttgctgctttgcacatatttgtgaatgaccataaaagtggcattagtattgatttgggggctacagagaaattttagcaggtaggcaaattcacaaatacaaatctgtgagtaacaaggcccaactatatttgtttcttttatggctatcacccctgtttgcgactcagctccacgagaatgggaagcctgtttggtcttttctcagtgctgcaaccccagcactagggcagtgtttggcagatggtcagtaagtagttactgaatgaccaagcaagctaatgctatttccctctgccacgaaaagtctaactccccataactctcattcttgtcctccaaagcacatctcaaaagcaatcacccctaaactcctagacacctttatgttttctttctgagcacctcttttgtaacatgtatcaatttgtattttcattatttacttactaccggtctccttcactagactgtgagtctctgggagctggatctggttcataatgatctttgcatccctagcacctaaggttatggctggtaactattagacatccagcaaatgtttgcttaaaaaataaatacttggggccgggcatggtggctcacgcctataatcctagcactttgggaggccaaggcgggggcagatcatgaggtcaggagttcgagaccagcctaatcaacatggtgaagccctgtctctagtaaaaatacaaaaattagctggatgtggtggtgcacgcctgtaatcccagctactcaggaggctgaggcaggagaatcgcttgaactcaggagttggaggttgcagtgagctgagattgtgccactgcactccagcctgggtgacagaacaagactctgtctcatataaataaataaataaatacttgtagttcataaattattttatccctttacttgttagaatcttttgtgcttctatcataaaatcagtacttccttgggatccactatcatggctagagtttatggtttatgcttctaagacgaacagggaattccctcgtgtgctgaaatgtggttattgctgtagagatgttagctgagtgaaaggtgacaaaaaaagcctccagaaaacatcaatccaataacggaaaatagtttaggcatttttagacttgtcaagtacagctttgataattttgtttaattagaatcacgtgtgtacttcacagaagtgttattacattcaaagactgaagtaagaacccagtattttaccattagctacaggattaaaccaaatgcctctgaattcaatctagaattcactgcctggttcaaacctccaagctggtagaaccacagccttcaactgagccctgtgcagtcttatctagaaagtctccttaccacagcctaccccaccacattgtatatattcttcaaagctcagtccaggcccaaatgctcctgagactcaggccctgctcacttcatcccgctgttatctcactctcctttcccatgcctattaattatgccaaacatttctttcttatctcatcagctaatatttcatgagtatccacacatgttaatctgctttattagataagcaagtactatctagaactattgcctcctcaatatactcaagaaagtgcctagaagtcagtaagtccccattaaacatgggtgtgaatgtaaagctaatagataagagagcaaaatctctactacatgataacaaaaataatgaaatcctgtgttgataatgtcatccaaacgaacaatgcgagcccttactgaaggtacaagacaacttactattgttttctgcataaatccttatgacaggcatcaactcaaagagcacttttggctttgattcaatgagtttcatgttcctcttgtcccagccagcaccttcaagatataagccatagacatagacaccctctgtgggaggggcagaaatgtcgtccttcatccatttggtgacttcattgcaaagcaccatattgtccagagcccagcctttgttggcccgagttatttcctattcagggcagcaaaagatgaatggagcggttagaggtttgtcttaatagaaagagcataacaataatgaaagcttggctccgaatcactctaactcgaaggacgtacaatagtatttaaagaattagcaagattccctcattaaaaaaaccacatcctaattgagctaggtctactttaaaaaaaaatagaaaatcaaatcaaatacaaaaataagaaataaatattttgaaagtcgagctagcagcctgagaacaactggctgggatttatgtacatgacaatgtaactgctagtaccaaaaagagacagtcattctctgtcttattatagtctttaaaactataatgatggaaaatcctgtggaggaaaattataataacgcaacgggtgcaaatcagagctcttacctgtcgcattgcagttaaaaatccctgggggttaaaaaaacccgtcatccaaaagcagtgaggtcggccattgaaaacccacgaggtaaactggctgtttctttctataagttcagtaaaccagaaacccagtgtactagaaatccaagaagcctgcaatgaagacattaaaacaattaattgatgtaagtttaatactgcagtgtaaaccagctatgttcactgaaaaaaaaaaaagatgaaatatcaatttcacttttataatgaaaaaagtccctaagtcatgaattttccctggattctggcgtaagtgtttcaaattattctttctccttaataatagtaatgctactaagatatgatagaatatactagtcatcacatgaacatctgataaattcacagagctgttcaagatatctaacgtcaattgaatcactttccatgtaccaatatattcatcactgactctgctgtaaaggaatcaaaacaatttattggattaaatttaaaggctttcctcatttttccttaggttacaatttcaatctataacacataaaaaaggatttttattcacctaaatatgctcatggccttatcaagataaatcaacactttaaaacagatcccatggataagttgtagaagacttgctacacttaattttaacggggtaaacaacagttattttccagaatgtttatccctttagaatacatttttatttcctctcttgaaggagcaaaaaatggaaacccaagactctttatcatccacaaactatttgcatttattgcttctgactttctccctgaattcacctgtggaacttccattatgacaactggcatgaatatgtcattaatgtcatcagcagcagcagtgtaaggtatcttcaaatcatagattataacattttactgtaattgcaatattttatgtatgaataaatgtagtaatcaacctgggtataacacttgaatttcaaataccttaagaattaatttgcctatttttcaagagttattgagattccaaagtctgataataagctgagaagaataaaaacctgaataaaatgatcataatttaagaattaaatcactcattgtctgctatctttataggtctgttaactaaaagagatgtgtgtttatactacgttcggtctgagggcagagggagccgctaatgagagagtgcccctgacagggattcctgttccagagcctcctgggtcctaccgaggtgggtgatctggtttggtagggaaggaactcccaatggccactgatctggaagaatctccctctgtccttggcaatgagaggaggcaattcagatacaaaactctctggcatggacaatggatttattaaagatgagaaggaaataaaggggtctggtcaaagctgattctgagtctctcagctatgtgatgagagggatggagggtggtgtcatcaaataacatggagaagacaagaagcagcagtcctactcactatatgctgcctgcagaactcactgccttgtaatctgctgaagcccgggatgacatacctgaggctcagcaccaaacaagtcctatcaccttcccatttagccaagtaacctacagaggccaaccctctatcctcccacccaccaacctcacgtctgtaggctgccctctctgtgcagcccccaacctgacgcaatccccctctgtccttggcaataagaagggacaagcctccctcccaagcctttccactctaccttcagcatctttagtgccatgatcagaaaactcttctagatcctccacctcattctggaacattctctccatcccttctcttaactgaagtctgccccccaccccacaccctctacccaggacagactgcttccctcacagccttctccaaatgtaggctactgctttcctcatactcaacaaccctcagggccaggagaagaggaggtgacctcatgccaggcactgttctaagcacttcacacacatcaactcatttaatcctcacaataatgctaggaattatataatgctattatttcccttttacagataaggaaactgaggcacaacaaggcaactagtgtaccccaagttagcccataagagacatgatttgaacctgggtattctggccaagtaagtgcatactcaaaacccatagactacctttatttactttcattaatcattctaggtgaattcagcatccatgtgaatgatgcatttaacatcttattatcttatctcatgaccctctgctctctaatgaccctgatgtccattccatttcattcctctgctcccatgctctcatgttaaattttgtcatcctcaaacagtagcctgttgggaggtgccttttttccactcctatatttccttctatggggagagagctcctttcatataacattccaagatccttgaccctctcattctccccactcccaggagataaagaaattcatctggtttctggctgtttcagagacacattctgctcatcagatgtcccatgtgccccctatacttctcagcctcacatgcagttaggttgggtccaaggctctagttctgatctacagactgtgaatgaaagtggcatgggtcacttcctaatccagaaagtctagacctggggtgccttgtccatctcccttccctctgctgtgatgacttcagaggccacatgctccaggtggtacagctcccagatgacaaggcctccacaatgagggtcccagagtaactgtctggacccaaggatgcacccagctggtgaggggcataaggaagtagggtgcagctataacagcagctcctgaagtatgatcagtgacttggcactagggcagcagcaggttggagaagccacagcagcggtggaaagacagagatacagttaggaagcccagccagccagccccttctgcttttattactgggggtagcagggggaaagggaccacacactctcttctgctcccacactctcttctgctcccacactctcttgtgctcctgcacactctcgcttcacagggaagtctctgtagaggaagctgtctagtgtagtgctgctggtgggtaagtctgtctgataccaaataccgttttaaaaccccaaaactcaccttccagcagatggaagccactttgttcaatatcagctttatcagtaaatgttctctaatctgcaccactccttttctgccatttaattgctttggaattcaggcggagaaaagagctagttatttagccgccttaagaaatccaacatgcaccacccccattccacattccattcttcaaccacaacctccacttctagttcacttgttcaaggacagtcctttgacctaagcatagtatccggttctttggttccatgattttcacctcatccataaattttgtcccatctccattatgctaggtgaaataagccaggcacagaaaggcaaacactacatcatcttacctatatgtggagcctgaaagagttgaactcatagaaatagagagtagaatggtggttaccagagactagagggtggagtgaggagggagggaataggaagttgttgatcaaagggtataaaatttcagttagataggagaagtatgttcaaaagatctattttacaacaaggtgactatagtttataccaatagacaattttttttttttttctgagagggagtctcgctctgtcacccaggctggagggcagtggtgcgaccttggctcactgcaggttccgcctcccaggttcacgccattctcctgccacagcctcccgagtagctgggactacagatgcatgctgccacacccagctaattttttgtagtttttttagtagagacggggtttcaccgtgctagccaggatggtcttgatctcctgaccttgtgatccgcctgccttggcctcccaaagtgctggattacaggcatgagccactgcgcccggctgcaatggactgtattcttgaaaattgctgagagtggcttttaggcctgaaccacaagaaaatgttaattaagtatgtgaggtaatgcctatgttaattagcccagcttagccattctacagcatacatatctttcaaaacaacatgtagcacaccataaatatatataatttttgtcaagtaaaataaattttaaaataagtctttaacagtttttgtcccatctcctctcctctcgtcttcaccttccatcattataatctccctgttgagaatggcttccatgacctagctacctctcccactatgggttgaattgtgtcccctcaaaaccatacattgaagtcctaacccccagcacctaacaacgtgatcttatgcgggaacagggtctttacagaggaaatcaagtgaaaatgaaggcataagcgtgaccctaatccagtatgttgctgtccttataaaagggaaatttggacacagagacagatgtgcatagagggaagatgatgtgaatgtacacaaggcaaagaaaatcatatcttcacaagacaaagggagagactggactaggactgccacaagccaaggagctcctggggccaccagaaagtagaatgaagcaaagaaggatgctcttctagacactctgaagggagcacggctggccaacagttctattttggacttgccacctccagaattgcaagaaaacaaacttctgttgcttaagccacccagtcggtggtactttgttatggcagtcaaaaaatcctaccacacctgccactgcactctccaggtgggtgtccaacacggaagctcctcaagtgtctaccttcccaggcctactcctggcaattgaagccagttggaggcgatgcacaccagtgaaagccggtttcattcacatgcataacttgagatctcaaaggggtgaatcctgttgcctttccatgcctgcatttctgtcttgatttccccctccttccaacctttaggtgtagcagggcaagtgaatgaggaagtggagcagaagtgaaaatctagggagcaggacattgggagtgatctgtcaggtcagccctgcttgggttcatgctgtgggtgtggagtcccccagacaatggcaggagtcagatggaaaggaagccatggggcagatccagattttcccaagaaataggttatagaagacagctacacctcccactcttttcctacgtattttttcaccataattaatcttagcaagttcacttacatctccccataacatgggtgtgcatgcacatcacacacagacacatgcacacacaaatacagaacaaagagaagaataccatttaggctccatcccttcaaatgtcctctactaaaatacacttattttcctacttacaaagacactcaggaactcactttacttttccaagtgaaaaattattccttaaaaccgtatctgtctttagcacaattactaacaagtaaccagtgagcatgctgttaaattcttatccttttattttgatatatacatactacatactgtatttacagatatagtgataccagagcagggcagggaagtgctgggtagagaagggcagggtccctggcgaaggctccaccctcaggcttatgcccaaagacctacctaagtgagaacaggcactcttgttttcgtgcccaaatgttgcattttccaagaccactctggcccaccatgccccgcatcctgtgcccatataaacccaagggaccatagcgggcacacacacaagtggctggatgttgagaggagtagaagcgcagaagggcacactgacagacaccagcatatactggcaggaccaacagacaccgctgacagcgggacgacgtggaatttgctcaggcatggtcagagaagagtccggtcactgggcggcccaactccaggggaagaccaccttcccactccatcccccttctggctccccatccaccttgctgagagcaacttccaccactcaataaaaccttgcacccgacctctaagcccacatgtgaggcaatttttccagtacactagagcaagaacccaggaaacagaaagccctctgtccttgcgataaagagggtctaattgagctgattaacgcgagccatctgcagatggcaaaactgaaagagtacactgtaacacatgcccattcgggagctgtaaacactaaccctagacactgccatggggttggagccccagaacagtccctacaacctgcccctctgcatgctccccctagggatttcagcagcagggcacagaaaacccagccacacccctgtcacacgccctgtgagggggataagggaactcctccgatttcgacagcatgtagcagaaactttattttttttttccttttggtgtgacttttgatgttagggtgaggcatgtttccttctatgaaaccaacatcatggactttggagtccaggagcttgggtttaaattctgattcttggactacttagatgtgtaatctgagaaaagacttaacctgtcccaaacttaagtttctcatctgtaaaataagagcagtaaaatacaaaatttaagtaaaataacgcatgtaaatgccctagcagagaacctgattcgtgggatttgctaaaaaaaaacttccttccctacctatggtctaaaaatacagggctacagggggcttcgtccctgtgcaaaagaatcatgttgagtaaattatcctttcatgctttccacttgccaattacaactcttcacaatcataagtgaacaggcagaataacagcaggcttatacgtacttttttccaccaagcagggattctagcatcaaacatgcaatccaatgcatctcgcagattttcgctcatgatgatggtgccatcaatagcaagtttcagctcagtgagggtgctgcggacaaggctgagtaccctttgcattctgtctatttcctgcctgaggaaaatgttcataggctggaatggccccatcttctgcagcctctcttttacctgccatggagacattcaaagcacatgttaacaattagctactaaggattttatagacctggtgccctggggcctctgaacaggcccaaattcttactattccataaataataagcttctaatttattgcatggcaaaaagaaaaaaaaaaagaaaagaaaacagaaaaaagtatctgttagatgaccagcccgaattttcatgccatgtgggaaggaacaggcagccatgaattcacagaagaatgtaaaatgcatgaccacaaccatgcagtcttccaaacagcaaatgcacttattgggaaactccctttctgagaatccgagctctttcaaacccacatgtggacacacacaagcaaacatgtacacacacacacaaccattctgctggctatttcaaaaaactagaattctcttttaagagctttctgttttttccatcaaagcatccatccatccccccaaccattcattatcatcctacaagtatttattgagagtcttctatgtatcagatattgtgttaggctgagttgctataacctaaggtagcactgacaaattcagcaaaaggctggagactcttctaactcctgctacttaccatgtttatttatgtagttatcattctatttttagacatttttatcacttcctaactatttcaacccctgttagacacgaatgacgcctttcctgatcctataatgaagagtgcttatgaaagctgataacagtattgatttttctccaagcaagtgatcagaggttattccagggacattatccccttgactaaaggtccttaagttcagtctgtagtattagcagccaaaattgcctgcttagtagaaaacagtggggtacaaaagacacaaaatgctacaggattcctcttgaaaatgagatacaaaagggaaaaatacaaagaaatagggtggctcatgttagaagcaccaaatgattgtccaggtcatctcttaaaactatatggaaaatcagctacctcttagtcttggtttaatcaaagatttttatttttttattttttattttgtaatttaaaaaaaaaaatttgtgagtgcatatgtaattgaattgtttgtaactcaaaggataattgaagatttaaaaaaatactatcagggtaactctttccacaatactcattaagatgttaaaaaagaaaacacctgggggacagaggcaagactagattgcagctttgactcggatgggcagagcagtgttcagaggcttgcattgtgaacattagctccggatctactccaagaacaaagcagcaatccctagaggacccacagactctgtgaaggaggcggtctgctcctgcaggactcaggagacaccccaaatactgtgagtgccccaactgcagaagtgggaaagggagagcctcctctcctgaacacacacccccactgaagaaactgaagtagccacagcaagacaagcctaaggagaggctgagatcagacacacctagccttgcccctacttggtggtccttccctacccaccctggtagtggaagacaaacggcatataatcttgggagttctagggccctgcctattgccggtttctcttcatactaccacagctgatgctctctggaaagcaccacctcctgacaggaggtcaaccagcacaaaaacagagcattaaaccaccaaagctaagaaccctcacggagtccattgcaccccaccgccaactccgccagaacaaatgctgctatctgcagctgcgagacccacagacaaggttcacatcacaagactgtgcagaaaacccccagtaccagcccagagccaggtagacttgctgggtggctagacccagaagagagacaacaatcactgcagctcggctcacaggaagccacatccataggaaaagggggagactactacatcaagggaacaccctgtgggacaaaagaatctgaacaacagccttcagcctaagaccttctctctgacagagcctactcaaatgagaaggaaccagaaaaccaactctggtaatatgacaaaaattgacattctaatgtcacacctcaaggaactagagaaacaagaagaaaccaaactcaaacccagcagaagaaaggaaataaccaagatcagagcagaactaaatgaaattgaaacaaaacaaagcaatacaaaaggtaaatgaaacaaaaagctggttctttgaaaagaaacaaaaagctggttctttgaaaagataaataaaatagatagaccattagcaagattcaccaagaaaagaagagagaaaatccaaataacctcactgagaaacaaaacaggcgatattacaactgacaccactgaaatacaaaaggtcattcaaggctattatgaacacctttacacacataaaccagaacacctagaagagataggtaaattcctggaaaaatacagccctcctagcttttatcaggaagaattagataaccctgaagagaccaataacaggcagtgagattgaaatggtaatttaaaaattaccaacataaaaaaatctaagaccagaaggattcacagcagaattctgctagacattcaaagaagaattggtaccaatccttttgacactattctacaagatagagaaagaagaaaccctccttaattcattctatgaagccagcatcaccctaataccaaaatcaggaaaggacatacccaaaaatgaaaactacagactgatatcctcgatggacatagatgctaaaatccttaacaaaatactagctaactgaatccaacaacatatcaaaaagataacccagcatgatcaagtggctttcataccagggatgcagggatggtttaacatacgcaagtcaataaatgtgatacaccacataaacagaattaaaaacaaaaatcacatgatcatcccaatagatgcagaaaaagcattcaacaaaatccagcatcgctctatgattaaaagtctcaacaaaatcggcatacaagggatatacctcaatgtaataaaagccatctatgacaaacccacaaccaacataatattgaatggggaaaacttgaaagcattccctctgagaaccagaacaagacaaggatgcccactctcatcactcctcttcaatacagcactggaagtcctggccagagcaatcagtcaagagaaataaataaagagcatccaaatcagtaaagaggaagtcaaactgtcactgcttgctgacgatatgatcgcttgccttgaaaaccctaaagactcctccagaaagctcttggaactgatacaagaaatcagcaaagtttctagatacaagattaatgtacacaaatcacaaatcagtagctcttctataccaacagtgaccaagtggagaatcaaatcaagaacgcaaccccttttacaatagctgcaaaaaaataaaatacttaggaatatatgtaaccaagaagtcaaaagacctctacaaggaaaactacaaaacaatgctgaaagaaatcacagacaacacaaacaaatggaaatacatttcatggtcatggatgggtagaatcaaaatgaccacactgccaaaagcaatctacaaattcaatgcaatccctatcaaaataccaccatcattcttcaaagaatgagaaacaacaattctaaacttcatatgtaaccaaaaaagagcctgcctagccaaagcaagactaactacaaagaacaaatcaggaggcatcatacaacatggtactggtataaaaataggcacatagaccaactgaatagaacagagaacccagaaataaacccaaatacttacagccaactgatttcgacaaagcaaacaaaaacctaaagtggggaaaggacacccttttcaaaaaatggtgatgggataattggctaaccacatgtataagaataaaactggaccctcatctctcaccttatacaaaaatcaactcaagatggattaaggacttaaatctaagacctgaaactacaaaaattctcgacaataacattggaaaaacccttctagacatcagcttaggcaaggatttcatgaccaagaactcaaaagcaaatgcaataacaacaaagatatatagttgggacctaattaaactaaagagcctttgcatggcaaaaggaacagtcagcagagtgaacaaacaacccacagagtgggagaaaaatcttcacaatctatacatctgacaaagaactaatatccagaatcacaacgaactcaaacaaatcagtaagaaaaaaacaaacaatcccatccaaaagtgggctaagcatatgaataggcaattctcaaaagaagatatacaagtagccaacaagcatatgaaaaaaatgctcaacatcactaatgatcagggaaatgcaaatcaaaaccacaacgcgacaacaacttactcctgcaagaatggccataatcgaaaaatcaaaaaacagtagatgttggcatggatgcagtgatcaaggaacacttccacactgctggtgggaatgtaaactagaacagccactatggaaaacagtgtgaagattcctttaaaaagtagaactaccatttgatccagcaatcccactactgggtatctacccagaagaaaataagtcattctacaaaaaagatacttgcacatgcatgtttacagcagcacaattcacaactgcaaaatcgtggaaccaacccatcaattaacgaatgtataaagaaactgtggtgtgtgtgtgtatatatatatatatatacacacacactgacatatatataccgacatatatatataccgacatatatatatatatacggacatatatatgtatataccgacatatatatataccgacatatatatgtatataccaacatatatatataccgacatatatataccgacatatatataccaacatatatataccgacatatatatataccgacatatatataccgacatatatatataccgacatatatatactgacatatatatataccgacatatatatatacactgacatatatatatacaccgacatatatatatatacatcgacatatatatatatatatatatatatatatatatacacacaccgatatatatatatatatgatggaatactactcagccataaaaaggaatgaattaacagcatttggagcgatctggatgagattgaagactattatcctaagtgaagtaactcaggaatggaaagccaatcatatgttctcactgatatgtgggagctaagctatgaggacgcaaaggcataagaatgatacaatggactttggggacttggggggaagagtgtgaggggggcgaggaataaaagattacaaatatggtgcatcgcatactgcttaggtgatgggttcaccaatatctcacaaatcaccactaaagaacttactcatgtaaccaaataccacctgtaccccaataactcatgaaaaaaaacttttgaaaattaattcaatttaaaaagatgtcaaaaaattaactttcatcatcataaatttgcttagaaactacttacatactaaaaatatcaattttcaaaactaatgagatgaagaagctgcagaggtaatgatataaatgtagactctctgaaataaagaaggtctgaattttaaggtgtgcattaaactacataaaatgtatttttgaataatcaggtgttttaataatacttcgctttattttgaacaaatggcaatgtaaagtacctcagggaaggttcagaaaagcagtcctaatccatcagtacacacctgtaaatcaatcataagtattaacattctcaacaggtttccttatggtttatatattgaaaagattatgttacattcatggaggcaaaaacttctttttctggttctttaagaagctggtttttaaaagaatgttttttaatttcaggaaaatcattttttgccctcctttcttcttcctcactctcccaaccgaagatatgcaaccccagctgacattttgtcaggatttcatcaactcacttcaaaggggacatagtctgggggcagcttctccagcatatcatcagccagccgggccaccaccgcctcccgggtctcatcccctccaccagaggtgtccttgggttggatgcctaggatggtgtccagcacgtccttggccagcttgctctggtaggtgatgtcagcattggggtgcagcccaaacacctcagggctgtcataggcaggcaaactctgaacaacagacaccccagataagcacagactgccaacataagcaccgtctaaattacactattttaggaaacaaaaatgcttctatgagggtatgcatttacttaagtcttattggtgtcaagctacaaactcaataatttctccagaaaagaatcaaatttcctttaaaaaaacaattaacattgagaaacagacagtaggctcatggctctttacagtctgcacctcaaacaaaatttaatcaagagagactgtcttgttataaaatatgtgagatagaaagggagctgtggattggtgttttgctttatgacagtctaatagacttcaaaccagttgtccaaatcaatgttgtataactaatggttattatgtttagaagataccaggaaatgacagctttagtaatcgtggtccaaataaaggcagcacgtgggagtcatacccacccagggaaaaatacagagactaggaaaagagagaaactgagaaagcaacagagtcagagagaaaaacagagacagagatggtgtgggacacaggcagaagcaggagaagcaggcaaaaagatcccccaacggtttgaaaaaaaagaaaatttacggacaatttgacacatatttctatgtatgaatcttatccttaacttaattatttgagtcatactcgtatttccctcccttcttctccctcattttattccctcttgcataatatcttcttatgagctacctcaaataaactgtgagatggggtatatataaaaatatatgtacaggcacccccaaatttataccttcatggccacttttcttattcagtgctgatgatttaaagatacatgcagtacagtaaaacaaatatatttgctgatttgaattaataaaagtgcagaggcggtaatatatgataaactcattacatttgtatatcaaagcaacatgtaaatatactgataaatttagccctctggggctgttatgttttagtttgtttactctgagataaatcttcgatagagaccaaagagactgctaaataatgatataatgaattttaggtatagagaaaggagacgcagtcaccttgaaaatcagaattttttccccacctattcccaaactgcctgtagaaatctacctattccttcttatgtcagtgcttctcaacaagcgacaattttgccccccagaggacatttggcaatttcaggagacatttttggttcttacaattgggtatggggttgttattggcatcccgtggatagaggcctgggatgctgctcaacagcacaggccagccccctacaacacagagtgatccaaccctgaatgtcaatagtgccaaggttgagaaaccctgtcctagaggaggttcttacacaaagcagcttcctggacatatccataggctgtccattaggccagggttaaggaacagatgtcatgggatttgtcaaatggattggaaaacagaacaaattgggtctagaagctgcctttgctctactgctgtggcagccgaagtttcacagacagagaactccaggtgatttgtgtaggtctcctagttctaaatctgcctaatctatcatcttcctcaaagaaaattcctccctggggcattaaaaaagaggggggatggaaacacgattcacacaaaacacacactcagaacaaatataaacattttaatcatccattgagtataaaaatatgaagaaagccttcacagcaaaagcattagtatatatcaccattaaaatgtattgtaaaagcaatatagacagtgtaattaatacccaaaactcaagtggctacagatatttgctctatgcataaaattctgaagttgacaaacctggatatactgaagatagttatccactgtgctgcattttggaatattgtatccttggtaaaaactgaaatctggtccaaacatattttcactgaaccaaaccttagcaaatgtgttcaacaatctcttatcatagtcgtcagtgactctgcctccatattgaatctctcctatcatgtagcggatggtggtccaggagacaccctgggaaattttatagaataattatgtagaactgactaccgttgcattattatttccctgccaagtcacacccatgtattcactttcaacatcattcagtcagtcactcttcatcagtactgcaaagagaaagtgcagaaagaaaagtaaaaaggtaaagaagagtagttactcagtgctcaggtccatgatttgaaatagacttccttgatgcattcgtatgttttcatacttcaatataaatagaaaatagtgtttgctttttgagggtattgaggcagttctttagaaagcacacacttccaactgatctggactcccattttcattttccaggattttgaagaacaagcttccccacccacaccccctgagaacaggccccttgaggctgtcttctttggaatgtcaactcacttttgagaaataaaataataatcaaaatttgatcaatttttcctgaaatcaagaggcaagtgtgacccaaattgctatgacttaaagatgactttgcaagcacagcaaattctcttatataatttacgccaaagctaggaggtcccgtgagcttgatggcccaagcccacagccactagaggcatgaggcagcatgcgcggcagtacctttttgacatccatgtcatccaagtggttttggatgaactgcacagtggcattaaagtccgcttggttaaattcgtaggggatattccaccccagggcaccgaacttgcgcctctcctggacagtggagtgcaggaaagccactgcgtacagcatgggcttccactgggacccagagctcacgtccagcaggtcttggctgacacctgttgtggtcagttgggtgaaaaatgtatcatctctcaaatgtctttattttctactacttttataagtaatcatttttgtaaatccctgatattaaaattcacttactttggattgtttttatgacactcatgtgacaataataatttaacttttgggtgtccagaggccatttctctctgaaaaatcttcaaagagactttggggaggggaggagcttgctaacatgggtcaacttcctgccaatctaacaagatcatgtgggggtaaaatcaagctggaagggtaacgacagttaaataaattctgccactattactataactactactctattattattactgttgttttgagcatatacttggggcatatacttttaactaattttatattaattaagatagtatatatagaagccctttgcacctgagtacatgctccaaataataatgattgatacatatgcatatactatattgtatatataattagatttatttatttattttttactgccattatccttccacctctcttttatccccacattatcttatagattggcaggaatttgggccttgttagcaactccccaaaagtctctttgcaggttttccagattgaaatacaataattatatttattatggttatcaaatacatgattttagttacaatttatttcaattctcctagagagattctcttgtccctattttatatatgagaaaattgaaactcagattgaatgactcacacccaaaagaacaaagtaattgtcaacagcaagggccagaatcaggatttctgactgaaagttccatgttcttttcatgaccacaagccccatacataaagctatgaagcagaggaagcaatggccaagagagcgacctcagccccagtcatgatgggggcatttgggcctgagtttgctgccactggatttttaacttagctaccttctgacatatggccctaatgaaaggcaggcaggcatgactttaattcagactctcctcttggaagagactactgtactactttaagtatggagcataaagaccataaatgacaaaattgttcatttttgatattaattatgtctagctggagaacagcatgggcttaaatagggcagtactgggaaaataggaaactagaaggtgggaatcatgagctctgattctttcacactgccgggacatattcacaaaagaggaccatcacctccccatcaggttaaacagtagtactatttgctataactgtatcctagctaatccttttataatttttttaggaaaacaatttaagtaaggaaactcctgtagactcgcaagtatttctggactcaccactatatgttcttttcagtcctgcccggagtccttgtggaggatcgttggcaaatttaatggacatctgaaggagtgtaatgggaaactgcttatgagcctcggtggtcatccagaggcggaacgcatcatgtacaagctcagtttctatgattatgtccatcagctcatccatgaaatcaagtcccagatggcagttctgcagaagtgcccatcctccctgtcaatagcagtaaacggaaattaggtagttttgtatttcacccaaattctaaattattacattctttagaaattaagtaattaaaatttaataggaaaacactaaccattttaaattaatccaggtcaaatctaagaaaacaaaaatgtttaattgcgataagctattttatttttagtccatgcatttgttccagtatacactagtatgcaattgtaccaatactatatggtcgcaatcatgaatataatcaaagttaaacataaaaggacttccaagtaaagatggctgattgaaaacatccatttaactcagatccctccccaaattccattaaaactacaatgaagaaaatttttaaaggcatgaactcttaaggacaatgacagagagagtgaaggcattatcattaacatttaaaagaggttcaggaaagttgaatcctaagctagcatttagggaaatctgagatgcaacctgatttataccacataactccccaaattctgcctgccttaatgaaaaatgagaagttgattttctacagaaggcaaaacagggtctagattggaggataccagcacattgagggaataggtaccacactgaaaccaggtgaaagaatgattgcctgctgaattttgagacctgctacttcctgcctcccactagttctcagaatcctggcaactgagcatacaccctttagcatgtggaagaaccttccctgggaatctgaccacactaagaagagaaagagccttagaaaataataagccatatattttgcctgaattataccataaggataggaaggtcttcgtgtaatgcaactcaggcaaaattgggggtcatgtaacaataatttcctcaatatctaatctataaaatatttttgctaaaatcatctacaagatccagatcataatcttgaggtgtttttctataacccatcttagatcactgactagagctgcatgagttgtctttcaaaaagaaaaaacaccaaaaaaaaaaaaaaaacaagcactagatctaaagtcttagcagagttacacgtaaaactgataatttagagatttcacattttccttatattttcttcagaaatttacagtactgctgaataagttatctaaacattaccgtttgaaaatttcaactgacaccgtccacaattcaaaacaaaaaggaaattcaatataaaacacagcaactacaaaaagacttcagttcttctcttttacccagcatagaagtgaaccctgacctgagtttccttcttttgtattttgctttgttttggtttttgagaaagtgtcttgttctgtcacccaggctggactgcagtgactgcagcctctaccttcccagatcaagtgatcctcccacctcagactccaaagtagatgggcccacaggcacaggccaccacgtccagttaatttttttttgtaaagatggggtctatgttgcccaagctggtcttgaactcctgagctcaagcaatccttagcctcggcctcccaaagtgctgagattacagttgtgaggcattgcacccaggtgatctaaacttcttaggtgagaactctgatattccatcttcacccacagaatcccatttctttgggattccattctctgcattaaatgttttgttttcatctaactgagtagaccatccactttgctatccttgggtagttgatttatttgccacattgcctcaaaagtttcaatgttagcttaaatttaaaaaaaaaacgctgtttagtaaacagcaggcagcatgtaaatttaaactcctaatgatttatatttttcttctgcattgctattctataacctgtaatatgaacagcatggcacaaaagtagactattcagccttacgttcgccatggtctgctgcaagagcttccgagcatggacttcctggccctggcccatggacacataacgggtttctatttttaatctcttccccaaggcaatgatggaatctgtggggtctgagcccatagacaggagacagatgagtggcgtccgtggatcagattcctcccacgtcttctccaagtctaaaataacaccttcggcatatttttctcccatggagtccacgatgtacttgcgggcctgccaaaaacagtatacaagtcagtaaaagtcattccaactctttcatgtagataatgtagtgtggtttccaaaattcatttttgtaattatctcagtgatgtccacagtaaccctgtcaggcaaacagggtagagactgtttttcatatttgtttgtttatatctccattctataggtgggaaaactgtgttgcttacccagtacaaaatcagagtgtcaaaagaaccaaagttgtatgactcctggtttgaaacccatttcaatatactgcttgcttcctgctagaccagaaaataaaaatactgggaaactattgtttaggatgctctaaggcaaatatatttgcatttaaataatcaagtaagcaacacaatacctagaatgtaatgggtactgattaaatagataattattgagtgactatttttatgaaatatattggatatttgttgaatgaatgaattagtttttaaagatttaatccataatctctctcctcatcattgtcgtcattccttcccacatttggctcatccctttactgttaattttgttttgaatgaaatccatactcgaaatatcacagattttgtcaactttattacaaccatagaaaaaaattatggtaacaacaaagtcctttttcaaatgaggtaaaagagttataatttatttttcaacaaatggtattgtgaatatgatccttagtctatattctccaccttctaaataattaaattccctcaaaaacatttttcctcctattctggtggtcttcttccaccttagatgggtaaaacccaagtttctctccccagcagcattctccacaataatcattttcacataacttaggcgtgggtgcaacatgacctgcaactctcccaagggctaggcaggtgagcctccccactccaattcccggagaaacacaaaacagcttcagatggagcttcccttgaatcagacagatttcagatagacccggatcaaaggggagccagagctggttcagtcattatccttgactttaaaacatcagagtttgatttacagccagtaatctgggctcatccctcatcttcgatatcttgctatcccctattcatcctcaaaatgtaccccaagcatctgagcttacaaattggtgcgatgtttcccacttgtgtttgccctcttttgtgggttacaatgagagagaagtggccaccacagaggaatctcctggcttactacgtcctctcatagcttggtaagagaggtacaatgggtgccacatgagtctagactgttgaacgactggcttggtcctactttctgattccacctggtgtgtggagacttctcaaacaagcttcatcattcatatagccaggtaaagagtgtctgaaaattggtcatcagggaacgtccatcttcctcatgagagtgcaaaacacaaaaagaggagcatttacattccctaactcataccagctaattcagaaacagctggaccattttactgtggatctcttctccttcttctaaagtcataatcctcctcataatgtccattcccccataccaatggcagattaagaggcatgccaactttgtagaatacacaggatttctgccttggcaactatttctagatggctttggggaaagacctctacctggtttcccaaaggaacaagaaatggtggtcaggccctctttgacaggactaggccactggcaatgaaatgaccaaacagcaccttggcccctcactcacagagaggctcaccccttctgaccttcctctctattagttcagtgcctgggaagttttgaggaggtgaatttcagtccagttgaatttgaggcacaggatgctatttattttcatacctctcaatactttttctaggttggacagatccaatatctaaatctctaacttgcatataaaagcctacatatttttctacagcctctggcaggtgtttaataagtttgcctgatatgttctttgacttccccaaatgtctactccatgtacacattcagtcacagtcactgaagcagggagtcctgtgatcaggaaggacttcaaaggctggacactgaggcattccacagttgcagctgtttctcagccacatgttccgccatcactgcatctctatagtgcaactcatcaagattcaagtactttctaccccaagatagcaaggggctcaacatggccagttctgccatataactcagcattgacccagttcaggtattaccatccaagccatgagctaacatgttagaatactatggggccagatggtaaatattttagactttggtggccaaatcatctctattgcaactattcaactccgccattgttgcacaaaagcagtcataggcacacaaataaaaagcatggctatgttccaataaattgttagagacactgaaatgtgaaagttatacaatcttcacttatcacaaaatattagtcttctggtgatttttttcaggcatttaaaaatataattcttaagtcaccagctgagcataaacagacagttggccaaatgttgttggcaggccctagtttgccaacctctggaatagataaccacagggaaggctgcttcacttatatctggagaagggacctttggtcataattccagttcctgggcggggacattcttaaatagggtcacagtcatggttcaaattggctccaagcctaagggttgtaatgagtctgtggggcaaatgtgtaatatgcaaggatgctcagcaatcccagggaaggccccactgcggtaggcatggatctgaaaccagatatgcatgcattagaaagagtacatttcttcatcttcttttctccaacttcaacccaacaccctgcattatctcaccagccagcaggacaataattccaggcattactcggtctccccatcttctcaaagttttgggagcccatcccttgcaccagtgtgccttggatgcaggacacggggtcaaaggaaattattttggagattcaagatttaaggactgccctgctgtgtttcagacttgcatagggcctactattcctttcttttggccaatttctcccttctggaatggtaatatttacccaatgccttactaccattgtatcttgggagtaaataatgtgttttgattttacaggctcacaggtgggaggagatgagtctcagagagacttaggactttggacttgatgctgtaacaagttaagactttaggggacagttaggaagagatgattgtattttgcaatgtaagaaggacatgggatttgaggggccatgggaggaataatatagtttgaatgtttgcccccttcaaatctcatgttgaaatgtaatccccagtgatgaaagtggggcctggtgggaggtgtttgggtcatagaggtgagtccctcatgaatggcttggtgctgtactcatgagagtgagtgagttcttcccagatctggttgtttaaaagtatgcagcatctcccccactctcttgctctggctctcgccatatgacatgccagctcctccttcaccttctgccatgattgaaagtttcctgaagcctcaccagaagctgagcagatgccagccccatgcttcctgtacaacctgcagaaccatgagccaattaaacctcttttctttataaattacccagtctcagatatttatttatagcaacgcacaaactaacaaaccatgttagataattcacctcatgcaacagatataaaccttggtccatgaccctctcctctgtcccaggcagtgcaacaggttttaggaacagatcagtggacaaatggcccagcccttatgaagcttgccccccacctccatgccaggatgagacatacattgagcaagtaatagcaaaataactagtttgaaggatttatgacttgcagggtgacatgaaagtatgaaactgattaatcttgcaggaatatgtcagagaaggctcccttgtgaaagaagcatttaagctgttgcttggatgatgagtgggatttactgaggcaaagaggacagctaagtgggtcagagcatgtgcattctatgcagaagaaacatatgcagagaccctgaaggagcaaagagcaagtcactggctagggacaggaggacacccataataactgatgtaagagttaattcaggtgtggcaagccaggtttctgcacagcctgccagcctttaaagaaagccaacaccccactgtggagtgctgcattttcatacactgctcttcacacagctctgcagaacttgttcatcccaatatgtggtcccaatgcaacagattcagcctttcaatgggggagaaaatgaacaaataacctgcacacctgtgccaacctccctttgttgagtattttttttttgagatggagtctcaccctggcacctaggctgggtgcagtggcacgatctcagttcactgcaagctccactttccaagttcaagcgattctcctgcctcagcctcccaagtagctggcattacaggtgccaccaccatgcctggctaatttttgcatttttagcagaaatgcggtttcaccatgttggccagactggtcttgaacccctgacctcgtgatccacctgcctcagcctcccaaagtgctgggattacaggtgtgagccaccgcgcctgacctgttgaggatttttaagacacaaatgtgtacctctcaggagacacactcggacagtgcagcatttttgcaatcaggcatgcacagatgtggacagtcacactcagccaaaatgcagagaataagaaatgcatatagcctgatgctgcctatggggaatgggattgaatgtatctacattgtagacctactaatatgcttcccagaaagttgtcaggttgaaaatcacaaaaggattctaaaaggagaataagaacttgagagaacatttatccaacaggccttctaaaccttgtttaggacctgggcactataagggccatgggcagatactgcaggacttgaaaagccaatgaatggcaccatatttgcatttcttctagtgtgtgcagagtagactagagtatacaagaagaaatgtaaggagaacaggtatgaggccatggctgtggtaagtccagggatcggagaagctaaagggatcggatgaagataaagttacaaaaaagagttacttaaatttcagcattgaagcaaatatagctttctatggaaaaagataagaaagagactactcaaacatttctttccacactgtccttaaataaggcaaccatttcacaattcagttgggcaggataaaagtaatgaaactgagaagaaaaactgaaaggaaaggtgatctcagtgccccgaactgtgaaactcatttttcttttctcaataaatcattgaatctggttgttttcatgattccacagtacctaagtggacttggaggtagttactccataagtttttaacactccctctggagaatgaaggagaaaatatcttacattctattataaacccaaggctattgctactccacagctcatttggaaaagcccttaaggagtcaacctgggctgaatatcagcgttaaacttttcatcataaaggcaagacacaagtccttttagtgggtaaagtcccatgatactaagccagcaaattaaaggtctttaaacagatgaatcatctggaggcaggattcacatttaaaccatatgtgaaattcagttgtaagacaaccttactgacatctagagctgtgacatttttctggggaaatgactacggtttgggcacactgtccttcccccactctattcaccctaatgcctttatgttcttcctgctttcagaaacactgttttactaccagcaaaatggagcagccatataatctttgattgaatataaaatgatataaaagaataacgcattacctgtatgttatacctatatgccaaccttagaatcatggttttctcatttactcctattgtagccataggtcagaaaaagttactaaatcacttagcccaaacatatgcctcaagacatctatttgtttacttttccatttttcacacatattgctagaaaatcacacagaggcctacaagaaaattctcactggaattcacatttaaaatattttttttaatttaaaagaaaattctctttaaaaatattctctcatttttctctttaatatggactttttacctgggcgatggttctgtcaggacaccaggatctaataaggagaagacgtctgaagcagtcaagagatttatcataggcatttggaagaggttcctcctccgggttttccttatcaaaccaaattttccacattttctcatttctcgatatctgaaaataccatgggataaaaactgtgtcatgccacccaacaatctttcagtaacaggtcatagatatgtttcatcaaacctctgacctctccagatatgtgtaaattatattccttggctatttttttattttatattatagaaagtttgacagtgtaaaatctaatgtcatttgctccaaagtcagtctatactaacatcagcctacaactacatttcaaagtagggagagtcatgggatatttaatttcttctatgcctttgtggtaacaaatttgtaaagaatacaacaaaatcaatggaaattcattttcattatttcaacgaagtccgatttgctccacaaaatcttctcatgtcaggaaccaaatctcattcacttatgtttcctcatttcccaggaccactcctgacccaaaagaagacatttaacacatgtttattattgaatgaacagctttttgatcaatactctattaatctagagtaattggaaatacgccagttaatatcatcaaatgaatgatcagacacctgctacccttaggcaactgggaaagagtaaaaggacatagtacattatcctctgcagcttaaaacaccaaagagaggcaggaattacatggtaagcagatcagaaacactgaacaaacaaataatgtctacagataaatatcatcttatgttatctggtatattccttttcatcaagggttccaatgtctttcttgggatataatcaaaggcaaatcattccaggttcatatttagaaagtaccatgtaagaataaaaataataacttctttcgatcttgaaagactacttaatattgaggggtttcgtgcataagatatcatctccagaaggtagcaacttcaatatcaatggtctaggcaaggccactgggggtaatcctattggggaataacccgaaagaatggtttgtacccctaagtacatggtagtaataataaacaccaccagtgataagccaaaacataaaaggatagcagaacataagcaaatggtcaacttaaactgaggaagtcaagaaccaactttaagacatttcctcgtcaaaaaaagccttcaacttatagctggataaagccaccctgctgccaaactcatttctctatggtcacctgattttcaataacctgtttcttggcttgtcccaattcaattctctacacccaacttccatgattccagaacatgcaaagttcatcaggagctggctgattctagaaagatgataacttctaaagataagaggccaagtgtttacaggagattcatacccaggtgcctaactaagtcaaataatgggaagggcaggagaggaagaagaagaagagggagagaaacaagaggcaagaaaggaaatttagcatttagaggcaagctgttcatatgtcttttcatttaacctctagaaagaaggaaaaggctttttaagtctatctaattatttaatctaattggatctatcagtttttctacttgtggacatccaattggtgatactaacatatggcccaggatggcactggttaaagttcctgggcacatttctacctgcaagatcagttaacgatgagcagagaatgccttatcagagtgtaagtgtgctttcaagaaggtcaagcacatgtaataccattttaagagtgacaatattaagaactatctctcttccacaaatattgtacctagtgataaatcagaaagctgctcaacatgacatcagcttaagttgattcaaagcacagttacctggtcaaggacatctgaaaactgtctgagtttgctaagttccaccaaattcagccatgttatgtccaggatccattttgatggttttggaggacaagctttaaggtctaatgaggcacctcctttaaaattaaatattaaattatcagatttcccttccttcactataaaacaatctatttagtaaaatttgtattattttaatttcagttattttactactttcacttttttaagcacagaaatataaatcatagtgagaaacatgcaacatttaataaatcaatagataattttagaaaaaactcatttaatcatcagtaatataactttggaaccaggcagatgctggattctgtcctagcttcccctggacaaggtctgagacaagccatttcatttgtctaggtctctaattccaaattagtaaaataagaataattaaacctgtgtcacaatgtatgcgtgtaaagcacacaaaacaggatagaggacatggcagagggtcactaaatgagcatcaattttcaatattaagaattgcccaatattagcacaagctaatattcaatacacactttatctagaaatgttagtagtactagatgtttgaaggattctcttctataaatcagtatattacttacatctaccttgaacacaccccaagggttccatgctgtgtcacttatgcctgtggttataccctaagctaaccacaacaaacatttccatttggtactgacccttatctttttactgatgatttaccaaagctcatgtaacccacgtaactctgacagcaatgtaacaaaaatgacaccttaaaaatgtttttgttgtccacttcagaacaactgaatgtgtgagcaatcgttattttaagaaagagttaagaataaaggataaagttaagaattaaggataaaatatactatttaataaataacatccattaaagaatatcaaggaaaatatgctctatgcattattctttctttctttctttcttttgagatggagtctcgttctgtagcccaggctggagtgcagtggcacgatctcggttcactgcaagctccgcctcccaggttcatgccattctcctgcctcagcctcctgagtagctgggactacaggcacccgccaccacgcccatctaatttttcatatttttagtgaagacgaggtttcaccgtgttagccaggatggtatcgatctcctgacctcgtggtctgcccacctcggcctcccaaagtgctgttatttttttttttttttgagatgtagtttcactcttgttgcccaggctagagtgcaatggcgtgatctcggctcacaacatctgcctcccaggttcaagcaattctcctgcctcagcctcgtgagtagcggggattacaggcatgcatgaccacgcctggctaattttgtatttttagtagaggcggggtttctccacgtttgtcaggctggtctcgaactcccgaccccaggtgatttgcccgcctcagcctccctcccaaagcactgggattaaaggcatgagccaccgcgcccggcctacgcattattcataaaatgataaaatcaatccatttggccactttaaaaatctttgtttgaacagagtaggttataaacaaatgacaatactcaagatatttattgagctaatctctattttatccaggcaccatgtacactactaaattgttattttttgccaaatccatcaaaatatatttacaatgaggtcagtatggccttgaagccaatttgaagaaaatattagctcgtaaaatgaaaacagattgttttaacaccagtgagcaaagacctaaagacaatgcattgtgttgaataaaattttgcaccttagcaactgtccattttccaacaaattgaaaagagtaagacatccaccagagggttagggaaaggctattcacagaaaggaaagagtgttcctcgcgggccagagtattattcattgtttagtagccggtaactatgtcatgactaacctgccggctcccaaagtacacaattaggcacaaatagtgattgtaacttgggggagaggacatattcctgaataatgtggtaacaaattaaatagacccttgatgaataaatagctgaaaggaataattcgaaataaattgtccagataattgagaactgtgctgttcccttctttcctcaaactcttgctttggaaaaaaaaagtaagttggagtttttaccgtaatactttgtgaaaatgatacatgcttataatgaaagttttatacaagctatgccacacaatcataaattgtcacagctaaggcagacttagagaataatctaggctgagcctttcccatcttagaaatgactgaaagaccaccatccaaatactgttgaggccaagagcagtgtcccacatctgtcatcccaggactttgggaggaaaaggcaagaggacagcttaacccagaagtttgagaccagctggggcaacataatgagacttcatctctacaaaaaatttaaaagttagctggatgtattggcatgagcttgtagtcctagctactcaggaggatcacctaagcccaggagtttgaggttacagtgagttgtgattgcaccactgcactctagcttgggtgacagagcaagactctgtcttcaaaaaaaaaaaaaaaaaatggaaatctgttgtggctattgggcttaaaagctgctacaacagaatatcacattctaggaggcactctgcttatcaacaactgaaatttatttatcacagttctggaagatgggaattccaagttcaaggcaccagtgatttggtgtctggtgagagctcacttctggttcatagaagaccatattctcactgcaattctcacatagtgcaggagctggggtctctcttgagcccctttttttgtgagagggagtcttgctctgtcacccaggctggagtgcagtggcgcaatctcggctcactgcaacctccgcctcccaggttcaaatgattctcctgcttcagtctcccaagtagctgggactacaggtgtgagccaccactcctggctaattttttttgtattttagtagagacggtgtttcaccatgttggccaggctggtcttgaactcctgacctcaagtgatctgaccacctcagccttccaaagtgctgggattacagacttgagccaccgcacctgggtgggcctctcttataagggcatcaatcccttatcttgactctgcccctatgacctaatcacctcccaaaaatccctccatctcatgccataaccttggggtttaggttttcatcatacgaattttagtcggatacaaacatttgcaccataacactatctaaataacattttaaattatgttaaatgattttaaagtccttacagagagagtttatatcaccaggtagctctcatcaacctaaccattgaagggcagatttgcaacataatcctgctccaaagtttgctctgaaactgtttcataaagcagtgttacaaacagctgttgaaagccaaagacccatgacaaccagtccaacccatacaagcatcagactaatcaaaatatctaaagtgatgaagataatatgatggccatcatttgctaagcatatcctatgtatcaggatttacataaactgtgtaaattctcaataatcctactatgtagattttactatccttgtattatagacaaggaaactggagtttgaaaagggtaaatgaccttctcaagatcaagaaagtgacaaagccaacacatattttaactctcaacttcctaactctaaatcttatgtttgctatcatgaagacaaactgtgagatgcttcacagtatttcaacaagagctggacactctcttcaaagttatttctatgtggaaatacatttcatgcctgagttgagaacgacaggaacaacaatccattgaaaagctctagaaacgggggactagagtcactgaggccagaaattagtaacatattaagggttcaccagagaaggcagctcttacatctacacatctttctctccagagactcatctgtcacttattctgatttaggaaatttggaaaataaggttcaaatatagctaaagagtaagtgtttaatggttagacacaattaaagagagagagattgtctataatttaatcatttctaagttcaaatctaaacagatgagtctttgttgctactataagatatatatatacacacacacatatgcatatgtatatgcatatgaaaatgcatttgcatatgtatgactatggacctataacccccaccagggcacagcatgtgtatacctacattccttccctactgttcccctaggggtggtcttcaagttctcctacaaacctactctccatgttaagcatgaaaatctcctgctagataaaattatgtcttatctctaaagacttggtttagaaaggtatactagatgaatctatttagaccctggcatcattttcatagtgttatgggatgaatattgtgtctccccaaaactcatatgttgaaaccctatatctcaattctgacggtcctgggaggtgaggccattgagacataattatgattagatgaggtcatgaaggtggagcccttaggaatgagattagtgcccttataatagtcactagagagcttgcttcctcttctctgctccccagcatgtgaagatgcaatgagaagacagttgtctacaacccagaagaggctcctcactagaatccactgtgctgcaccctgatctgggacttccaacttctagaactgtgaaaaataaatgtctgttgtttattagccacccagtctatagtaatttcttatagcattgagaactaagatacacagttacttcaaatatttttttcaagacattcaagaatgtgatagtgaatttatgttttccagccttccgctgggctgtttcgtttgaatggcccaggggacacggctgtgagcaatgcttcagtagatgcagaataaatcatccacaggatgagctgcacagggtcttcatccgcttcactcatcacccagtcactttgttttatctacatcacaccagcctcactccaccagaggccctgacctgatgccatcccttctgcttcagccctcttccctaaatgttcccatggccagcacctcctgctctttcaggtctttgcccacctaccgatctcttaggaatgccaccccattaaatatcccattgaatacctcacttaaagcttgaagctcctcccacttcataatgccctgtaacttcccatccctctcatcctgctctgttttccataggacttaccatcttcccactcactataaaattcatttattattttattttttttctgtaccctccctaaatctatatatgcttttcaagggtttttgttcactgacatgccccaaatacctattccatgcccaggtatacagtaggtcctcaatagatagttatcactcaagaaaagaacaaataaaatatctcatctaaatgcagtcttacataatgcaaggcaattgttataaccaaaaaatgtactgcaaagggctttcacaataactcctccatctgcacctgtgcgctatagtctctattcttatattgacctttaataagagtgagaaactcttcatgcttgactcggttcctctggatgtcaatctttagggtaagcaacaaggtgaacaggaatttgtgctcctcgtacagccctcgggcagcatacttataaacctcgtaggtcatgtgctcgatgatattagcaatcctcttgcttgtaatcgggctcttgacagacctggtgaatagaatatttaaatcaggcttatcccactgcccttttcaattgtctgtaaaaacaattgtctttaatggaaaataagtaactttggaggaagaattcttatttttacacatcaagagaaagcctcctaaatctaaaataacaagaattctctcaacatgaaataatataacagaatcccgaatgttgtctaaatcaattctacctgcagggcatcatcactcacaacgatatcttgggaattttcttgtttaacagaaacatacgaagccaaaggaatcaaatcaatggataaatagttggtagagttttctctgggcataaaatggcaaatcagaatgatttgttaacacattggtaattacactgatctgagatttaaaaaagaaaaagactcttactaacaaaggagaaggaagttataaatgtaatgtcatcattttagtgcacagatatagaattcagcttggcttcccgcgtacagacgtacctggctaaggaaaggtcaaataagcccagaaactggcgaagcgaagtctgatacatctcattaaccaagcgcatctcagtaatgaggaagtagaggatgctgccccgcgtagccactggaagacaaagagcaaggttgcatgtgctacgagagaggaaaataaatgatccatgcaaagagatcagcctaaactctaaatgaaaacaacaacttttattttaggcagtggctgcctaccagatacgggatacaaagcgatattcatttattaatatatttattatttacaacattttgtaagtaatcaactatttgtatttattaaatggtacttctcattttagaatctctagacccctcgcaacaatattttactatttttactgcaggtagaaaagacaatcaaagaaatttcaaaggttgtgttagtttaacacccagcaagcgaggtagccattagggacctcatccttaagttccagggagaagccatgcctaacctgggcttcaagtctgcaaaacaagccattgcaaagatgatgcttctgcctctctaacaataaacgacactttaattattattattattttgttgatacggagttttgctcttgtcccccaggctggagtacagtggcgtgatctcggctcactgcaacctccgcctcctgggtttaagagagtctcctgcctcagcctcctgagtagctgggattacaggcgcccaccaccatgcctggctaatttttttttctcttatatttttagtagaaacagagtttcaccatgttatccaggctggtctcatcatgttgaccaggcctgtctcacactcctgacctcagatgatctgcccacctcagcctcccaaagtgctgggattatagtcatgagcaaccatgcccggccgattatttgttaagaggaataataaaatactaaaagatagccgatccaactgaattatttagcaggtttctcttgtacaaggccaatttgcaaattggtggctgaggataaaaatctcccaagagaccacagaactaccttcctaacacaaaaactataaacaaaataccaacatagtgttaccaaacgataaataactggtgcactaattcctcagatttccctaatttgtagtcatcagattttttaaaattctccttctttactttctaacatcaaaataagttcatgagaaccttaaaggatttaccaactaacatgaatgacaagtacccaggaaatttataccattataaaaaatttttgacctccattttacggaatatttcccaacagaaattccacaaaacacctccactttgcataatcatttgtataactccctcacatccttccatttctctaattctcattcctctctcatttcattttcctgtgacatttgtctttcattaccaaactcaccaggtctgtattcctcccgggctgagttaatttgaacttctgtctcagcagaaatttctagcttctgtgtcacctcctcggctgtcctttttgtgttactcagcacgacaatgagactttcatcttctaccagggacccctgggtacttgtcaggcggtaaagcaagttatcttctagttccttcatccttcttttgtttgcagttacatcttccatcagatgagttctttctttctccaattcctattaatttgcataaatatattttctacctcaattaacaactcttgttgagtattccttaagacgttaacctacatggctgctttgaagctcccatactgtatttatcataatcaactgcaggaaatatggacatcaaaaaagaagggccgggcgcaggggctcacacctgtaatcccagcactttgggaggcagaggcgggtggatcatttgaagtcgaaagttcgagactagcctggtcaacatggtaaaaccccatctctactaaaatacaaaaaaaaatagctgggcgtggtggcgcatacctgtagtcccagcactttaggaggcagaggcgggtggatcatttgaggtcaggagtttgagaccagcctggccaacatagtgaaaacctgtctctactaaaatacaaaaaaattatctgggcatggtggctcatgcctgtagtcccagctgcttgggaagctgaagcaggagaatcccttgagccagggaggcagaggttgcagtgagctgagatcatgcaactgcactccagcctggacaacagagtgagactctaacataaaataaaataaaaaataaaatgttaaaaaaaaaaaaaaggaggaggagaagtaacagaggaaggaagaataggtgccaagcaacatgaaacctgcaaaaaatactaccagcatccctttaatcacccatttattttctcaagtcacatcagtttcaagtgattgctgtgattatatttaatattatatatataaaatcttcttttgaaggggaaatatatttgaagacaaagatatatatctctgattaaataggtttacttctgtctactttcttaagagagttccattattgtttaaatgtggttatttcaaacttgctaattgaaaaagtatccaagtctgtgaaaaactactctccgaaatcttaggcaagcaactgagctgcaactgtgagcacgtttaaattgaaaagtcttcttggcctgctgttctctccaaaagcagaaaagttttgcatcttttctgagggagctttggagacagctgggagagtgaagccttggaagactattatccttattggccttttcttcctcttggcagcttggagagggagagacagaggaagagaaggacagaaaagatggaggtggtggcaggggtgggagaaggagaaatacgtgtgacaccaagcaagccacaggaagaggaagcccaaaggcagggagacaaaacagaaatatgcttctggcaccaagtcaaattgtacatggatatcaacttgctatatgagagactctatctgtgatgctaaagaaaagaatcaaaaatggaaagaacaataaaatgatacgtacaaatttaaaatgaaacttatgtattagagagtttatttgaagagcttcctggatgtggagtccattgacaatttgcctatgtttaactgcgtttataatgtacaattcattataagtaaaatacggggaaaccagggttaagtgcaggtgacaaacagcaaaatcacaggagctttacctgtgattttgacagtgcgtttgacagttctgactggactcacggcagctacctgaacgtatggtaccaagctcacatctctagaccagcttcagaaatctacattctcaattgggtactctggatatgactcagtaggtgatatggtttggctctgtgcccccactcaaatctcaccttgaattgtaatccccacaatccccaagtgtcaagggtggcaccaggtaaaggtaatggggtcatgagggcagtttcccccatgctgttctcataacagtgagtgaattctcacaagatctgatggttttatcagcatctggcacttcccctgcttgtactcactctgtcttgccaccctgtgaagaaggtccctgcttctcctttgccttccgccatgattgtaagtttcctgaggcctccccagccatgcagaactgtgagtcaattaaacctctttcctttataaattacccagtctcgggtatttcttcataccagtgagagaatggactaatacagtaggttttatagattctactccctattgagagagccagaaatctagagtgaggcagtgatgaatcatatgaaaccatataaaacataatggactattcactgattacatgattaattacacaatttacctttgttatgatccggtatgcacacagacatggagggaaaggagaggccagacccagcccaaaccgtcactgttaaccattacgcaagttcttccctttagtggctcttacaattattcatttttagtacttagtttatgcttacgagaaacttatccccatactactccatgaattacattttgttttaaacagtatcgctatgctgatgactcccaagtttatatctcagcttcagatcatacctcctttcaactctccacttggacatctaagagacttctcctacttagcaccatcagcaaaactaaacgtctgatcctcccttcaaacatgctcaacctcacccttccacagcccagcaaatggcaacactattcttctagatgctctggccaaaacctttgaaccctgcttggtcactttcttctcctcaaattcaacaacaaattcattggcaagttctatgacctccacttcaaaatgagattcagaatctaatcatttctcactccctccactatcaccaccctggtttaaactatcattgtcacccccctctaaattaggaggtctaaacaggtctccctaccccagccttaccccctggtctactcccagcccagcagtcagaatgatgctactaaaacatacttcctctctcaaaaccctccagtggccaatctttccactcagagtgaaaggtaaagaccttaccaaggcctataaggctctaccaagctgccccctccttcattactgctgggacttcatttcctacttttctcccctttttcactttgctctagccacgtttgctatttcctacatcagtggttttcaaatttcagtgcattaggatcacctggaaggcttgtgctgtaggcctggaacagcatctgggaatttgcacttctaatcccatgtgatgtgatgctgctattccaggaaacatgctttgagactcactgtcttaaacacacaaggaactctcttgcctcagggcctctgcattagctgctgctctgtcaggtctgttcttccaaataactcactctcttcccttattcaagtcttcctcaaatgtcacattctcagtaagccccactgtgaccaccctctttaaaatgctagcccaccagctgactccccagctctcccgctcaccagtgtctgtaccttttatggcatttaccaccttctaacataatacataaattatttatatgttatgctccagggatagtttggtctgttagtctattttgttcattgataaattcctaaattagtgaaacaaagcctggtacgtagtaggcactccattaacactgcagattgaatgattaaatgttgcatctcttttcaaattgataaactgaaacacacagtgaactggaaaatctagtctttgtgccagaaatgcagatgtggaaatgctcaatctctgaaaaccatgacattaaaaataaaggaggtgttaacaaaactgcatgaaggcaaacagcaaagacccctggcctctgctttatgtttcagccagttaatcaccactgattgaatggttatagttggtaagaccccaccagactcacaactcatgctctgagcacagtgaatcaggtctgcggacattcgaggaaaggaagaattccctctttaagcaaaacagaagttcaggttttgtgtcaattcttaattctttaagatgtagcaactcaagcaaaacttgctcttatcatctttgtttccatctgttatctggttacagatgaaagctcccttagtggttatttcaattcattgattcactagatgagaatttcaaatttcagaaaatgtagaaattagtacaaacaagtgacatttaatggctgctataaaattaatttccataagcagttataataaaagccctcacattacggttgtactaggaaataaaagtgataatgaaaattcaaacaatttttattgccatatttataaatttcacacactatcactatcatttctgagttccagagggtgagcatttaaaggtcttcacctgaagacaggtaagggaagaaaagtaaagcagtagaaagagtgatggttttgacatcaggaagacatatgtttgaattacagctctcaaaacccttcagccacttgacatttgccatgttttaaaactctgcaagcctcagtattttcatccacaaaatgtatgtaaaaactgctcataggattatggtgaagatatcaccagtaatgcagctaaagtagtggctggattatgataactgctcaaaatgtctcttcccttccatcttctcccttgattcatttctggccaaattttcagaagcatgataatgcttattgtaaaaataagtagtttgaaaaatcaagttgaaatgtggcacaaagtaaatgataaatgatactttgaatttcacatattatcataaaagtgcataataaagtagctgaaaagggataagaaaggagaacttagaatgataaggacaaatacttttgtttcaactgggaatgagagcatggactatcaaactcaaaagcagaaccaggtcttatcaattcttgctgcacaaaaacttttacctttctgcccattttttcaaccacataaccactgccctacttgagaatttacttgtcattcatggactactctaacaaaactggtcttcctgctgacccttttccactcacagtcactcaggagatctcccttacctattttgaaaggtccaaaaattctcaatatagttggcaaaacctgtcacaatctacttttctaatcttatttctacttgagaactatgaattggggttaaaatcatgcctccatgttgcttatgaaacaaatattaataaaataaacatagtaacgatgtatacaatcagtggcaaaccattcaattcttgataaagcaaaaatagtaactaaaaagattgaacattattgagatggctgtagtcaatttaatatcattgttaacaaatttgtcgattaaagcaattgcctatattcccaaaggattaaaataaatctaagtacatttccccaaagtttgaaacggatgaaaataaaatatactaagtaaacagtataattgaaaatactatttggaatcccaaaagcaatctgtatattaaatagaaacaagtggccaaatacttgggctctagaaagttattggcaaaagaaagtttatctgagaaaaaaaaatagaacaattgttgcttggtttttgttcaaggttaaaagattgaaaacctacttatggatatggttataggcatattttcatttatatggctgatttaaacatttgtattaaacaattactttcattccaccaattcataagaagaaggtaagactttttcagattaatatgatgaggcaaaattaatcacaataattttatccataagtctccttcccaccaaagggattatctcttagcaggcagatagatatattgatagataggtaggtagatagagagatagatgatagataaaagtaaagatttgtgctaagtgttctatataaattctaaggctacaatgtaaaattcttatataaactgtgatatattccaaagggaattttaaaagtaagaaatagatcaaagatctaaaagtaagacctgaaactataaaactactagaagaaaacataaaggaaatgcttcaggacactggtctgggaaaagattctatgaataacaccacaaaagcacaggcaacaaacgccaaaataaacaaatggggttataccaaaaagcttctgcacagcaaaggaaacaatcaacagagtgaaaagataacttatgaaatggaagcagttacaaactatttatctaagaggggattaacatccagaacatacaaggaactcaaacatctcaacagaaaaaaaatcaattaaaaaatgggcaaattatctgaacagacatgtctcaaaagacataaaaatggccaagaaatatatgaaaaaattctcaacatcattaatggtcggggaaatgcaaatcaaaaccaaaatgacatatcatctcaccccagctgggttggcgattatcaaaaagtcaaaaaataacaaatgctgatgaagatgcagagaaaagggaactgttaaacactgtgtgtgggaatgtaaactagaacaaccactatggagaacagtatggaagttcctcaaaaaagtacacacatggatacacacactgaaacaaatagaactaccacatgatccatcaatcccaccactgggcatttattcaaaggaaaggaaatcagtgtatcgaaggcatgtctgcatccccatgtttactgcagcactatgcacaattgacaagatatggaattaacctaggtgcccaacaacagatgaatggatgaagaaaatgtggtatacatacacaatggaatactattcagcaataaaaaagaataaaatcctgtcattcacagcaccatggatggaactggaggtcattatgctaagtgaaataagctaggaacagaaagtaaaacactacatattctcactcacatatgtaagctaaaaaaaaaatgttgatctcatagaagtgaaaagtagaacagaggatactagaggctgggaagggtaggggaaagggtgagagagggagagatttgttaagatacaaaattacagctagataggacaaataagttatagtgttttatagcattacaggatgactgtacttaatgattatattatataatttcaaatagttcgaaggagaatattgaatgttcccaacatacagaaatgatcaatgtttgagatgatggatatgctaattaccccaatctgatcactatacattatattatggaaatatcactatgtaccccataaacatgtacaattactatatgtcaattaaaaataaaataaaaatttacacgtacagggtggtttggtaaaatttcgtgaacatagcatttgttaattaaatgattttttactgtaagtagcttaacaaagaagcaaatgaaaactaaacttatttgtgtacttaaactgcatttataaccaaagttttgaaatcagtaaaagacaaacggcagccagagttctcattcttaaaggtatcacacagcctccattaccaaatattatttctcttttgtactttacactagtaaccaaaatagaaagattaaacaagagaactcagaaagagatttctttttcccccaccaccagtgagctggtgataacgatgtctgtttaatgtccttcttaaattacttcccatgtcagtttcaccaagttcaggtacttgcacctcaaaaggaaatcacacacctgtttgttcatccagaattctgaacaatgatgatccctgaggccttgtattgtgtgaccagcaggagctattgatcaacattggcatttttctcccaatggaacatagattttttttaagtttccattttattctctatgatcaaagtgagagtgagtctaagagatttggtttctataaaggaaggttgttgtaggcctacaacatgttcaaaatggtctagatacatcaccttctggtaatagcagcagaatgtccaaatctactcacaggtgcatcagataaacaattggatataggcttgatgtgaatttgaacagcacatgcatttaaaatgactgttttgaagcacacagaaagtataactctgttaaaattcatgcttccttgcatccatacgctctaaggtttacacgtgtttctgaagcaaacaaacctgaaggtctagcagatatacaactgaacattcatgagacccgattatgtgtgataataaggtccctcattgcctctgtatccctaggacacagaacagctgatgaatttttggagtcaaagatttgtctttcccttgcatgatcaattactgttcagagtctcctttcacaagacgaatcaacaaacctatgaagtcatgactcatccccactgaagagattcagcctctgtttcagccccacattccttagatggtttccaacatcaacttcctattctgtttgggatatcctatcccttcctgtgtgtaatcttcctaacgtcaacagctctccttaaatcaataaaatttcaaattgatattttatatttataatcacccaagaagtgagattatagtcaaagacactgcattgtcactgaagtcaaaggaataatttggactgtattttttatgatttcatttattttttactttattttccattactttaaaaaagattgaatcttaatacaattaacataattacttctttgacttataagacaacataaaaatagttttcatataacatcaatattactgaaaaaacttaaagtttaaaataccttatttctttttattcttagaacacttttactaaggaaatgagtcaaacttctctgttaaaaagccactgagagcaattctttctgtgtgtaatgatgtttgcagtttggagaagctcttactaggacaatgctgtggagagagaggatgggttgagacagcttcctgggaggagacctgtgctcagtctctaatcatgttcacctagaatccagaagcttcaggttgctgcttctattaacaggtgaactcaaatctatttgttaggttactaaatttgtggaattacagaaggccctgagtttattatacctaagggtgatatctgaatgcatgaaagagggaggacaggccaacacacggtttgcaactgtgcactacagatccctgggcacctggcctgttagtaagagaagtcagaatttccacaggcctatgaagcatcatatcttgggtgaataactaatatgtatcactatatttatggggtagtgactcttaaaccctcttattttaaaattaagatttacaacaggtaggatatgaaatatgggaggcaattagtattaacagcaaatatttgattcaggttgagtttctcccaagtgagagaaaagattggcaggcaatacgctcatgactctgttaagcaaacaggcttgatccattttcttttacccttggctcattttttttctataaaatatcaataattgtcctttgaataaatttctagcagaaacaacttgagaaagtttaaaactatgtactatccttgtttttttttaatatatatttttattatactttaagttctagggtacatgtgcacaacgtgcaggtttgttacatatgtatacatgtgccatgttggtgtgctgcacccattaactcgtcatttacattagctatatctcctaatgctatccctcccctctccccccaccccacaacaggccccagtgtgtgaagttccccttcctgtgtccaagtgttctcattgttcaattcccacctacgagtgagaacatgcggtgtttggttttttgtccttgcgatagtttgctgagaatgatggtttccagcttcatccatgtccctacaaaggacatgaactcatccttttttacggctgcatagtattccatggtgtatatgtgccatgttttcttaatccagtctatcattgttggacatttggtttggttccaagtctttgctattgtgaatagtgccgcaataaacatacgtgtgcatgtatctttatagcagcatgatttataatcctttgggtatatacccagtaatgggatggcagggtcaaatggtatttctagttctagatccctgaggaatcgccacactgtcttccacaatggttgaactagtttacagtcccaccaacagtgtaaaagtattcctatttctccacatcctctccagcatgttgcttcctgactttttaatgatcgccattctaactggtgtgagatggtatctcattgtggttttgatttgcatttctctgatggtcagtgatgatgagcattttttcatgtgtctgttggctgcataaatgtcttcttttgagaagtgtctgttcatatccttcgcccgcttgttgatggggttgtttttttcttgtaaatttctttgagttctttgtagattctggatattagccctttgtcagatgagtagattgcaaaaatgttctcccattctgtaggttgcctgttcactctgatggtagtttcttttgctgtgcagaagctctttagttttgtcaattttgtcaattttggcttttgttgccattgcttttggtgttttagtcatgaagtccttgcccatgcctatgtcctgaatggtattgcctaggttttcttctagggtttttatagttttaggtctaacattgaagtctttaatccatcttgaattaatttttgtataagatgtaaggaagggatccagtttcagctttctacagatggctagccagttttcccagcaccatttgttaaatagggaatcctttccccattgcttgtttttctcaggtttgtcaaagatcagatagttgtagatgtgtggtattatttctgagggttctgttctgttccattggtctgtatctctgttttggtaccagtaccatgctgttttcgttactataaccttgtagtatgtttgaagtcaggtagcgtgatgcctccagctttgttcttttggcttaggattgtcttggcaatgtgggctctttttttggttccatatgaactttaaagtagttttttccaattctgtgaagaaagtcattggtagcttgatggggatggcattgaatctataaattactttgggcagtatggccattttcacgatattgattcttcctatccatgagcatggaatgttcttccatttgtttgtatcctcttttatttcgtttagcagtggtttgtagttctccttgaagaggtccttcatatcccttgtaagttggattcccaggtattctattctctttgaagcaattgtgaatgggagttcactcatgatttggctctctgtttgcctgttattggtgtataagaatgcttgtgatttttgcacattgcttttgtatcctgagactttgcttaagttgcttatcagcttaaggagattttgggctgagacaatggggttttctagatatacaatcatgtcatctgcaaacagggacaatttgacttcctcttttcctaattgaataccctttatttctttctcctgcttgattgccctggccagaactgatatatctgtgttcataaggcacacataagactctttccaattgagtaactagattgtaggaaatgacccaaaagcagcagggatcaactcagacccatctgcaccacccagactgagaaggtccagcagtgttagcagattcaggaatatgctgggaagtgaagaagctgcaaaagtaaaagcctcttagaacaagcatactgctgaaaatccatgaaaatgaagcccagcagctcacttcttctatcacaagacctcattttgggaacaaaataaataaaggttaggcgttataatgctgttcacattataaaagaaaacgagtgtctgttattatgaaagaaaaaaaatgagtgtcacattattctggctgatcattttgtaagaattatttactgtgagcccagaacagattctgataatgagataatattaaaggagtaattctctcaagacactcaattttcctaagaagtaagaaaaagcctggtcctgcatccatactggcttttcagggctgctccaagtgttttcaaatgagcttaacaagctccttatttcatcttaaacctctgctacaggaattaaggcccagtgatgggcttatttttgtttttgttgttgctgttgctgttgttgtgttttgctgcaatccaagtctgtcagatcaaattatttgttccaaggagactgtattcattcagttgaatataagaaaaccaaggacaagaatattattcaaactgccatcagggccccttatctccatgaagccaaggctacaggtggaaggagagtctcaaataccagtgacagaggtggcccaaaagaccctcaggaacttccacttgctccaggtcacatgctattgctcaagaatcccagtcccgcctgaagtaattacatgacaatgctaaatttccttcaccacctctattgagatttaactcgggactcaaaaactaagcaagtacatattttgaaggcggtcattaccacaacagcaacccagtggcaggaaccagaatcagtatctgccattctgagatcactcaaccatgcgatttatgaagctggattaaatgctcctaatgcagcttccaactttatgactctgtgattcatgtgctataaattaacaataatgttcaggaaaagggaagggagagagaaggggaggaagtggaggagaaagagatagacatgtggtagggctcagacgggcaagcaccgtacaacacacagaaaaggtacagacaaggggagggacagaccccaaagactttgctgactgtattaacataaataatcttcaggtcagcgtagaaggtgccataaagttaactaaattcctcattattatcgaacccaggaggaaatcaatagcaatgttaagagttcgtgcagtttcaccataacattcccattaaaatcttccacgtttctttgctgaagcctcacatactccctaaagaaaatgctcactcgaaagaaggaagtttacaaatgtgtgcccatttttcattgagcattaagttattccataaaacagaagtaaagaaggcagacatggagttatgtttcattagcataattaagtcagtagccttcaaaagttacagagtgaaactcaggtggcacaaacttctgtcttctcacatcagatcccatcaggacatactacagggctctcttagatcacaaatgagaactgacaatgttgtttgttatgagtacaaagttctaattttatattctaaaagcataataatgaatcaaatgaaagaaaaacctagatgtgtactagaaaattaaaagtcaacagatgagttgaattcataatagaacacacttttcagaacaatcaagtaatttaagaacaaagtaatgatgctgaaaatgagactgattcctcgtagtttcatcatcagtctgtataaaggcaatcgatgacatacgtaatttatgagacatttgtgaaacatatgagtagatgactggttaataatttcctttaggaaaaaaagaaaacacttggagattaatggaaaaaaacacagggaataaaaggagagaaactcagtcctattacaactgttattatcttatttttgtcaatgaaatatgacattaaagcaatgcagaatgggagggagccacacttcactcacctgcttctctgtgagaatgaccctccccagtaactgatcttctagacctttcatggtgacagtgaagtcaatgatggaggtacgggcacttatctcaggggtgtaggctgggttaggcaatttggtggtaatgtagagtctaaagccatccaacacatctacttccttgtcaccaactttcaccttttttataaaaagaaatttaaaagtaataaaatagagatataccttactgtgtcttttttgtatcagatcaagtattgttttaaataattacataattggagatcatttgtatactaaaaaagaaatggtcatgaggcgtctgcacagcttcagacaactaggatgaaagaaaggaagcaaagaaggatgggaggaagaaacatatatatacacacatatatataatggactgaatatagaatttaacaccaaaattgttatgatcacattgcaggagtgagatggatcccttacccaaaattcagttcacaggttgagactgatgatgctacacatgcaccgaaagagtataaaaaggtttattactcacttgataagattttgggagagatcagagcaggttcccaaacaggtcccaaaaaccggcttgagagagcagggaggggcagctgctctagggctttgtggtgtttagggggtagagctggggtgagggttcccatacataggtgtggacaggggattgcatggtttgaatttcaacctgtgccaaagcagggggcacccaggttttatcagcttgcccagatgtgggtggggcagaaggggagaggggcatggagaggcttcaaagctgtcagcatcaaatgcagtcagacccttttcacattacaaaagtgaagtcaatactcctaaaaggcttgctcctggatattttaatccaaagtcaagaagtgtagaagagaaaaacaaacctttcccaaggactcaaatttaagttgttgcctattgagagaattctatctgtgtcacattgacctggcctcatggtaattgttctgcacattgtcatccataggtttaacctaccttaaaggtagacccagttttaatgaagtttctttccaaaacattatctagtgctggatctagttcctctccaacatcttcaataagcaaaggccttccaagagaaaggctgtcttccaggtggtttctgaagtacttgtgatttaaagacgtgatctaggaacaggatcacaaggttgctattggcagacattaccatgaagcaatgcacagggataactgttttcaaatgaagcctaaagcattctactgcaagagacaaatacaaattgagcatccaaaatgttcccaaatacaaaacttgttgagagcccacatgatgcccacagtggaaaattccacacctgacccctatgctttctgatggttgaatgtacacaaactttgtttcatgcataaaattgtttaaaatattgtataaaattaccttcaaatatatgaagaaggtgtatatgaaacataaatgaatttcgtgttctgacttgggtcccatcctcaagttatctcattatgtacatgcaaatattccaaaatctaaaatctgaaacacttcggatcccaagtatttaggataaggggcattcaactttcatatagatttttagagatccttggctttgaaacccacacttggtgaaattgtaaagaagtgtaactgtttccattgttgtttaacaaactatcattttgttttattgggaagcatgtaaaggctctgtgtgggaacaatgttttttcttcaccactaccacttttgtgacaaataataatgtaataattaggaagtattcatgcaaagtgctgcacactttgtgtgatacagctctgccgttctgtacttatcaaagagagccctggaccctgacagaatagcctgaaaccattgaaagatggcattggtagagatcaacacaaatgcaaataatgaaagttttagaaaatatttttatattagatttaagcttgcatctgctactgctctacctaggattacaaaaacatctctagtgttttcaaatatttctttactcttggatttttgtttatctgaggcaataaaacttaaccggtagcataaacatactaaaacacaaattacctggagttcatttcggctttctttatttttaatccagatcttgccttgagtctgtggatcaattaacaaagggtaacgagatgccttcgtgacaataattccattttgaatggacaagtcatcatttggcagaccttggaggttccattcactaatagtaggagcatcaatcaacatctcactgagatttaggttctttccaaatggaattttccgggctttcatttccttccgccagtcatttaacagaagatcacgaaactcttggttaaatggaccagaataagatagaaaagctgtagccaacagtacatcccctaaaatagaaaacaaacaccattgaaatactttacgttcatccgtgtgattgtacagcatattaaaaatgaaaaaaattaaaaagacaataattcttttaaactaaattccacaaatcaaactggaggcacaagtggctgtgctggtgaataagcagtagtctggtttattagtcaataaggtccaagtggcctaccaagtgatacctactagcagtcaagcactggattatctttactctcattagaagtgaaaagatgacctctaagtttaagagaataaaacctcataagacagagccttcattaaatgtgaccttcatcaatatacccatgcactcacagaattctaaagtgacctgataataaaaggcataaaggtcgttaacacatctaataaggacagcatagatgccagaacaatgtctctttctctgaaatggctggaggcacacacacacacacaggaatttttttttaattttattattattatactttaagttttagggtacatgcgcacaatgtgcgggtttgttacatatgtatacatgcgccatgttggacacacaaaggaatttgattaaagtataagctttcgaattccctatcacagtcaacacacaatctcattaataaagaaatttacatacctacaagtcttttagtttgtgcagcaaactcttggctttgctctgtccatctttctttttcacctgccaagccactgatgagcgtggaagctgtctgcatcttgtgtctgcatcgctctgcatcttcaagcaaggtctaacaaaggtcataatcacaagaaagcttttactgaaataaacatagccactggctcaaaaatataattgtagaacacgccatattatctgccttcctgagacatgtgagccattacttcacaagaagcatgagattctatttccatgtgtctgtcagcccagtcctctctcctttgccctgtcctctctcttatcccctgcccatggaacttggctggatagagtttcgctcttgttacccaggctgcagtgcaatggcatgaccttagctcactgcaacctctgcctcccgggttcaagtgattctcctgcctcagcctcccaagtagctgggattacaagcatacgccaccacaccccgctaattttgtatttttagtagagatggggtttctccatgttggtcaggctggtctcaagctcccaacctcaggtgatccgccaacctaagcctcccaaagtgctgggattacagatatgagccaccgcacctgaccagtgcttagttcttaaaaacaaatggttccggtggctcacacctgtaatctcagtactttggaaggctgcgaggtgggcggatcacttgaggtcaggagttcaagaccagcctgaccaacatggtgaaaccccatctctgctaaaaatacaaaaattagctgggcgtggtggcaggaacctgtaatcccagctacttgggaggctaaggcaggagaatcacttgaacctgggaggtggagattgcagtgagccaagatcgtgccactcaaatccgctcaaaaaaacacaaaaagcaaaaaacaaatggctctgtttcttagtgtttaagcaacaattgcttattctacttgtaaaaatctaaacttatgaaataaaatgggtatgtacaaaggtgtagctacctgacaagtcactgggtgttcaaatatatatacacatgctaaatgtctaacaatagaggattatttaaataaattatagtgtatccatgaataagaatactctgaagccataaaaaaatcctataaaaatttttatgaccaagaaagcagatcacaatatattgttaaaaattcgatttataaaatggcatttctaaattatcagttatgttgagttcaaaatgcatctgaaaggcatatattatgatatgaataataacagaatatgattaatgttcatctccagggttacctgtattttgtatagagacatgaattgcttttgtaataataacacattacagtgtttttcaaaagcaagatatttattccacttcgtcctaatctattttcttcctctggagttaaggcaaaaaaactaacagtccatcggagagaaccatcccccaactacggctactcacatctgtttgtttccctcaagagggaaggtgccagctgggaaggacaatcctacattgtttattagaaaaaaaaaactttttatttgtaacatacttttaatattgatttgctttctctaaattctgcaatcccaattccatcagccaaatcagaaaatgaccagtcctctccctttctggcttttgttttctggaagcccaggcttctttgggggattacaatttgggagaagagaaaggagtaaatgttgacaatgcaagagaaagaaagccgtaagttccgtgagttccccccagcctgttgaggggagcacacgggacttactgggttccctgagtagtacccccctcctcaggcccactctctcataggtcccagagaggtgactggctctccagcaggcctaggcaagctgaaccctaggcaaaggcactggattctgcatggggcacagccaggacacactctccttcaatgggccatgcaggcctgggccatggtgaactgcagattggaacccttctgctttctgggaggcccacaaacccctggactttcatggagtcctatggagggagaagagcaacaaaaatgactgaagatcaagttcagaagttggttgtaggtatgcccagatttttttttaatacggaatttgacatttgttgaaattcaagttttagagttagagccatgatgttacagttcttctgtggtcccatgattatttacctaacaaatagcagatgctcaaaaacaataaagcttgctgaatgagttaaggtaaaaatgttaaaatgtacacataataaagtgagaaggtaaagtattttcactgtgttcagtagagcttcctgatacaaatgagcatccaaaatggtagaaattaacactccttccaaagtagattctttcagactgccataatgttttccatacataagtgaattttatgaggcataagtatataaacccagataagtgttacttcttttttataatttcattttcattttcagttcaggggtatgtgtacaggtttgttatataagtaaacttgtgtcatgggggtttgttgtgaagattttttcatcacccaggtattaagcctagtacttgtcagttatttttcctgatcctctccctcttcccatcctccaccctccagtaggccccagtgtgtgttgtttccgtctatgtgtccatgtgttctcatcatttagctcccacttataagtgaaaacatgtggcatttggtttttcagttcctgtgttagtttgctaaggataatggcctccagttccatctaggttcctgaaaggacacaatctcattcttttttatagctgcgtggtattccatggtgtacatgtaccacattttctttatccagtctaccactgttgaacatttaagttgattccatgtctttgctattgtgaacagggcagcaatgaacatattcacacaggtggctttataacagaacgatttatattcctttgggtatatatcaagtaatgggattgctgggtcaatggtatttctgtttttacgtctttgaggaattgccacactatctaccagaatggttgaactaacttacactctgaccagcagtgtataagcattctttttctccgcaatctcaccagcatctgttgttttttgactttttaataatagccattctgactggtgtgagatggtaactgattgtggttttgatgtgcatttctctagtgatcagtgatactgagcttgttttcatatgattgttggccgcatgtatgtctttttttgaaaagtgtctgttgtaaagaaagcaaaaactgacaaatgggatctaattaaaataaaaagcttctgcacagtaaaagaaactatccacagagtgaagagacaacctctagaatgggagaaaattattgcaaaatatggatctgaaaaaatcttaatatccaggatctataaggaacttaaagaaattcacaatttaaaaaaaatctcattaaaagtgggcaaaggacatgaacagacatttttcaaaagtgctacttctttaaagcttccaaaagcatttactttgcttgtggaagacttatctttaagacattatatcatacattctgcagatattgaaactgaaatgtttatctaaactcttttattgggacccctacaaaactaacaaggcaggaatttcaattcggccaagtaaaggctgagaaggggtagaggtgaatttcataaaattatcaaggtaaaacagagtgaatctagctattatttaccaaatattggatttatcagaggcagatacagattttattaagccaaaagcttatatactctagagagaccactttgtaaaaaaaaaaaatcagtatgtatttaaagtaaaaaaaaaaaagtgacaagatcctggttacttagaaactcaggtacttttcctctgtgatctctttaggcatttgacttgaatgctctaaagtgagaacaaagataggtaaggcactagggtgccttggctcacacctgtaatcccaacctttgggaggccgaggcaggtgtatcacttgagctcaggagttcgagaccagcctgggcaatatggtgaaaacttgtctctacaaaaaattagccaggcatggtggtgcatgtctgtagtcccagctacttgggaggctgaggtggaatgatcacttaaccccaggaattcaaggctgcagtgagccatgatcatgccattgcactccagcctggacgacagagcaatactttgtctaaataaataaataaataaataaacccaccctgcctaccttgcaagttacttcaaagattaaatgagataaaaatgggaggacatgatttgaaaaacataacaaaaatgctagtacacaagatgctgtcatcactaccaacaccactaacaaagaaactcagaatggctatgttccagcactgacagccatcttgactgaccatcctgttgtctcatcaaagacccttggtgtccattatgtgctatgtatgtattatgtataaattcagtgaaaccccacaagaacccaaactcttggagagagaagccgtgtagatatgtgacagtccctgccatgacaaagggcagttacctgcttttcagtcatggcctgttcatactcagcctgcaccacgtcaagttccgcctgcttgtcatccaactcggcctgggctttctgcagatcctgcatggccaggagatggcgattctcttgcaccaccaagttggcctgcacaggacacacacagagtgaagagatgggcagccaacctcaaaacatcctgcatttcagggtctgagaactcagctaacgtcacatgtttatacctttgctttgttcccgctccagaatcctttcaaatcacattaagtcctgaacaaatcttaatgtgaacttgacataaatgtgtataagcagaaagttacacttcattagaaaggaggtcagcaaatattttctttaaagtgccagatagtaaatattttgggccaagaggcaaaatcaaaattattgttcatgtacttattttaaaactatttaaacatgtaaaacctactcttatttcacaagccatccaaatataggtagtgggctagatttggcccacaggccatagtctacctagatcagaacactgtaatattaaatgtatataggtaaattataaaacatgctaatattgagagttgtagaaaaaaacaatatttagaactatctgcctagcaggactcatcactgttgaggagtaataaaggatgtaaaatgattatttactgaatataaatatctacgttttgtgtatcgtggtggtcttgacattgttcctgtcactttcatatatttcttgccttctggaaagcgtatttgataccttgagctgtgactaattaaaaatgtttattttaaagaagctattaagatagaatcaaaagacttaaccaaaagcaatattagcaaaagatgagatgtaaaaaagtagttcatgcctaagaaatttagatcctttaaaatcatttttgaaaccaaatttttcccttttaaatttataaagtgttaatattgactttcatgggatgactagaaggcatattctttctgaagtatttgagaaaagattatttttaaaacacttttgaaataaattattttcctatctcaaaacttcaggcttccaaattttggcagaataaatctttagggaaaaactcaagagttccataattgactagatccagtgatgggcaaaagcatcgcttgtaagttacaatttaaaaagaacctgactggtggaacattttttcctcagctctgctgtaagctgcaactgttcccatggctcaaaacatggaaggaaaaagtaaagtcaccgtgtcaagcaacttacaacttaaagtcacctgctaatgacaaactttgcaaacccaaagattttgaacattttctagtactttactcaccaataaataaataaataaaatttatattaaatgaagctgtcaacaattgctaatcaaaatccttcaaacccaattaattgctcaacttaggacttgtagaactctgtgcaggctgcttaaaccctgtgagcttcagtttcttcattaaaatattgaaaaactaactcctaggactttttatgaggattaaataagataacatatgtaaaatcccaagtctagtccccggcacataacatgagttcaataaatagtagatgttgttactgttattatctatgttcaatatttaagttctgcttttttataacattctctttatatgtactcatactgatttccataaagttttcaaggagaatctcattataaggaacttgaatagaatctaaattgctattgccgctaattcatacttgtttgaatttattcactactagaagtcacttagcccaactacaaggattgcaagatgaaagataacagctcctcagtgtgtccattactaattagtgtctaagagattccacctggaatttagggaatgcccttgacctctcctcacttaagaagcaggggtttgccagtgaagcccctccaggaagaagggaagttaaagtcgtaggtctgaatttcttaatatattcaacagaaccacctggtgacaatatgcactcactgcctcttctactcctccctacacagtgaatgcgggtctgtgtaacagcatgtatttttcggactgacgtaagaggaacctgacaagctgagtggtccaagatgctagatacttgtaagaatataagagaacagacttctcagaaagaaaagcacaggttgtaggagtaaataaaaaggttcccactactgatagtgttcccttcacttcctactgcaggacccagattgtcttgagacaagctgaaagctgaaatgtggatggcattgaatacaggggaagagatctcattgttcttatgcaagccttgttcagaatgtccatgtttaacaatttcagctatgtacttaaaatgacaacaataacagaaaaaaactatgcatcatgaacttaactgtagttctctttaagacactatgtggccgggcacagtggctcacgcctgtaatcacagcactttgggaggccgaggtgggcggatcacgaggtcaggagatcaagaccatcctggctaacatggtgaaaccccatctctactaaaaatacaaaaaattagccaggcatggtggtgggcgcctgtagtcccagctactcgggaggctgaggcaggagaatggcgtgaacctgggacgcagagcttccggtgagctgagatcaagccactgcactccagcctgggtgacagagaaagactccgtctcaaaaaaaaaaaaaagacactatgcatggttacccactggaaaagtatgcaaagaatgactgtacttttcacttgatataatggttctaattcagtcaatatcagattgtccatttttgagctatgctgaagtcttcaatagtcacaatatccatggtgtcagacagcatgacatcaattatttgctctgaaattctcggactcaaatgactctttgtccctttaggttgtcctgggacctcaagagcctcaattgctgaatatatggtcctggtatcacaacaagtagaaacaaaatagaacttgcaactccatgcctgtcttcctgatactcttgattatttgtatgatgattgttaagtttcttgggtagttaacaagtgtaagtagaatgtagttgatgattaagagagatgagactcatacaaaagcaaaataatcaaccaagccatgagatatgattttgagacatcagcatttcattttcaaaaaacccactctccattgcctctccatttgctgaagactgaccttttaatggtagaggaatatgcaaaaatgaagcttaaggattcaattacacaaaggaaataaaaagcatgtctaaaaagtcacattaaataacaaatattcagatattcagtttctttcctgagagacaaaacaaaaatggaaaagggaggaatacatcacgtcttaagccaagctaagaccagctttcagcatgttctgtcttgaccctacctcactcataggattctctggataaagatctgaaatatcagcagaggattctgtgctacagtttgcagcgttttttgtttgtttgtttttgtttttttcaagttaacattgtggaggaaaaatatcgagcagcccacaatggacctgtagggagcatccttgtagagagtctgtccctgcttagaggctcatatggttctgattagaacaggattacaaagaagaaagaaacatcccatgcttggcctttctatgctcactctccccatggacctgagtatcctaacaccagaagccacaggcacatgtgctcctgtaaagataagacgggtcgacctggagactccgcccagccaccttcacccaggtctgcctagcaggcttaccttcagaggcagtacttctttgtttatagaaaagaaggaagccatagctttcgtccaggaacaaagaccagctacatttccacatacgcgtttagcagtttcgatgttatagtcaggcatttcaaagtaaggactcaaaaattctatcacctcttcattgattgtgtcttttgggaattgctatggaagaaaagagtaaaataaagtcgaaacacttctttccataaagtcatacttgcatcatgctctcaatgccactgaaactactgaacgaccacaaatgaatgaagggcatcatattttgtcactattttaagatatgaggcaaaagtcctaaaagtaaaaatacagtaagaaatgacagcaaagaagtctgttagagtacactttgtcttctgtagaaaagataccaaccttaaataaatataatgagatccagggaaagagtaaattatttaggtgatgaacactaatattgttattagaatttccaaagcaataaagattttttgtcattaatcctaaatggatgaattacaaacccataaaatccacaatgaaaactaaacacacctaggtgtattcagtctgaggatatacatatttagcatttatcagcaactaaacgcttaatacattcagacagaagttttattaaactcacctaaaatgtgaagataataacttggacattaggctttgagggtgatgaattaatttttaatcatagaactatcaagaatatgagagaattattatcttctggtgggataaaaatttaaaatagtagcagaaatgaattaagaatgcctttctgcatcacaaaaagaagactgaccaaacaatgaaattggatcttttaaaagtggtgtttgatcatttaaaagaggatgattaaatgttttccaagcggaaagaaatttagcaactaaataatttagtgacacaaaccttcgcagaacacataatgtatagtagaacacactctcattcagacctcgtttaatgtaactcatttttatgagacttgaaaaattgtaaccccaaaaaaagccagatgaatgtctgggagcaacagaaggtcagtggtgacaatgacaaatgcaagggagagtccaagagcaggggctttgccaccaggtaaatgtcaggaacgtgtaatcacttgtcaggattccatccaaagtccaagtctattggcagagtctcatattataattatctgggacaagtctgtttggcccactagtttcataagctacttatcgttatagctgctgtgtgcacctcaccacaggccccagacatagcagtcacttgagcaatgctgaattgaaaaccaaaagaaagatggtgctgaattcacaacttgggaaatagaggtggactgggtattcccaattagttgttttgagatttgaacatgaaagaaaagacaataaagcttccagaagaaaactagaaatctgccttggatgtgggcaaagatctcctaaacagaacatagaaagcactattagggaaaatattaagaaattggactacattaaacctaagaatttctgtttatcaaaagacaccattaatcgagggaacaactaacgccagaaagcagcagaaaatatttgcaaacatataaatgacaaattagtcatattttacatataaggaaattctacaaagtaataaaaaaaattaactggacaagcaactccaacaggcacttaacaaaagaattccccagaggctcataagcctatgaaaaggttgggaaatgcaaattaagccaacaataataagacaccactacaaactcatcagagtagctaaaagaaaatggtgaagatgttgagcaacttatacactgctggtaggtatatatatagatacatcagttttgaaaactcttcagcactgcctaccaaagctgattaaatgtgtataaccaaagtcccagaaattccactcctgagtatgaaaccaacaggaatgcatacctagagccaccaaatgaccaatattcacagcagcttgatttataatagccataaattaatactaagcccaaaattcatcaaaagtacaagggacaaacaaaatgaagcatattatagtgtttcacactggtgctggttcaaacaggcttgtaaaaaatgattgttaaatttccaagaattctgcaaacttgttagactccgccattattaaaaattaaaatatataagcttacaattaaataaatgatatctcaaacaaagattatagtcaaagctcataacttgctaattcttagactaaatttgactaccatctgtgtttttgaggtcatttacaagtattgtatctacatggtggaaacactacacagtggctgctaccatgcacctcttctcaactctagattcagcaacatcattttggcagcttaaaacagccatcatgggagtgcttacactatggcaagacttcaaattagagctttttttttcttttttttgttttcctttctcccttaagaatcagttgttaaacatttctcacacacagtacagcacatttatatactggcaaactatataacaatgaaaaaagaaagactgtcatttgcaacaataagaatgaatttcacagacatgttgaatgaaagaggtcaaaacaaaagtgttcatacaatattatttcacatatgcaaatttcaaaacaggcaaagctaattatctggataaaggtaaggatataattatcttaaggaaagttattgacttggttggggcacaagagagatttctggggtctgaaaatatatatttttcttccagtgttcacaaataggtatatacatatgtaaatattcatcaagttatacatttaaaatttgtgcatttattcatgttaagttctatctcataaaattaaaaaagctgtaaattaatactaaaaaattactgagaaatgcaaaatacaaatatttgtattcatgtgaatataatataaatacatacttattgtcttcttaaaatgatttttttaacttttattgaagtatacataacactgatgatgctttaatacaactaaaatctgtcaggaaaaactctaatgcttataatgttttatatttgagacaaagttttactctgaaaaaatcatgtatgtagagtaagttctttttttagaaacttattctacgaaaaggactcatacaccagtgaagaatgagttccctcttagcccatcaccactgaactaccaacctgtaagttctgtaaaaagttccctgcagtcatcaattttaaggattcctgccaggagggcatggtacagcttttttccaggtcaattttcacagcactgactttcctttgaaacagcagcagtacgcaatccatgatccgcatgatgaggtgaggggggcggcccaacgtgcgaacagtggcgatgtccgaaggcctgatggtctgggggatgaaaggaacgatcacccaaccacagataggaaagcacagacaagcaaaccttgcatgtccaaatgctgctatttcaacagaggacagaaaactgttttaagttagatgcaggccacagggtctagatgcatatttaatcccaaagaaacaccatgtcccaacaagttcacatttctactattcaaactagcagtgacaggaaagaaatgttggcgagcagataaggagctgtgacttctctaaaagtgcacagatggctttgtgccagaaaaaagaaaggcataatctgaaagaaaaagaatagtcagcacataagtagatttcgaggttcaaaaccaggaaaattacagtatttgtggtgcttttttacttattagctatgtaggtcaagaatctgcctctctctcttaaacaattcaggctcgtcactgtggactgacaccagagggtagccacagggctgacagattgaataattagaggtttcttagctaggaactgacctttaaatgacgggacttgagcaataagaattttactaagctctctcttagaaaagttccattccatttctagtatgtatacacttatagagtaaatgatttaatagtcacatacacctgttttggttgataataactgctcaatcacctaaaactcactatggaataagtattgaaaaagtgttaaatgtaagaattggaaacaatcctatctctaagacaaatagtatatattccttccttccagatcttcaaaacatccatctggtttgtatttgcatcctttctatcaaaagacagtaaccaatgaccttcacataaaagtgaatgatttttttctccaaggactgaggacaaagaaaaaacactaaacttggtaaattaggaatgtaattacataccttgaaaaggtttgtatatatatatagttttgcttttgttttttattttgagacctgagtctcactctgtcacccaggctggagtgcactggcgtaatctcagctcactgcaacctccccctcccaggttcaagtgattctcgtgcctcagcctcctgaatagctgggactacaggcacacaccaccatgccgggctaatttttgtatttttagtagagacagagtttcaccatgttggccaggctggtctcaaactcctgacatcaggtgatctgcccacctcggcctcccaaagtactggaattacaggcgtgagccagcatgcccagcctgttttaatatattaatactagcagttatgaaagccagacagctggaagttagggtgaatgtgtagtagagaactgaaaatggcaaacagacctttatttgaggtgcacagttataaaagaaaagagaaaaatagaacagcagccagtgaggaaagtagggtagggtcaaattaaagttatataaaatgtaagggctaggcatgcttactttactttagctttaaaaataattttcaaacagcatggtgctcagctgtgttagatgcccaggtaaaagaggttggagaggggaacaaaaactcaacctgtttcacctaagcattaaagtcctctcttttctgcaggccaagaaatatgactgttatataatctcctatatgctgtggcaatagaacagttatctaacatctggaggtattttttatttttgctctgagctggttaaagtcacattaatatcaagataggaagagacacattctttgcacaagatttgttgtcttatttgttgtatggatttatgtaacctgatgtcaaaatgttaagagtttgtacatacctggaactttcttagtaaaagtgagtcttcaaaactggaccagcctttaaggtgtggcctagttcactaaactcatttcattttctcaaaatccaacctcttttgtaattttgccattggtgtattgccacatagtttgatatggtttagctctatgtccccacccaaatctcatcgcaaactgtaatctccacatgtcaagggagggacctggtgggaggtgattggatcatggggacagtttcccccatgctgttctcatgatggtgagtgagttctcaggagatctgatggtttcaaagtggcagtttcccctgatctctctcccgccatcttgtgaagaaagtgtctgcttccgttcaccttctgccatgatcgtaagtttcctgaggcctccccagccatgcggaactctgagtcaattaaacgtcttttgtttataaattaccccgtctcaggtaacatctttatacagtgtgaacacagactaatacacaattgtactgtttaattgcgttggaagcctgctcaaactctctcattaatgtgctacatcagaccagcagctctctatttgggtaattcatagacagaaaacgtcgtatcttacagatcacctactccattggcctcaatgaatgaatgagagaatgttgccttagaaagttgatgtaacttttccaacattacatagcttattgatgacagagttgaaatgaggacccaggactcttggccaccagtatatggcattgcccaacattgatgagtgaagagtgtgagatgttaagcagaacaggcaaaacctataaagagctaataaagtctcaagcagaaaatattacttgaaatcactcaagtggatagagctttcatctgaaccagtagagcatttccttgctgttattcatctttttagcattagtctgcctcttaagccctaaagctgacatctgttatatcacatagatgcacctgcaatgcagcttctgcctcttctaaagctggttttgctgcttccagtttttcttcagcaatggctttgtctttagagatgctgtccacaatggcctgggccctgtccttcaccttctgtacctcagccttgaccttttcagcagcctgtgctttcattgtcacttcttttaagacctaattcaatataaagcaagcaatacttcaccaaacagtattaaacatccagctgaaaatgcacatttttgccttgatttgttgattttgttcacttacccagttttgttgttttttttttttttttttgagatggagtctcgctctgtcgcccaggctggagtgcagtagcgcgatcttggctcactgcaagctccgcctcctgcacttacccagttttttatacataaaattaagagtattttattccaatggaagttaatgtatacttcactagttatagccagtgaatatgcatagatcattaacacttgtgaactgagaattcaaaaggaatgtggcacatgtgtaaatgcccacccaccatgtcggctttatcgttggccacttgtagctccttttctttcgcttccagttctttactcaaggctgcaacagactctgaagcttctttgagcttttccaatccagtattcattctgggattgaaaatccaagcaagcaatgttaaaatgtgtaggacttggatgcaattctcaagtactggtccaataatgagtggtaatggttatatctgaagattgcatgtatgcaagtagcaaacccaagagggcttagcaaaaaggatacagatccagtcttgactctagactgataacatgtatgttctttacagaccacgtgcaagaacagcgaacctgctagaacacacgacatgaaattaggaacgacagtaaggctagaatctgtatcacgaaggaaacatacttaatgacattaggctaaatgacaatagacttcaaatgcttaaagctcagtcatgcaggaaggaaaataatgcctgtttttcaaaagagacatatgaagtcaaaagaagaatgatgtgggcttaagaaaccaatttaaagccatcagaacagctgtaggaaggaactagctgcctgcctgaacctgaaataacgtgaccatagagatgggaaccctccgagtcatttcgtgtaactgcccacccagggattccttactctggctgattctagccacgctcaggaagatgatctgatcagaaaagcatagggcagagcagtgacatttggaagaaacttcagggaagcagggatactccttaggcagtgaacatatgcatcaacctggcttttccctctcagtcactcagaagggatgggaagagaagggcaagaagagggaagaggggatgtctgcattcgcaactcccgtccaggtctattatttctatcctgatgtcaatcaatattatagaacgcagtaggccacataaaaacctggcaataatttatcctactgggcaaggaacagtcaataggctctagaggagggtttcccaacctcagcaccacggacatttggggctggataattctttgttgtggaggaaaagaacttcaggaagtttagcaacatccctaagcctctacccactacatgccagcagtaccccttccctgccctgccgccacagctatgatacacaaaatgtctccggtcattgcaaaatagccaccagggcaaatctgtccctggttgagagccacggctttaatatagctttgtataagaacatcacacttacctgttggccagggtccgcacctccacatgcttttctccatatatgaacttatagccctgaataaaggagaggtatgatttgggcgtcacgtgggtagaacgtcggaatctctgaaaataatcaacacacttctcagccaccccatcctggaaggagcccatgcattggaccacctccttcttgatttccaaactgcagtcaatatcataggaagtgaggaagtgttcagacactagagagaataaagatgacagtgtgtgaaatatgtatgtaagttacccttttaaaagttaactgtttatttctaaaacttagacatttcttaggaatgcaaaccatttttgtagccccagctaggtagatctgtgtcagcatttttggccccaggcctataacatcaacaattttattttctgttgtatatataaaactataaaaacactttaagcctatcaacactctttgttgcctggtgcttgtgcagagacatctcttctacacagctgcaggttctggtcagcagccaacctgttttatggtttacatcaggacaaatggtacaaataactcagaaatcagtgcccacctggtactcatatttaacaatgccatttattttgtcactcagaacctatcacacccttagtccaccctggctctgactgcatttggcatgtggaaacgctcatcactaaatttttttatgctggagtcatcttgttcttaaatgtggcagctggtcatttgtggtcagttcttatttacagtattcttttagaatgtttgggtaaaaagtctcctgttggagacctttaccttccccacattgccaaatgggggaccaattctaagacagccttccctgctatgggaataggctcatcaatcaccatgtacactgaatgcctgttgcggagccaccactgcgacgggtgccatggaatgaaagaggaacgtgaaacttggtctcaaccccaaggaatttacaagcatcacacaaaatacggttaaaattatcacaaccatttctatgtatctcagaagaaacaacctatgtatataagtattgtaaagagaaatatggtcaataaaatgggagagaaatgaatcaagtaagcaaggcttaaaaaggcaaagacatacaaatagtacttatcaccatcagtacccaatcactaaattaagttcttaaggctgttattgtggggctgtatttacatttatgtaaataatagagacaattcatcggcttcattacaaaaacagtttaccatataccaaaaggcaataattaagtcacattttctcatataagttagccaaccagtacaaagaacggtttaaactctaagaagttcaagtctaggtactggaaccatagaacaattcatacttatgatacattttgtgtaggtgttaaccacaatggctgcgatgtctaccatgtgccaggcatgatgatcaatgctttacttggcattatgggatattctcggggaagtgcccgctttctgaaatcttccttgtatttatcatgtaatgattttctttcttcttatctgaacaaacagtatcaataatggtgaccttattctttacgtagcaaattgtccttttgtctctccaaaaagtcaaagagaataaaatcaggatggattctaagtatatttttccacagacccaggatctctggtgcaggaaaggttacagaaagaagcagaacactccctcttagagtgacccgtgcctgctgagattcagtcaagaggccagaaaacccttctgtcatcttcaatatcccatcaccaaggcagtaatgccagttttggggctacctccagggattttacaacataaagcatatttttctttaaatgattcatcaacagattcagtccatttaaattcatacatataaaaaactcactttttttccaaaggtatttagaagttattaaaattactacaaaatccagtatcagccctaggggcttctttaaattagaaaaacacataataatgtaatattttattttattggaaatatttcttatgatctaaatgaaatgctaacacaaacgaatgatatatttctttctagatgcagctggaggtaataatttaattcagaatcaatatccttaaggcaactaaaataacagtttttctagaaaccttgttgctaattttctaaaaagaataaataacactgaaatccctaagtgtctaagtacttctaatactcacagatggtattctttcaggataacactaggcaggttagtattgggtgtggagacattgattttcccaacaagattttctatttattgaagaaagaaaccatgtcttatgtcttttagttcttttatccattactatgactagcatagtattaaacatttatgtagtatgcaggctgtaaatagactaaattggagctataaccacaaaaattactggttatcaaaagatttaaaacgatttaaatgtgcaggtaaattatgtaaagcataagtgttatagatataggaggtccaagaaaatgggaaaatttcaaatattccaaagagaacaaaggaggattgaaggatgtgatgtatcttgattaagccttggagattgaataaataaaaaagatggagaagaatattcttggtagagggactagtgtgaaaggataaggatgattaaagcatgttcagagggaaaagaggtatatccaaagttgaactagagaaagactgcaagtgatcaaggccatattatggaaagatgatgaatttctacacagtctgatccattcattcaacgtcataagtatcaaacaccagtagctgctgaaatttgaacaaaggatgtgtagttcttgacctcatgggagtttttagtctagtaagacattaatttagtttttagtctagtaagcattcatcaaataattaacacaatgaggtacataaattacacactgtggttaatcccaagaagaaaaagcacagagtgctatggaatggataacagaggacctggcttggggggaaacggagggaagcaaaggaagattttcctgaagagatgacatttagctgagccagcattatccagacaaaggaggagtgggtggggagaaataggaggaggagagcattgcatggaacacaactgggggaaaaaaaaaagagcatattcaaggatccaggaaaacagagcaggaaagaaaagggacctcaggagagcctggggaggtaggtaggatcagctcttcccagcacgaaggcctgctaaaggttgtgatttttcctaagaacaataggaagacatggaggttttaagcagaaataaatgcaactgtatttgtgtttttaccgtttttctgtctgcaatgtgagatggatgggggacaggtgaaagagttgaagagatcattagaaagctatttgggttttccaggtgagcagcaatgatagcttggcctaggatgtcagtgaaagggagatgacttggtgatggataagacttgagagttggagaaaaggggaggtgttgatgacaaaggggtctcaggttgcctagtttgatgagcgataatggcccttcctgaaagggggagacaatttgagtttcagacattttcagtttaagaaacttgtgaagcatccataagaatggaccaggcaggcagttgagtacacagatttcaagccaggagacagactagaccggagaaaaaattgatggcacgtattataaaggaggctgtggacgagctttcctggggagagactctggagtacagaattcagtctgtcttgtgtctgttgacaagtctgtcttgtcttgagtctgtccaataacatcatgaagctcaatatgtacgttccgaataaatgaacaaatagattaatgcatgaaggttgggatatttgctagcaactgaggataaagaaaggaaagtttctctgccctccatgtaatcttggtttgtgttggtgtgataagatttaaaagaatgggacaatgagaaattaacaaaggagggatcaataagacctttgtctacaaaagaagagatgactgaaataggaacttaacaaaaagagcttcatatgtaaatcatcttaatttggcatattatagtatctgtcacctgaaattgttatttccattgttaataccttacagagcattttatgaagtacttgcatattgataactgtatttcataataaactttaacatagctctgaaatactcttgatctgtgctctgcatgtatatcctacttgagttttaaaatcttttttttaaggtcttttgttctttttattaatttccttcctttcatcagtgactttttgtattaagagctacactcctttttgttttttttttttttcaaatcttacctccagttatatttacatttttatgggactttaaattttaaatcactggccttttctcaaacttctaagacaaaaggcagaactgtgctgtaaatttatatcacaaacatgttaaaatattctgtgtttaaaagccacagattggaaaaccactactgtcaatagtgaagcgctgagaataaaacttccccagtaggtaagaatttgttttaagaataggtaattgatagataatcaataaatagatgatggatagatggatggatagataatagacagataaagatagatggatagataatggatcgatggatagataattaatagatatttagatagataatagagagagaaatacagatagatagatagacagacagacagacagacagacaacctaggtttcagtctcagtactgatcccactaactttttccacctatggcaaccctcaacttcatgctcctcagtttctccttctctaaagagcaagagatgggttaatcagtcattctcagatggggtaccacagagctgtagaggcaatggtgagggcagtagaagtggggagtaagaggatgagactccagaatgcttcctccggcaacccccatctacttttcactgttttatctactaggactacttgtaaggtattactggaaaataaggctcttctgcataaaacatttttaaaaatttgaaaactactgtcctgaatcagggttctcctcatgttctgatgtaatagggatgagacctgggtatctgtttcttttaaaatatcaacagacaatttctcaccaaaagctttcaaaaaaaaaaaaaaaaagctaaatgtacgctctctaacctctcctctactacttttatgttccaatttcatttgcaaagtaaggaagcactaatggtccatggcatggaagatcagaaagaagcagaagcagcaaagggtccagtcagagaccatgctggttaacatcttttgtcaaggacagaaaccagcagagaattgctggatgatgttttcctctttgattctcagcattgcagccttgagaaggaaatgtccaagagatacttggctttaaccactcttgggctgacaaacctacttaaaaagaacacaaatgctgtccatgagattaaacctctgtgccttcccatgacatcctggagcctgcctggagatccagctgaggcagagccttcaagcatccctgaaagaactagaatccttgaacacatgttatgccctggcataaacatttccatactaaccagcaactaaagcatctttgggccatcggctgaaccagtcaattgtgcatcctgaaattagggcagggaacttcaaagctctgtttcgaaatttctcccccactggcgagaagcagagcacaatatgaaggttctgtcggacccgactcatgaagtagtcgtgcaggttctcattggtaggaaggcacctggggaattcttttttcatgactgatgccaggtcgctattaatttcatcaatttcatctcgagcaaataggttagagaccttaaaaagaagtacaggcatgcaaattcagtacacacataggaaaatagatcaaaatgtagagcttaatacacagaatgtcttttctccatttgtgttcttgaactcacctacagaaaattgaaagttttcaagatgaaatacactacgttttaaaataaataaatgattctactattaactgcaaagttgtagccccggaaaggagtaaatggacatgccaaaaatctaattagctttctttctaacttcgctcttctgtttttttcatttgttattggaacattcactgatgttttcaatgcttagctccaaattttgatggagagttttattcttcaaaaacccaatagaaaaacccatccttcatactgatcacttaatacccatccccaatagcacttattcacaccactaatggaagaaaacatgtagagctctaagctggaggaaatctgaagggataaaacacataaagaataaatgagctcctacctcacctgatgataaaacattgttcatatattccaaaaatgactcatctttaatctcattgtctgtgaaaataaaagtgattcctttgccttgctgaccagctgttcgatacaaaaccttcagatcttccatcagatttgatgtgttgtaggatctaaagaaatattttcattttgtcattagctaaaatattttcatgagagggaaagaaccttgtaacaacgcattatgccatttagctaacaaaaaaatgctgattttgttctatcgtatacgtatgtattctatatgaatgttactggttaatttttaaaaatccacatttcataaaacattataattaattaatgtttctacataaaaaactatactgaaaagtcaacctggaacaaaaatagaatttttatcacaaccaaatgtcattacatttcaaaatgtatctttctcaaaattttttgacaatgataaaagtcaaattcaattattgatatttgattggcaattggtatttgagatgacaactcataaattaaactaaaataaataaatgcaaactttggttatacagggtgagtgagatgccctgttataaacagtgcctgcctcatcccccaacaccgttatcatcattgcatgtttgtattatacataaataaacttgttttctgagcaatcagtacactgtactagactacctggaaacgttgtgaaatatcccagtctgaaggttctctaattacccaaagcaatctttaggtggaagtgaacctacaatcaggaaatattagagagttcccactgtggagtgctacattatgccaaaagtataaataaaattatcccaattctggagactcagacttactaaattattatttgtactttagtcatgaaataaactcagaattcagggtgcaagagaaaagagccatctgattttttaaaaactagtgaatatttaactctacctttttctaacttctgtaacctacaccctagaattggaaatatcacaactatgcatcaatacttctagaagacacctaaagaagtgagatccaagagatcagaaaacaaatacttctaaaagacacctagagaagtgagatctgagagatcagaaaacaaatacttctagaagacacctaaagaagtgagatccgagagatcagaaaacaaatacttctagaagacacctagagaagtgagatccgagagatcagaaaacaattagaagatgcagcctctagaaagaacgaaagagagaaggaaggaaagaaggaaggaaggaaggaagggagggagggagggaggggagagaaagtgagagagagagagaagaaagaaagaaagaaagaaagaaagaaagaaagaaagaaagaaagaaagaaagaaagagagagagaaagaaaaagaaagaaagaaaagaggaaaacatctcacccagcttcttgtgatatgggggaaattttcaacccgatctcttggatctcaagggcccattgcctcaaataatatggcctaagacaccaacaaatagttgtggttcccaaatgagagtctcttgcatctcagccttagccacatggctatacaaagcctttagaagtttgataacatcttgaaagctatgaaaaggaaagaaagaccctggcccttcgtctcatcagtaatggatcattcccagtatgacatgcagaggaactagtctgccacagtgagagtggtggttgggtatactggatgtggcactgtggtgcagtaaaagtcacacaagactagaaaccagaaatcctacaatcaattcccagatagatcagagatgttgggcaagccatagcctctctgagcttcagctgcaagatgggctactgctatctgtcctactaactcacgaggtttttttgaagatcaaattagctcatgcatgtaaaagtgctttgaaaactacaaggttttatacaaatgttaggaacaaaaatttgagtccaatccctttcctgtgcaggttgccttttatgtagcttgatttctaaccaaaaactagaagaatcatatgcaaggtaactagaattatttctctctgtcccagtacttgaataaaacagtaatctttggatttattctccaagaagaaccctataggtcagacaaaacacaaagtgtaacaacagcttaaatatttgaatctccaaacccaatgcttagtaactttcagccttcatcctagcaggtatctatgggcctccctcaatgagacaggtcagcagcatgttctgcttatcagtgcctgacttcttgctcctacacctagaaattaacgtcaaatgattttcagcccaacctaacttcccaaactggtctcctggttctaaccttatcttggttaatcctgaaattctgtttcacctctccaaatcacctctgtttatttcttcatgttcacttttcatgtgctaattatgctttctccctgcactacacccacatctgtggtcaactcccctggggttccttgtcttgataagaagcagcaccatctagatagtttcccaagccagaaaccaggatgcaccaagccctgaagctccaacttcctgatgatcttttccatttccactctctattctccattctcactgctgccactcatgacagcatcatggcttgcccagacccctgagacagccttataactattctattttagttccttctattttctgtacataaaatgtacctgacatgtcctccctaggagcaactcatcaatggtttcctattgctctgggatgaagtctgactttttatcatcactttaaaggcctccatttctcttccattcccacttgtcaccctacactgtacactctgcagtatttaacttcttccaggactgactttacctgtgctgattcttctgccttgaacacacttaactgctcttctgctctcagtcttcctcatattgaggtttcagtttaatcactttctccaggaagtcttttctaatcatcccttagactaggttaggagctcctccctcaagcttcaataggatttggtctgcatgtatttccttatcataggtggtgcctatgaatcacaccttactgggtgagttgggttgcttagttgtctgtccctttgagttgctacaaaatccctgatgatacggctagattcaccttgctcacctagccacagcttgacacataggcagtgttcaataactattctgaaatgttggaatgagtaaaccaatataaaatcttcatctatttttccattgtattaacatccttgaaatctgaattaacactcaacagggacaattgtcttctgaaattcaccaaaagtagtgcatgtaatacactatcatatataacataaaagtagggaggtggctactaagtgagagtttgaaatatttcaaaagcaaattatgactgtgaaatgtttatgatctatgacaaaggttgacaggggaagatgataagtcaacattcaagaaggaaaatgactgtgactctttatatgtaagagaaatgcatttgaacttcaggtggcctctgagcaccttttatcaaaatccatgttaggtttgttaaagtaaaaggttgtcacctcgtcagagtgatctggaaggaaacgtagccagcaatgaatgaagccaacctcgtcaggctctgctttcctgatccgcccaccccgaccaggagggcatttccctgaggagtacgaatgacacgagagatctgtaatatggaacagaaaaagtatgtatctttcaacatgtaaatgttctatttttcctatttattcaatatatgaataaggcctaattattattttggaagatataggtgtctcaagatcagactggagacacactggttgaaggaatgagggcatttctgaaatagaacagtgttgggctgcatcagacggggtgggaaccgtggggtgtgcctttaggaagtaggaggacaccagggcagaaaagtcaacacacagccgagaccgtgcttgctctggcttttaaaggagatatctatctaaaggggactttgaggattcctgttagttggtctgacctaatagtgtatgacaggaaggagaacagaaatgtcagaacaatgtctacccttggcatacagggcatcgtcgttgatgagaatatcctccacatttgaaaagtgttcaaatttaaattgaagggaagaaaaacccccaaaatgaggtgatatggtttggctgtgtctcaactcaaatctgatcttgaattgtactcccataattcccacatgttgtggtggggacctggtgggagataattgaatcaaggtggcggcttccccacagtgttcctgtggtagtgactaagtctcatgagatctgatggttttatcaggggttttcgcttttgcatcttcctcattttttgtcttgccgccgccatgtaagaagtgcctttcgcctcccaccgtgattctgaggcctcttcagccatgtggaactataagtccaattaaaccttttccttcccagtcttgggtatgtctttatcagcagcatgaaaacgaactaatacatatggtatagatgttggaattttaaaaagaaagaaaatgagcataaacaccctcctattacttggcaaagacagtgatacctaaggtatctaccaataagtgattatagatgggtcaggggggccacttcacactgttcaatagcccaagactattccacagcccccttgtggcagaagtccatgtttatttggctttattggtgttgaatggactagttacaccatcagtcttccaaacctacctaggagagatgggaataaaattccccttgatgttctttataccttatgcaagaactgtttctctttccctcctaactgcattttgagcctaggggtatcactgcgatgtccatctttcttagaagaatgatagaggctgggcagggactggaaggggtcacttctccacagccagggaagcttcctgaagtcactggggctctgcattctgccaagtttttgttaaacatcctttctcagaattccctcactagctgcagtgcattctattcctgttgaaaatatgcctggttttgaattactttccccagtttagtgtgaacctggggaaaaggagaacatattttccatctctatgtggacctgagaacctgcaggactggtaggtgcatatgccctgtttttccagcctcctgcttgtcccctctatgtggttctcgccaaagtcattgtgggtggaggtggtcacacatgcctcttcagatcttcccctgacacagcttcaagaggcacagacggtgggtaagaagctactggaagccacactagaacattctgtgtctttccttggttgccacttttcaaccatcatcatttcctttgatgtaggtggatatatcaagatgttgttaattaggtattaaggaatcctcatcccaaaacctttacttggaactgggccaaggtcttacattaaaacacatggtaaaccctcaaaacatatctgacaaaggaacagatacatgaacagagaaggcttgcaaagcagactcaaaacctcataatctagttaaatccagtgagaccctcaaatagggctattttgtcctgttatatacagattgtgaggtggaggtatgcgtttttaatttcatcagcaagtactcaaaaatgaataatgtccaccctgcccctcaggagctcacgctggaacaggggacagaggctggggtcatgagccatggtgagcactggcacagagacaggagtgatggcaaccagagaaaagaatgctggggaaacatccccgcctgggtgaggtatgtcttaggtgcagagctggacttagacttggatgactagaagtacatcacacaaagaaggtggtatgccaggcatgagctgagctacctttaaagaaggagtgagacacacagtatctcagaattagcaaaaggcctgaagtgccccctggggtgagaacttcagtatgaggtatggaaatatcaggatataaggcagcaaaggattgtttagggcttatttgggggacttgattaaattccagacaatgtatccagattctctgtgtggttctcagcagtggtccatcctgtcaagactgaggtcactaagacgggaacccaccctcctagagcctagtcttctgatagggagacaaacacacagataaactttccacaaggtagtatatgggtggggaatacacatgggggaggcgctccaggatcatgatttgtttacccataagcagcccgttgttctggatcacacaccaggcagagcatgactcgggaggctggctggtaagcaggaactagatcatgcaaaaccatatacaccatggtttgaactttcaccaaagagacaaaagaggtatcacacagatacactgtactgaaagaaaattgagtttctaactaagaaaggaactaagaaataggcttggtctcatatcatatcctgttttgctgcagtttttgtctgcagttcttactcttggcttctatcgtgccttgtaactaggccacgtatttcaaggctcacagcagcatgacacagagcgtggaagcgctgtgcacagaaaatgagagaagacagggccagccgggaagtggagaggaatgcaacattttagctcaaaaactctagtcacggattcttcagccaattccagagcagacagacaagaggcagagagtgagagaaaacaccagcgaggccccagcaccgaggcattcacacctccaacatcacacccaaagtgtttcaagaaagcctcctcactcatcatctgggctgcgaatcatggagaaaacggcagttctagtgaacttgctcaagcacgacacttaacataaataactgcatcttcaacttgagctatgaaatcccaggtcattcagattctgtctccagcaggcaggctatttgtcatgaaattgcctttggtaatactcatttggaaaatatattttcctttcctttttcttccttttaattattaaaaatgacagaatgtttattcttcctgaaacaactcttaatcaactataaattaagagcgaatttcaaaatgttatttatagttggctttggaagaatatttgagctcataattcggtacagatgcctcagattctgagaatccacagagttgccaagccaagtgccctcgtgctggggagacccaactcctgagcagcctctctgtcttcctccctctctctgacttactccagccttgcagaaatgcttttctttcttgcagggaaaaggagcaggtaatccctattttcagaggaatggttgactagataacctctaaaaccccctccgtttgtagattcagtaatttttagaggtgacaatttgtaattgtgcagtggttcctcacggtggaacctaaatcatggaagacagtgtcgaatcattttctttctaactaaaaggatgtagtccggaaaagtagttgatatcaactaagtgagaatatcaacaatggatttttacatggcattttcttgcactgtagataaattaagtcacataagttttcaaataaaataatatattctacttccaacctttgaggatcaactgtcctaaaaatggatacggtaatgactcatatcagcagtccctaacctttttggcaccagggaccagtattgtggaagacaatttttccacggatgggacggggctgagtgatggttttggaatgattcaagcgcattacatttattgtgcacttgatttctattattattacattgtaatatactatgaaataattatatagctcgccataatgtagaatcagtgggtgccctgagcttgtcttcctacaactagatggtcccatctgagggtgatgggagacagtgacagatcatcaggcattccattctcataaggagcgtgcaactagatccttcacatgagcattcacaacagggttcgggctcctatgaaaatctaatgccactggaggcagaacttggctttgcatgttcacctgctgctcacctcctgctgtgcagccctgctcctaacaggccacagacacatactggtctgcggccccggggctgggaaccccttctcatatgacaaactagaatagaaattatactttcatggtggatttcattctaacagaattttcatctcaaagtcaactgtttatacactatttttaaattattgtttctaatcatggtaaaatacacataatctaaaatttaccactgtaaccactaagtatattgttcaatatcattaagtacatttacattgttgtgcaactatcagcaccactgatctccacaatgcttttcatcttgcaaaactaaaactctgtacccatttaacactaactccccaatcgtctctccacccaaccctggaattctccattctactttttgtctctgattttggctacactggggatttatatgagtagaattatacagtatttacccttctgagtctggcttactccacataacataatgtcctcaaggcttatgtactatttttttataggatattctttgcatgatacaaaaagatgtagactttgcctgtgctctgaactcagatgtcaaccatattcatcctccgtggtgaaagcactgagctggaagccatatagaaacactgaataaaattatcacatcacacatttaaagtacacaggctcttatttcaagtctataaggtgcgacatgttgcattcagcttagaaattaaattggaatatagcatggagtctaattttaaactgaagattctcctaggaaatgaaaataagagagggagaggaccatggtgtgaagccaaatgtctgtcacctccacaaggcactactcagagtggctactgtaccttgactaagtgaaccatggcatctgcaaagaacaccatgtccatgccggcgccacggatgctctcattatagagctgcaggaacatattcagacgctcttttaggtgactaaaagattcaattggctcataaattttaggtgtttcagcatcagcctcttcagatgtttcacctttggtgggaaataagaatcagttaagtttctgcaaatacctgcattttacttcaatctaaattaatacactcaaagctctacaacctaacactgaataacattcattttaagctaaatgccatagtgtgtattttgcaaaaacagaagacaacaatagaagcgttaggatttttgtgatcatatgcagtctttgttgtttcctatccagcaagagtcaatttcaaataatattatcgtcattgaattgaatttgaacccacaactgattattggcatttcaaaggtcctcccagatatattagcttaatggtcaagtgctgaatgtcagaatcagcaagggaggtcaagaattacaaaactgtttgataagaataaaaagaaaaaggttattgcatttactcaggaaatttttataattcatgaatctcaggtcagtggtaaaaatagaagtgaattagaatatggggtggagggttgagagaaatagaaaaataatttccaaaatgaataagcatattcgattatttcactagggcaagatgtattaaaatcaatatacttttttaaaaaattagaaacatataatataccagcttaacacttttccagtgttaactacaaagcagaggccaaggtgggcagatcacttgaggtcaggagttcaagaccagcctgaccaacatggtgaaaccccatctctactaaaattacagaaattagctaggcctggtggtgtatgcctgtagtcccagctactcgggaggctgaggcaggagaatcgtcaggaggccgaggttgccataagccaagcctgcatccagcctgggaaacagagcgagactctgtttcaaaaaaaaaaaaaaggataatgcccaagaaaaagctaaattgggcacctataaattcacaatcaattaacattagtaatagggaaaaaagggacacattagttgaatataccaataacgacttagaatttcactgggtacgagaagaatgagtgggtctttctaaccttatagtacataattattttcaattgactgtgtcctaacataatagtatgttaatctttttataacaaatgagattggtttaacacaatcatgaagattgacctatctgcaaagctctcactaatcaaattccagtagtcacaattctcataaatgcccaaatcaagctttgagaaatagtgtttcaatgacacaaaaggttatgcatttgtctctagaccctcccccggcccccaaaatgcagcagttgtgctttggtccttgaaaatcataatctgattatttatccttctgaattacagggaataaattacatacattttaattaccttgtaagatgcccttactcttacaggatttttgtatgtgtttgacctgattaaaataaaatgtgtcagcttctttctgcagaaggatcattccaattgcatctccagaaataaacattattttgcaattgtcactcagaaacttttgatagttcacatttacagttatcaaatctagagaagcactgcctagtcatttccaatcattttcaagatatacttagcatgtttttaaacatgcttttaaaaatctgcaaattaacttaaaatccatcctcagtattagaagaggttaaatgaaagaaaaatatttttaactaagcctagttacttctgaggggaaaaaaagtggagcactgcctcttttcataagaaaagtcatatatctcaatttcccctggaaccataatcacaaaagcttgccccacatcagccatctcattccaattacatttaatgaccctctcatacaattggaagttttcctttttattttcaacattcaggatgacctgaataataataagtatcattatatttgctgcctttcatttagcagtgactacaggccatagactgcccaagccattctacagataacatttcatggactccccacggtgcatgtgatgcacatagtaatactttcatttttatgaatgaggttcaagagagtgccgagatgcccagctaactaatgtgtggtggattccttcctcaaactcacctctgtctgccagactgcaagtcctgtgcactctctcctaccgaatcctgccccccaactctactttaatatccaagcgtgatatgcataaactagttcgtctttaaactccatgataatgcattaattcactcatcctagttttattgagcatctactgtgtctcaggcttgtatcaataaagtttactagaaagaaactcaacatccataaactgaatcttctgtcttcagatttccctttagggaacaccttttggggaattccaaattccacttcaatagtttacctgcagcttcaggtgcatctctcaagaaatccacaaaatatgtgtcaattccacaatccaccaagagttttttctcttcaccaaactcctcctctaccaaacttactaaagccttatcaaaccaggtcacatcactggacactgtgaaacggtcagctataacacgtttacactcatgcttccacagctttaacagatcctgttgaaagtataattaaaatgtgttagtaattcctgttatgccgtaattgggaattcaggttgacagtactgtagagtattatccttcctgatttaagattcaacattttaaaaagttagggttcaaatatgctcaacttcacttcaaattgtcctcattcaagtatattaaatagaaagtagtctatttatttgcagtctctgaagtaagaagaaaaaatcctccaacaataatattgaaaattgctctgaccaatcaacaaactaatattctacgtaaaagtcttcagtttgtaataaattagtctttttaataagacatctatattcatgtggccagagtataacataagatacagaatatgaacaactctcatgtatacaactgaaaaattacaaaggtgtattcacttaacacaaagtgaataaaatttgtggcaaaaactggattatctgaacaaaaaaaagcaagcacctaatccagataatccaaggtccaaggttaactgaaagttgaggaaattaattgctcaatactcctgtttatatagcaagaataacaaatgtatgtaagcaagaataacaaatgtatgtgtaagcttattatttgatatgaaagactggtggaaatttcttagcttcgtaacatttttcaggttacagatttttaagccattgcattactaatgatagaatgctatctggttgcctgaatataaaaggagttgaatgaagtatattcaatgattcagttaagacaaaagtttatgataacatcaattgctggaattgtttgtgctgatttaaaataagcatcaaaaatggctatttcaatagtaatctttgaaaactgacttcaacaattccattgacttgtaaataactttgagggaaaaaaatcaagttaaaatattcacgccgctaaactgactctcacttctctgcaggaaggaaagtgagttttccccaaaatatcattaacagacacttctcaaaagaagacatacatgtggccaagaaacatatgaaaagaagctcaacatcactcatcattagagaaatgcaaatcaaaactgcaatgagatacaatatcacatcagtcagaaaggctattattaaaaagtcaaaaataacagatgctggcaaggttgcagagaaaagagaacacatatatgctattggtgggagtgtaaattagttcaagcattgtggaatgcactatggtgattcctcaaagagctaaaagcagaactaccatttgacccagaaatcccattacagggtatatatacccagaggaatataaatcattctactatgcacatgcacgtgaatgttcattgcagcactattcacaatagcaaagacacagaatcaacctaaatgctcatcagtggcagattggataaagaaaatgtgtgacctatacaccatggaatactatgcagccataaaaaagaatgagatcatgtctttcatgggaacatggatggagctggaggccattatccttagcaaactaatgcaggaatagaaaaccaaatactgcatgatatgtccccacccaaatctcatctggaattgtaatcctcataatccccacatgtcaagggagagaccacaaggaggtaattgaatcataggggctgtttcccccatggtgttctcctgatagtgagtgagttctcacaagatcttatggttttataagaggctcttccccttttgctccacacttctccttcttgctatcttgtgaagaaggtgccttgcttcctcttcgttttccaccatgattgttaagtttcctgaggcctccccagacatgctgaactgtgagtcaattaaacctcttttcttaataaattacccagtctccagcagtttttataccagtatgaaaacggactaatacaccacatgttctcacttataagtgggagctaaatgatgagaactcatgaacacaaagacagaaatggcagacactggggtctacctgagggtggaaggtgagaggagagagaggagcagaaaagataactattgggtactgggattaatacctgggtgatgaaataatctgtacaataagcccccatgaaacatgtttacctatggaacaaaccttcacgtgtacccccaaacctaaaataaaagttaaaaataaatcaacaaataattttttaaaaaaaaaagaatcggcaagtttggttacctatattgcaagcatctggacagaggtgagtttttttagtaatcaacacttgtgcttaatgaacagttttgttgataatttaactgtctctgtgtgtttatatggagaagtcccctaaaacccatttgcttaattacttctttagctctagaaaggcttaaacagaggccaaccctgtcttagcctgggcacataggctacgctttggaacaaaagcatactggattttcacatagcattcttagtttgagggaaattcttataacactgggaaatgtcatattcaagtgtgtgtacaaatgatcatttttctattaaatgaacttcgtaagctgctgcctctcctcaactttaccaatgtacgtaaatcttttagtgcatccagttacatggaaaagaaaaatcatagatgattatcaacaaaatgggttttttaattttgaatatttattataaagataattactttttaagttaaagtgtcaagcttaaaatatgaagactattatatagtaaaatccatagcgattgtttccattatttagtataagaaacatatcttcttctcatactagaactgggaaaataaatcaattgtttcttttattcttttcattaaaaaataattgtgtatatgatgttcttaaaacacaaacctaatttaattggaatttatcattgactgacattttctgacataatttatttcattatgttagtttaaaagcagtaaagaatacccatgctgaaacattccaaaatatgttcacagttcaagtaaaaaataaatcaataaaaatatttagaatatatcattaatagcaatgttatttgtttttctttcttcagtgtcacttacatttggttccttgatgacctctgaagtagtgttcagcattccctgccagacccgagaaagatctcgtaggttaaacacataatggaattttgcaggggtaggaagcattttaatcttggtcatctgccatagtcggcgtgtcagaggcaccaattttgtcacagaatctctcacttcttctgagaaacccctctgagtacagtagtggcctaccccaatcacacctgaaaagggggaaattacagcattttgattagccattcaaagaaattaaatgaaaatgaaaagcattatagcatagggtttgcaaaaatgtcattatacattttaatagataatcacatataaaagaaaagtatgttaatgttctcttgttttttcaaatacagtataacaaaaaatagatacaagtttaagaaaataagttcaaaacactgaaaaactgattaagaaatactgccgaagactctggttgcaccacttcaatattattaaatgggtaacaatgataaatgcatgaagttaccttataataagataagaaaaaagtttttataagtcctctaaggtttctagtttctgtcattgcctttccacgcattataaaatactttcatttactttttatgtaaaattttccaggcaataaggaataattaaaaatgataacagtcatttttttctggtccatgtttcttttcccaagcttagataattccaatgtctgttggtttccagaccttgctcactgctgtgactgaagggagattactgccatacttcactagcctggggcacccagatgacattttcgtttgccagaaattaattagggtaatcctgatgagctttttctcaatagcagcgtcagaaattgtaaactaaatacttaacataaatgtgttcaaacctttatgctcttttctgcacaaataagtcacaagtgcataatcattactcgggtaggcatatatgcttacttatttggctagtgattgttcgactaaattatctatgaaatactacatatttaatcaataacttattagaatccagtaaattactctgaatttcagaccgtgtccaatctgcgctctgggtgccattatttctttggccaaaatcattctatgggttggttaaagtataagctacataaactttcgacatggaacatagcaatccagacctcaaaactatgtgcccatgaggaaacaacctcatgtatggggaaacaatttcatttccatgttcatttaatgttaaacctccttgcttaagaagttagaaacagttaaagaaaaccataaatggaaaagctctaccaagtcatccaaatcaggaaacacctagaatcaatccctataggaaatgaaatacactgcttgagagtgatggaggctgtagaccaaggagccacccagtgctctttctgtgtgggtcttgggtgaagattttcaaaaaggaacccaagcaggtgttcttcctcaccctcccaccccacatcctcttgatctttaccaaagatcttgtccacagaagcttcagagggcaacgtgcaattaaatatagagaactgcctcttgagtctttggggtatgtcattgcgtccaccaccaggatggatcatggctgccaaaaactggatgtccacgatgctggtgaactccccaggcttctctagattatagaatccattttgttccatcagctgtcgcactatctcattcgtaacctacaaaagacaactttcagaattaaagcatcattcctttctatccccggagcctaactccttgagtgtttccaaagaaagaactttactggaattcagaaattatatcttgaaaaagtaaaaacttaaaaaaaatttttaaaaactcttctaagaataaatcaataccaaattaaagaaataaaatgcacaatagaatgatgatacctgatctccccactcattgattattggcatattcacatcatcaataaaaacagtcatcttctttcccgcaggagggccatatgttgtacccattcgtttatccacatagctctctatcgtcctctgtgaaaaaaaaatcaactgaaacatctgtgaaaatatcccctaaaacctggtcaattattttaaaaaacaacaaaaactggtaacctttgaactgatatgaattatttctaaaaagccaaatttcccccttaattctaacaaattctaaagtacctaaattatcttgtataacattcacaaaatttgaaaatccagtttaatttagaaggaaatgaaattctaaccaatgtgaatttgaatgggatgagactcgtctgtccatttctaaaaatttacttttgtcttcttctgttggtgacactatgttccccattattcaaagtcttgctaatagtttccctataaccagcaacaaagttaaacaaggctactgtgtgagaagcttctgaggtctgcactccgagctgcacagcccatcatggtctgaaggctgaaactgactgctgtcacctggcacagctcatacccactcttttgggcagatgcagttacacggattcaattctcattccctgacacagagtgaacaaagctcacttatgtcttctctctcatttttacattctgagcttaggcagtgcaagagaagaccacgctgcactctgtaaaaaaccttccttgaggccgggcacggtggctgatgcctgtaatcccagcactttgggaggcagaggcgggcagatcacgaggtcaggagatcgagaccatcctggctaacacggtgaaaccctgtctctactaaaaatacaaaaaaaattagccgggtgtggtggcagatgcctgtagtcccagctattcgggaggctgaggcaggacaatggtgtgaacccgggaggcagagcttgcagtgagccaagataacgccactgcactccagcctgggcgacagagcgagactccgtctcaaaataaataaataaataaataaaccttcattgcagtacacaaaaagatattaaaactgaaagaactgggacacatttaaagcagcgtgtagagggaaatttatagcactaaacacccacaagagaaagcaggaaagatccaaaattgacaccctaacatcacaactaaaagaactagaaaagcaagagcaaacaaattcaaaagctagcagaaggcaagaaataactaagatcagagcacaactgaaagagacagacacacaaaaaacccttcagaaatcaatgaatctaggagctggttttttgaaaagatcaacaaaattgatagacggctagcaagattaataaagaagaaaagagagaaaaatcaaatagatgcaataaaaaatgataaaggggatatcaccaccgatcccacagaaataaaaactaccatcagagaatactataaacacctctacacaaataaactagaaaatctagaagaaatggataaattcctggacacatacaccctcccaagactaaaccaggaagaagctgaatctctgaatagaccaataacaggctctgcaattgaggcaataattaatagcctaccaaccaaaaaaagtccaggaccagacggattcacagccaaattctaccagaggtacgaagaggagctgttaccattctttctgaaactattccaatcaatagaaaaagagggaatcctccctaagtcattttatgaggccagcgtcatcctgataccaaagcctggcagagtcacaacaaaaaaagagagttttagaccaatatccctgatgaacattgatgcgaaaatcctcaataaaatactggcaaactgaatccagcagcacatcaaaaaacttatccaccatgatcaagttggcttcatccctgggatgcaaggctggttcaacatatgcaatcaataaatgtaatccagcatataaacagaaccaacaacaaaaaccacatgattatctcaatagatgcagaaaaggccttcgacaaaattcaacagctctttatgctaaaaactctcaataaactaggtattgatggaacgtatctcaaaataataagagctatgtatgacaaacccacagccaatatcatactgaatgggcaaaaactggaagcattccctttgaaaactggcacaagacagggatgccctctctcaccactcatattcaacatagtgttggaagttctggccagggcaatcaggaaagagaaagaaataaagggtattcgattaggaaatgaggaagtcaaattgtccctgtttgcagatgacatggttgtatatttagaaaacaccattgtctcagcccaaaatctccttaagctgataagcaacttcagcaaagtctcaggatacaaaagcaatgtgcgaaaatcacaagcattcctatacaccattaacagacaaacagagagccaaatcatgagtgaactcccattcacaatggctacaaagagaataaaatacctaggaatccaacttacaagggatgtgatggacctcttcaaggagaactacaaaccactgcgccacgaaataaaagaggacacgaaaaaatggaagaatattccatgctcatggatagaaggaatcaatagcatgaaaatggccatactgcccaaagtaatttatagattcaatgccatccccatcaagctaccaatgactttcttcacagaattggaaaaaactactttaaatttcatatggaaccaaaaaagagcccacattgccaagaaaatcctaagccaaaagaacaaagctggaggcatcacactacctgacttcaaactatactacaaggctacagtaaccaaaacagcatggtactggtaccaaaacagagagatagaccaatggaacagaacagaggcctcagaaataacaccacacatctacaaccatctgatctttgacaaacctgagaaaaacaagaaatgaggaaaggattccctatttaataaatggtgctgggaaaactggctagccatacatagaaagctgaaactggatcccttccttacaccttatacaaaaattaattcaagatggattaaagacttaaatgttagacctgaaactataaaaaccctagaggaaaacttaggcaataccattcaggatacaggcatgggcaaggacttcatgactaaaacaccaaaagcaatggcaacaaaagccaaaatagacaaacgggatctaattaaactaacaagcttctgcacagcaaaagaaactactatcagagtgaacaggcaacctacagaatgggagaaaatttttgcaatctacccatctgaaaaagggctaatatccagaatctacagagaactcaaacaaatttacaagaaaaaacaaacaaacaaccccatcaatagtgggcaaaggatatggatagacacttctcaaaagaagacatctatgcagccaacaggtacatgaaaaaatgctcatcatcactggtcatcagagaaatgcaaatcaaaaccacaatgagataccatctcatgccaatcagaatggcaatcattaaaaagtcaggaaacaacagatgctggaaaggatgtggagaaataggaacgtttttacactgttggtgggagtgtaaattagttcaaccattgtggaagacagtgtggtgattcctcaaggacctagaactagaattaccatttgacccagcaatcccattactgggcatataccaaaaggattataaatcatgctactataaagacacatgcacacgtatgtttactgcagcactattcacaatagcaaagacttggaaccaacccaaatgtccatcaatgatagactggattaagaaaatgtggcacatatacaccatggaatactatgtagccataaaaaaggatgagttaatgttctttgcagggacatggatgaagctggaaaccaccattctcagcaaactatcacaaggacagaaaaccaaacactgcatgttctcactcataggtgggaattgaacaatgagatcacttgcacacagggcgaggaacatcacacactggggcctgtctgggggtggggggctgggggagggatagcattaggagaaatacctaatgtaaatgatgagttgatgggtgcagcaaaccaacatggcacatgtatacctatgtatcaaacctgcacactgtgcacatgtatcctagaacaacttaaagtataataaaataaataaataaataactgaaagaagggacactggaaggggtaggaagaggatctgaggagaggactccaggctcttgactggtgttctcacgtccatggtagtgcaatgtggcttgggaatcaattgtctttcaaaatgtatgcatgagtaaccagagtctggcactgcaaagcaaacagaaagggctttgaagttctcaaactccagaagcttcaaaactcaaaagctcatttcatttatataactgtaggaatccactaatgcatgattttaaatcatgttaaagatgttgtataaatacagaagaaagtggaggtatgtaaagataaaataaattctccttctcttatccaaaagatgttttatttcatgacaaagaacaaaccagttaaaagtgaattttatgaacaagatataaccacaaaatgagacaaaatataagacaaaaaaaagcaaaactctatacaactgtccttgagaatcttcacagtaattgcacagtgtacattttcatcatgattttatttattttatttatttatttatttatttatttatttatttatttatttatttattttgagacagtgtcttgctctgttacccaggctggagtgcaatgttggctaactgcagcctttgcctcccgggttcaagcgattctcctgcctcagcctcccagtagttgggattacaggtgcacaccaccacaccctgctaatttttgtatttttagtagagatgggatttcactatgttggccaagctagtctcaaactcctgacctcaggtgatccacctgcctcagcttcccaatgtgctgggattacaggcatgagccactgtgcctggcctcatcattttaatgaataatagcaagcaatgtgaaaatttttcactatttttaaatagaatgagatataaatatattacaactcattcaattacaaaacaaatctcccatgacattgtacaatagcaaaaagaatttcatacccccccccacaaaaatgcaaaattgtttgcatttgctaaatttgctcttcttttcaatgaattgaaatgcacctccttatggccaactaggacttccagacattcccatgtctattaatgagaacactttttggcacatgaagattttatgtattgggaagctttctcaagagctaaatgtactaggtgggatagtcagagtaatacagagtaatagccacacacctatattttcttcccctccactgtaaccctaatttttttgaaatgataggaaatcatccctatcaccactaagctatacatgtcataaaagagttaaattgacaaaagcacaacaaaatagggagaaaaattaagcaacctgagaacctagaagttgagatttctttccatttttagaattgttgcagattcaatagttacctgagtgttgaagtttggtaagacctcctgaaggcctgaaacacaacacaggttggttatgccttctctgaaatgcttggaaccagaagtgttttgtatattgaatgttttcagatttgggaatatttgcatatacataatgagatatcttggggatggaacccaaatctaaacataaaagccatttgtgtttcctatatacactttatatatataaccaggaagtagttatatatgctatgtatgtatgtgtgtatttattaaaatgtgtatttatatgtttacttacattttattttaaaatatttaaaattaaatatttcatatttatacaattttgtgcatgaaacaacattcgtgtatattgaacaatatatgttggacatgcttgcatgggggaatctggtagtgtgctgaaaagatatgaaagcaggagggtgctgggagggtctttcttcccttggggatgctgaataaactgtgtgttgtgcacctgcattttgactacaacctgtcacttgaggtgaggtgtgaaatattttgagcttgccaatgctcaaaaagttttggattttggagcaacttgaatttcagattttcagattaggcatgttcctcctgtattgcatgctctactcctttggatagctatccatttggggctgttcgaaaaaactgtatacttggacatctgatctgtccaagctggaggttccataacatcacaaaaataagcatattcaaacataaactccacttccttactcagcacaaagtctgcacccctttggggtgctcaattcagaaagtggcaccaactacctattgccccatccaaaaatttccacatctaacaacactgagtttttctattataatttcaacaccctttctaaagtatctcttcctacctaaacaacagtaggcccccattccattatgtctttctttctcacagggattaatgtcatgaccccttaaattgccttccctgactgcagtcaatcctggaaacttccttatgactcatacacaatggctatattgcatgatttgtaattttacctagaatttttttgtctcccccaaagaaatccgtctaaagaatcacggatcatctgtgtagtattctgccacccacattccttccaatctctttgattggtgttcccacctcatccactgttttgctgttatgaactgcggtccagttaataaaaccaagtagatatgttcgcttattagattattgcctgtctcctccactagaaggtaaggagggaaggcaccttgttttccttactttactcattatttcatcctcagtgtctagaagggtgtctggtactatgtgtttgttgttaaatattttttacataaataaatacaagaaacctggagtcatctttgacttttctcactgtctcctatgcctctcctccaacaaccttgatatggtttggctctgtgtccccacccaaatctcatgtggaattgtcatccccaatgttggaggtgaggcctggtgggaggtgactggatcatggaggtggtttctaacggtttagcactatccccccagtgctgtctcatgagtgagttctcacgagatctggttgcttaaaggtgtgtagcacctccacctttgctctctcactcctgctccggccacgtgagaagtgtctacttccccttccaacataactgaaagtttcctgaggcctccccagccacgtttcccgtatagtctgtggaatcatgagccaattaaacctcttttctttataaattacccagtctcaggtcattctttatagtagtgcaagaacagactaacataaacccctactcaaccaatcacaagttctggtagttccacttcctaaccaaggttgaatgcatccttgttctgtttcctttctcattttaccatcttggtccagcccaacctccctcctgagaaatgactgcgactgtctcctctcaggtctctctgagtgcagccatgtctcttgcatcttgttctccactctacagccagaatgagctttctaaagggcaatgcaatcctcctcaggactccagggggttcctcgtcagtgacttacagggaactctatggtacccactacttactcctccagtctcacttccagacagtccttctcactgtctttgttctggaccctcagggtcttagttcatttacatacagttaaaaaaaaacacatagactgtgaagtgatgttcaccttataggctggcttacagtattccttatgggatccttatttatatatttctagagtagccatttctaagccaaaaaaaaatctctcaggattatcattagccaaattcacattgtgaaatattgatttagatgagtgatcttctaaaaatgtcacttctgtcaatccagttactgatttttaaaaaaaaaaaattaagtctctagcaaggacttgcactaaggacatatactgttctttgagaatagacaatcactttactctgaaattggggaatcgtagtcagcatgacagcatcttatgcaatttatgaaacctaaacaagattccaatctcattgtctgtctacacacataggatatcattaacccaagctgtgacagcagcattttaagacatgaaaaccagatggtcagaaaaccaggtaggctgaggaatggagctcccttctggctcttttctgagctagaagccctaaacctagggacaattcaattactgaattaatttctcaatagacaactcagcttttataattcctagaaattaatataaataataaactcccccaaggaatgatcaactctttcattatgctgatttctgtaatcccctatggaaactaatcggctcctcctccggactccacagtacagcattgagattctgccataagtagcacttatcttgtcaactacacttggttatgcacatgtctgtttccccaacaagacaaagggaggaaagcaacattggaaggggtattggaaggatcatgtgcagctgaggcgacggtgcattgcctagttcttaggtacaacattcacgcaatcatctttgtgaatgagacacagtgcaaaatctgcacgacctgcaaggtcttacataacagctctgactaggctgaaagtcaggaaaaacgaactaaactactgcttctcacatttatcaactctatgatttcaggtaagccacttaatatttctgggtataatacaacccagaaatgagagtgtgtatagatacgtaaatcatatgtacgtacataaatatgcatatgaatatgcatatatgcattatgcattaatgatataatatatatgaaagcaattcatgagcttgctacagagtattatgcattaatgatatataatatatatgaaagcaattcatgagcttaatgtagtataaaatgtaaagctattttattatttctatgtgtagctctatacactagcacctaaatcatttttcatgcatgttacatacaattaaacagaaatataaaatataattaattttaggttttcatatgtgtgctattagctaaaacataaaaatggagagttatgctctttattaagaaatctactgcctaataacatcttcccattttattgtaattcaaacaaaaatagtcttacattaggaaagtttaaaatgctcaatagtacattgtaaaaagtaaaatatgtcaaaaatcacatgaaaatacaataatgcataactgaagctaaaaataaaacaagtgcactaagtgataaaccagccctttagatattaatatagataaagaaaggccattggaaggaagcatgtgggtgcacagcacagcagagcacatggaccctggtttccagctgtttccagcttaggttctgccaccaactaagtgaattcagacaatgcttgaatctccttccacccaagtacatcagtcttaaccgtaaaacctgacattttaagagagctttatgatacaaatatactttcacatattatctcttaggaaactagtcttcaaactgtgctctgaggagccaaaaggattttctgcaaacacagggatcccttgcaggaagaaaagatgaggctggaatgggctgcaggaccccagctccaattccaccaaagcaaatccatggttacttattttatagattaatctactgcacaagatgtcacttggaaaagtggttctgggtccaaaaaacactgtggaatttccttccaggtctaggagtcttattttttaaaaaataaaacctattgctatgcaaccatttgtaagatggtagctatattcaaaaaactttataattatttttagaaatcttttcagaaattatcttaatttttgctttcttcttttcaccttcttgtattgcttaaatttctacttctatgtatgaattactttcaaaaataaaaaaattaatattagttcggggggaaaaatgaggaatctttcttaaaaaatggactaaattcccttagccaaaaaatggagtgactgtataatttttgtccaaacttttgatagtggcaaaggatgctattaattattaatctgagacaatgaaagtaacctggattgtccgaggcaaaaagtgacagtcccctctactgatgaaagatgtgaaagttacatcaagatgaaaacaacctgtgaagtaacagatacgcgcccttcgttggacagtgtgccatcttggtaacagctgagaaatggacagtatctattttctcatctacaatttcagtttggttgggatccagatacgtgggagatgcagagacaaatgctctgctccatcagccctgtttagcatgaatgactgaaaattacagtgagaaagttaattacaacagtttggctaattgaaagctttctaaaactaatgagtcttgcttaatagaaatccctgatgctccacagtcaaaacagtctctggcacgaaacagagtggatgatcctgtgatgcttctgaacagaaaaaagaaatagtgatgtgttaactccaccttaacactgaagaacagtggggaatctggctaaagccatgtgtatcagataatgggagcctaaggaatacttcactcttcttctatttattatatttgaatatggtaccacttctagaaatttattatatggtttatgaatttgtatatcaaacaacaggttttctagataacatatggctttttccaggaaacgagtacatatttcatgttaaagagacagaaaccacagatctttaatacctggcagagataaatgtcacagagttggtaacaaaaacgcaatgacaaggcctcattgcataataaaagattggactggcctttgttcctggctcctgggatggagtctttaaaccctggaaatttcctgagtgatagaaaggactcacatgggcccctcataccactcatgccaaccactcatcaccagccatgtgatgagaaggttgaagttttaagtcacatgatatcagttgacctgggaggggagctgatggagatttgagttcagtcttaaagatcttggctgggcacagtgactcacgcctgtaatcccagcactttgagaggcccaggagggcagatcatgaggtcaagagatcaagaccatcctggacatcatggtgaaaccccatctctactaaaaatacaaaaattagcggggtgtggtagcccatgcctataatcccagctactcagaaggctggggcaggagaattgcttgaacccaggaggtggaggttgcagtgagccaagatcacacgactgcactccagcctggtgacagagcgaggctccgtttcaaaaaaaataaaaagatctgagtctcgtcctatggccaatgatgtaatcaagtatgcctatgtaataaaaccccaataaaaacccaggacaccaaggctcaggtgagtgtccaggttggtgatatacatgatatgcctggaaggtagcacatcctgaggacagggaaggtttgcatttgagaccctcccaaacctcgccctctttatcttttcttttgactgacacttacttgtatctttgcaagaaagctgtaatgataagcatagcatttctccgagttctgtaagtcattctagtgaattatggaaactgagagggctgagggaatggcctaatttgtagccacttggtcagaggtatgggtctcttgagaacccctgagcttgtggctggtgtctgagtgagggcagtcttgtggggactcggcccttaacttctgaagtctgcattagctctgccatagttacaatcagaactacactgtaggcctaaagagttcatacagtctcatgaagtgtggatcattagaaaatcaccccacataatgaaaaaataatcacactctgatctgatttttttaaaacctttatcctcaaataatgttataattataacctttaaagagaatgtcctcctaaggtaaaactaacaaaagctctttaattgtaaagcggtattaaaggaacacatataacgttagcatcttgccagcctagggtaatttaatgtgtcctttcccaaacacgaaaatgccactgctaagtcactgcaatttggggttgaccatccatccagatctgcccacccagacactatatgaatggtatttatttgatagaaagatagcccatactggaaatcctgtctcctccagaagagtataatgaagctgacagtcttatttagaagtttaatcaatgatcttagtgtattggcactccgctgtcaccaattaaattaagtgataaaaagtggtgatttaaccatgccttcaacaagtttcattgctctgatattttcattccaacagctaaagaacaacaaagttcattaaaagcaaagttctttggatttgtgttcccctaaaaatttcccttctatttgcaatttatgacatgtatcttctggtgatatattaatgttctaataaaaatatgagagataatttgcaaatcactgaagcatgtactgacatttaggatttcctcctcagtttcaataaggtcttgtacaatttaggaccaggagaaaaagaactatttaagccactgcaaatctaggtcattcctggtggtttcattgggaaaaaaaaataaacaacgcaaacttgaggggttttttttctctcacacttctgtgatacatagagcaaaatatttcatatctaagggtctaagattttataccttgttgcaattgagcatgggagctagggtggaatgttaagtcggggaacaagattaaagtggcattctaggaagtaaggagtggaaggtataaaagctagactgaaagagaattcaacttgaaccaatcatagctggggattcttccatgccaataacctggtacgcaatcatgcagaagtggattacctagaggtaaaccaggagcatgaagataaagaaatagatgtgaaatgcatttcttttggtactgtaacagcctttgagacctgagcaacagggacgcattaaagattattacaaagtgcctagcctaaaagagtattaggaacaccttcaggcaagcagactctagggaaaggaagtaggtttaggtggggaataaatgattttctttcagttttggattttgcgtgttcacagtattttctacatagatattttaaaccgcattgaggcctatagcaccttatataagcttttaatgtttccataatttaagatgttatattctaactagggaaactattgcagttgaataattgaaagaatggaagacgtacgtgggtgatttatcatggctatgaaaattcagatgagattcaattgaagcagaatagtagagatttgagcctccaaagtttatcacaaaattgggcttactgagccataccaaagagccagtacctggaacatcagtggggtggttgcagaagaaaaattcagactcttgatcatgtgacattcaggatcatattttgacataaatcctttaattattactgttttggctgttccttgttcaccaattaatagcacagcctaaaatagagggaattgaaaaaaaaagaaatgaaataaatgagtgtgatgggctgaatttgtccccccaaaattcatatgctgaatcttcaacccctagtaccttaaaatgtgattctatttggagataaggtctttaaagaggtgactaaggtaaaataaagctgttggatgaggcttattccaccctaactcgtgtccttataagaagaagaaatttgtggccaggtgtggtagctcacacctgtaatcccagcactttgggaggctgaggtaggcagatcacctgaggtcaggagttcgagaccagcctggccaacatggtgaaaccccatctgtactaaaaatacaaaaattagccaggtgtggtggtgtgcacctgtaatcccagctacttgggaggctgaggcaggagaattgcttgaacccgagaggcagacgtagcagtgagcccagattacactattgcactctaacctgggtgacagagactccatctcaaaaaaaaaaaaaaaaaaaaaaagaggaaatttgtatacacaaagaaacaccatgggaagaacacagtgagaaggcagccatctaccagccaaggagaggcgcctctgaagaaccccagcctgccaacaccttcatcctggactttcagcctccagaacagagagaaaagaaactgctgttgtttaggccacctaggctgcggtatttggttacagcagccctagcaaactagctcagcgatcaaagcagaaggaatcctttggggaaaagcaagtcaaaatttactttctgtcaactcatacataagaaataattactgacttatgaattagaactattcaactcatattttagtggggaataataaaggaatagtaggttaggtgacattttcgtgtattctaaactgcaacataaaacattttataataaatgcaggatgcttcatgttggctgggcacggtggctcacgcctgtaatcccagcactttgggaggccgaggcgggcggatcacgaggtcaggagatcgagaccatgctggctaacatggtgaaaccctgtctctactaataaatacaaaaaattagccaggcatggtggtgggcacctgtagtcccagctactcaggaggctgaggcaggagaatggcgtgaacccgggaggtggagcctgcagtgagccgagatcgcgccactgcactccagcctgggcgacagagtgagactccgtctcagtaaataactaaataaataaatgcaggatgcttcatgtctccccttaaaatatgctacagttaataaaaattaaaagtcataccttgccctgtttagcaatggtttgaattagaaagtcagtcctcacattgtcaacatttggcaccagaatagaaccatactctggggtggtatcagacggatacaggtattcctgggtacgcgtgttccagtgcgtccatgtacctaaggtgagcagaggacatttccatctccatattaataattcaactccgaactgtaatgagcagacatccttgaaatcttatgaggtcaccttccaaattctccccataaaatgaagatcattaaaattagagatctaagtacacaagtatgtgttagctgagtcaaaacgtcccaaggaacaatttcaaggtggtaaacctaggaaatactaggaagtattttggaattttttaaaaatatatattagttttcaatagcatgaaatatgtataaaaatacagaacagagtgagagtagtgtgtatctaaaatcattagtcactttcgaatgtctaatctcacacttttcattaggcaaaagatcctaggctgatgcatatgtatattaaatagttaatacattattatacacccacatatatgtacttcattttctgtataaatgtactttatatatttatacatacaccaataaccttaaagtatatatacatacagagataaagatatacagctatagatacacacgtatttggcaaaaatatactttaaactttgtgacttttatacaaattgctgattatattgaatgagtgacagaaatggatctgatttggttttttaaatgtttcttaattcattgaaagtttagtgcacaagatatttaacaagaggaaaatgtgcatttgaaatacaaagtagattttttaaaaagaaaccactgttcactttcttcacacacgaacgttttcatatcttacagccaataattataaatctcatttagaaaaaatatatatggtgtaaatattggccatgtaggaaagaacggcccccatgggttccgtctggacgggcaggtgtcctcaccatcgggcgccacatagtagtcgaaggcggtgtccccgggccccgctggcggcggcagctccagcgtccctgtgggccgagagcgcagccagagctccaggcggcgccgtccgtccagctccagcgccgcccccgcgctccacagcagcgcgaacacgaacagccgccccaggtgagcctggctcacctccccgccttgctcctgagaaggaaagacacttttttttaataacttgattctgaaacccaaacgttgctctagggtttcaatgggaacagtaaacatagaaacaagacactagttgccctccaagaacaagggaaaggatgaatacaactggagaacaaatgaagaactgatctctgagaatagcaagctgcctttaaacataatagggttggccgggcacggtggctcatgcctgtactcccaccactttgggaggccgaggcgggcggatcatgaggtcaggagctcgagaccatcctggctaacatggtgaaaccccgtctctactaaaaatacaaaaaaaaaaaaaaaaaaaattagccgagggtggtggcgggcgcctgtagtcccagctacccgggaggctgaggcaggagaatggcgtgaacttgggaggcggagcttgcagtgagccaagatggcgctactgcactccagcctgggcgacagtgcgagactccatgtcaaaaaacaaaacaaacaaacaaaaaaacagggtttatcgcagcactgttcaccacagtcaagacttggagacaacctaagtgtccatcaacagatgaatggataaagaaaagtgctacatacacacaagggagtactattcagccataaaaaagaatgagagcctgtcatttgaacaacatgaatggaactggaggttattatgttaagtgaaataagccagacgcagaaagacaaacttggtatattctcatgcatctgtgggagctaaaaattaaaacaattgaagtcatggagatagagtagaaggatggttaccagaggctaggaaggggagtggggaggggtgaggaaatggggatgatgaatgggtgcaaaaatacacagtgattgcagtcagcaataatttgttgtgcattttagagtaactgagggagtccaattgtaatgttcataacacaaagaaatgaagaatgaggtgatagataccccattcaccttgatgtggttattacacatagcataccagtatcaaaatatctcatgtaccccataagtatgtatacctactatgtacccacaaaaattaaaaattaaaacacacacacagtaataattttgggatacccgttgcatgactttgttaacctgcaactaaattccaaatccatggttagctgtattttttgttaaagggatatgaaaaaataagtatatatgtgggatccatgtttgaaatattccccctccccaacagctctaaccaaatctaatttcaaatatagtactctctgtatagcatggctacattaataagagagaaaatatagtactctctgtgcagcatggctaagttgataagagagaatttctctagaaagttgagcaatttaccttcagaggaatcaggccttgaagcatgttaatgctctgtgtgatgacaaaggcctccagcacctccatcttgtattctaagttctggatacagaagcgatacaagtctgggaaagactcggtgtacagctgacgaagaatttctgcttcttgaggtgagcgtttcttaagaaaaccctgtcagttcacagacaagtgtattcatgaaacttattagcacactaggaaaatggtcatttggggacaaaaattttaaaagtatctgttaataatgataatatctaatgattataccacacactatgttccaggctttgttacaaactcttccacgtattaattcacttaatcttcaaaacaaccctacaaggtaagaactgttattatcctccttttacacatgaggaaacagaggcccaggaagtgtaggtagcctgctcaggagcccactgcaagcaggtggcaagggcagaattcagacccagaaagcctgggcctacatgttcagctactacactatccatatgctcacagatggagaaatagtcttcaactcttgattaaaatatgctgggagaaaatgagaaggcacatatatggaaataactcaggggggaaaagtaaagaataaaagatgaacaaaggaaatccatacccaggtttttttttctttttttgagacaggatcttactctgtcactcaggctggaatacagtggcatgatctcagttcactacaacctccacctcccaggctcaggtgatcctctggcctcagcccctcaagcagctgggaccacaagtgcatgccactacacccagctaatttttgtaatttttgtcgagacagggttttgccatattgcccaggctagtctcaaactccttgcctcaagcaatctgcctgcctcggcctcccaaagcgctgggattacaggcatgagccactgtgcctggcccccagatttttttttaacagaaaacaaagatttactacaattagttgtttctttttatttcttctaatttaattaataaacaatgtagaaaaatatcaaggatattcatgaaaatggagaatttagtcatttgagaaacctagtattaagaaactgcatctcataaataccacttaacacacagcgtttccttaagatgaggcaagttctcttaaggtcaagagatcagctcattcttcacctcagtattccaagaaacaattagagactctgaacagaagcaataaaatgttgattctgaattattcattagttcatgaatttaccatgattctacctcgacaaaaacataacatagcacttttgagttgatggaaccgaaagacgacattcactagggcaggtaaccaggttggctccctgaagctgacagattgtcagcaacacaacttttcaattactctgccctctaataactctcagagctggccttcctgttctaaacatttccaatctgattcttctcatgagtcttgcttttcctaacaatttccaaaaaagaaaatgcattatttaaaacatataggatattatgaggtgggtatagcattaaagtaaaggtcttattcagtctcagtatggacagactatagcaaaagcttattttataaatagcaaactcatgcattagctagtactccttagctagttgtataaaagtatttttcaaaaacctttttgaaattgaagtattttggaaaaatcatatatatacattttcactggtagtttgctgtacctgtggtttccaagcctggctatgtgaaaaaaaaatgttgtggcacttaaaagaaaaaaaaaaaaaaaacaatcctgagttgcctcccagagattctaatttggtaagattgaagtgtaacccaatcatctgtattttaaagaattgtcattagtgattacttttgcaaaaacagggttgcaaccctctgcttttattctccttaatgggtggataatctaattgtgaaatctgaaaactttacaactatttttagtgacacattcaactctatgtcaacatcattttgctatatgattccctccttcttcccatcttcataccaaatctaaagccttttgcaacagagttgagtaaattctggaaagacattagtaaaaagttaggatataaccatatagaaataaaagtttgaaaatgtaatgatataatgtaaataaacatctactttatttaaattaggaatttaaatgttttcaatcaaaatcatcttcgaaaaacttaggtgatgaaaatattcaatataaccaactatgtaaaacaagatttttcatgtggcttatctaataaacattctgccttacattataatatttatatagcaaaatatctaagtatgcaaggcatttatttataatataattttgatcaatatattctaggatatattgctggtaataaaataatatacctgattatgaattgatgagatgttatctgaaatattattgccaagttcaaatttggaactaacgttataactaatgaatctcataaaaattccttatatgcaattttaataaactgactccaagttaatgttctaagatggtcctcctaaactttatgtgaatgtgtacctttcaaaaatatcatgaatccccagattgatcaaattaaattttacttattcagtcctcagacacagtttggcaacactgttggttcatacaggcctggcaattactctacaacccagaggttggaaatcccagttcaaaagtgattggaagagtaatgaagaaatatgttaggagcaatcagggtttgaatgtcccagtgcattcaagtatcttccacaaacattagcataaaaatgcagttacactgccatctgcagaaaaattggcacacacactaaaagaatgctaaaggatctgttttcctttttaattatacaaaagaaggattcaattatacctcaagaataggactccaatcaaggatagaagagctcatgaaaaccattccatttcttgagacggtggcaggagaagcattgtcaatgttatgaggctcgaaaatgatcttgcagtttggagccatgggaatccgatcaccattggcaagggttagagttttgttatcatccaaaacagaattcagattttcaatccagatggcatctactggaccatcaagaattatccagatatgttcccctagaataccccaccaaagggaaaaaaaaaatacatacactcatgcagtgcatgtacacataagtttaaaatagcttgaagaactattatattagatgtaattttcattaatttttaaatatagttttgctccaaatgattaccttgttttattacaaaggatcttcaaagatctttatatagtagtcaaggcccataattaaatcaaaaagtagtttgtttattggacaaatattcattgagcaccttgcatatgtcactgttctaggggctgaggatattgtggtaaatgagacaatgtcctgcttttgcagagcttacattctaaggagtagagatgacaagcaaacaaataaaagtttaacatacaaaaaaactaagtagaatgagggcatggggcatgttttagataaggtggtcgataagatattccaggaagagaatgaagtgatgtaaagatctagaggtagaatattccagacagcaagaacagaaagtgctaagcccctgaagcagatacaggcttagtgtaatacaatggactgaatgtttgtgttcccctaaaatatcctcatgaacaagattagtgcccctataaagagacctcagagaactctcttgcccttctgcaacatggggtacagcaagaaatcagcagactgcaaccatgaagaaagccctccccagaacccgaccatgctggctccctgatctcagacttccagcctctggaactatgagaagtgaatgtctattgtttataagccacccagtctctagcatcccaaactaaggtgatcacgttccaggaacagtaagaagttgaacctgaagggcaaaaagaggaggaaggggagaggtatatgagggcagtgggaaagacagagctatggaacccattctggtttgcacctaagtctaaggcatccaacagagatcctcgtagagttgctgagttgggaattcaggagagaggtcagggctggagattaaaatgtgaaagtcaccagttcagagatgggatttaaagctgtgggactgggtaagtttcttctagataagtgtggagagagaagagggctgaagacagaggctctgtaacccttaggcttctggcatggtctcctgtgtttgctcccctttcttccagacttctcaaggaagcagaagtggaaaaagagctagcaggatgaggaatccctgcagcccagagaaggaagggtttcaagaaggcaggcgatcaactgtgccgaatgctcctcagggcagtaccagactgagaactggcaatttgtatttgacaagctggaggtcaggggtgtccttgatacagcaatttcagaggaacactgggcaaaaaacttgacagcagtcatacgaggagatacttggaggtagagaaaatgacaaacatcagcagattgctcaacaagaatgtcattgtaaatttaggtatttgatttaataatagcattcctcttaatttctcaactactaccttctcttactcaccaacaccatgacctgtcttgtggttctaaattttctttgctatgcaacaaccgtgggatagtctatttaaaataaaatgctttgaaaatcctaatcaagttcattcaactagcaattcaagtaaaatggtgatctaatcaccagagtcactttgaaagaaaaagcatatgttgcctttttttaatgtggaaaggggaaaaaaaaaacaaaaaaacctctgcgctcttgttcttttaagtcacattttgtcactgggtctgtgtttacagtgggttagtggaacaaatcaggaataaaattcgatttatttccagtagaacaaaaacaatttctaatatgagcacttttttaaatgaagcattttcatttctctttcgacaatttatattagcgttattaaatgcgagcgtcaatggtactactttaaacatttttcagaaggacactgttgcccaaagggtaaacccaggaagcccaaatatctcctccttctcctgcttctttctctctgcaattgtattcactctgcctttgcctgctcactcaggagtgaggaaatcaaatgagaagaaagctgatgtcacctcttcccaccgaatttatattctgagaacattgggttcaatttacaaagtccataagtgagggactattcagactgaaccgctagcccttaatgagtttgtttaaacaactgaacaccaatgtccatctacacagaataatttattagttcaatgtagacttcatttttgctatatacaattttctctcccaaacaacccattttctctgtgactttatagagaaatcaattctttaaaaataggctgtacttaaatgagagcaacactggtaaaatattcagtgaaaatagttatggtaaaatcactttattcaatattatcaattttccttaacagctttttccatctattttattctaaaatatcacagggatacagacatatttttttagaaaatattatttcctaaaagggagcattttaaatactgtaatcaataattccattatttcaactttcacaaatatcacactgatttatgacttcttagtcttggctaagatattatacagcaaatacagttgttctactaattctgtatagcctccaaggattctatctagaagtataatcaaaaataatccttgtaatttatcttctacctttctttgctcttaatgttttcctccaaagcgtagaaaatatcccatcagtccagtcatttgtggcaacgtccagccgaccaaacatctgtggggcagtaatcgctttgggattcatcctcatttcccgatgtggttttccacaatctataccaagtaaatccaaattttagacatctcagatgggaagtgaaccatcattaagcaacattgcactaatttgtggtgtactgtcagcaggtgctcaaaatatgaaaactgcagaactacattgaaaatatgtcttactgcattctaagttaccataattagcttcattatactttattgactaaagcacttttttatcttctttagagaaaattgcatattgtttaggggtgaaaaaagataccatgctggaatttatgaaggtactaatataatctggaagctctctaaatttcatggctcaaaaaaaatctttggtttaagctacactagattaaatcttctgcctgaaatatcacctagaagatgcctcattcactgcattatcagctttgatttgtgttatgttttcttgctcaccttgaaaacgataagctaaatgaattttgcatgaatcaaggactttcttttgtgaccaagaaatgtattcaagaaatgtattcaaatctttcacaccctaagccgactcttcagtgggctgggattctgtgcataagggactgtggttaatgagcagaagagtgaacaataaggtttaaagtataaaattataaaaatgggcagggcatggtggctcacgcctgtaatcccagcactttggggggccaaggcgggcagatcatgaggtcaggagttcgagatcagcctggccaacacggtgaaaccccgtctctgctgaaaatacaaaaattagccaggcatggcggaagtgccaaagcacttccttgcgtatatcatgttctctccaatccctcctactgacacagactctttttttctgctaaaaacattttttatcaatctggtactcaaccctcaagcctcggatgaagtagcacctggtctgtatgcctttctataattccttagaggattttctcatcaccttggcctctactcatgggatacttgtccaaaccttccttatagcaattccctgttgagttttaattatctctgtctatgtctatgtcctgcttctaatacagaacctgacagatcttcaaagtatgcaatattaaagacacttgatgagatatatgctgaatcaggggacaaataatatgcatcagccctccacgtcgtcagcagaagttaaattatcttctcaaccttttggattattaacattttcagtgagaaacaatggttctttaagtaagattaatgtttcctctactactaaaaccaaaaccaagttcataaacagcaaatagtctaatgattaattcttctttgcaaggaacttctccagaatcagtgatgccatacagattacataatttagatataccatacataatgtatctatattgtttaatatttagtactcattttgttcgagtcattgtaccgtgtgcatttaaagtttattgttaacagaaggcagcttcgtcactgcaacaaaaatattattgagaaaaatttgagaggaagaacacaattatttaagaaacataaaaatcccaaaacagaatcttaacagcatacatgaaaaaccacgtgataagtcctgcaggttggagtggtccattttggtagaggtagatgttagctgagaacacactttatctcagtctgaggactgcctggtagagtcctgatagacagaattcacttcctccaataactgaggaaacaaagaccaaatccaacacctgcagggtcccacagtaaatactggcaatcctcagcaaccaccaacaatgtaccagtgttgcatcagtagcagtgcactgaggttccgggaactgcctgaaagcccacccaggtacctctttgctggatgggctttcagtcagctcctagaacctcaatgcactgctatatattttgcattccaaccgtcaaggttctgtgacattttggaatgtctacaggatgccaatatttttagaaagagagtcatccatgtctgatcagaaccagagaatacaagaataatcatgaatgtggtaatgtccattatccttagatgactttagatgtaaggcttagggacatctggaaatgaaatgcatttatttaacttcactaaaataaatctgattccaaatgggaaggtaatttatgattgggattgggatgacttcggcatatagaacataagagttgggtttggaattattttctatttattgagagacagtgtgttgtattttgtttttactgggaaatggcatggtatgttgggaaaactgggctttttttaagcgcgccctgaccttaactctgagtcccatcacttaccatctttgtgaccgtgggcgtttttgaatttgagccttgatttttatacaaaatggggataataataaccacctctcaagatcattgtgaaaatcaaattacataacatatgtaaaacatacagtgcagtgcataaagtcacctaaaaatgtttttttttctctctggttcattaatgtaatatgttatctctaaaatgttcccaataattaataaagcagtatttcctcctataaaaatatattattgtatctgcctgtgtatccctcttgggcattcaaatgggtcaccactacttaaatgggccaccccaggcattgaccttggctgccctgtacctgtcatggctctcatcaaggtgtggatgcaggtggtcttcccagccccactgggccccagagtcatcatcccatgtcgcactctctgcgtttcgaatagctggatgaccttcagtttccaaggaggatggttgattaaaccagcttcttcaacctgaaaacataagagaatccccacattgaaacacaacaatgatggccggacacggtggctcacgcctgtaatcccaacaatttgggaggccgaggcgggcagatcacaaggtcaggagttcaagaccagccaggccaacatggtgaaaccccgtctctactaaaaaaatacaaaaattagccaggcatagtggtgggcacctgtagtcccagctacttgggaggctgaggcaggagaattgcttgaacctgggaggcagaggttgcagtaagccgagattgcaccactgcactccagcctgggcaacagagcaatactccgtctcaaaaaaaaaaaaaaaaaaaacacatcaatgacaatctcaatttaccattgtgccacaaaaaaatacacagacatagggaggaaggaggaggatttactgtttaatgagtacagagtttcaatttgggatgataaaaaaggttctgaagatggatggtggtgataacagttgctcaacaatgtaagtgtgcttaattcttcttaaaaatgattaaaatgtaaattttatgttgtatttttaccataataaaaaatatattgcatgaaaaatacatatttacatagacaaaaatctggctgaatgtaatgaagatgttatcctaaactaataagaaatatctgcatttatctttgggaactgaaaacatttatataaatattcgattgaatgaacctctgaggagcaacttaaaaataaagactcaaacagcaaaatgtattttaaatgtttaatttaaaaggtaatacttacaactagaaaaatggatagcatactatgttgattgaaattccatataaatttcaaactgtctttatatgtccactgcagagtttctatctatcaaggcatgtatggaagttactctgtgccaaatattattctaagatcaatctttataataacatgatggaaatctttataataacatgatggaagggatgctattaacatcttccttttacagataaggaacttgaagcagagtgactaagcaatttgcccaagatgatcagcttgtgaaactatggaatgcagatttaagaccaagaagttcaaatccatggtctatgcacttaatcatcatgctatgcttgaactcacagtacgtaatgatttcaattttacttaaataatttttataataatcatgtatcactttatgctatgatttgcccttcagatttttatatgctacaaattactaacgtaagtcatcatatcaactacttaatgcttagcttttttatatttttatatattttttagagatagagtctcatttctgtcaccccatgttggagtgcagtggcgtgatcacagctcactgcagcctcaaagtcccaggctcaggtgatcctcctgcctcagctgcatgagtagttgggactatagacatgcaccactgcaccaggctaattttttaatttatttgtagagacgagttctcgctatgttgctcaggctagcctcaagtaatcccccaacgttggcctatcaaagcactgggactattggcatgagtcaccacccctggcccaatacttagcttttaggtagtgttaaaattagccaaaagatgaagaaaccacttgcagacaaattatcactcttacctcatcagaaaattcagacatttatatactaaatttttaaagcaaaatataaactaagtactgctacattttgatttccttttttttttttcatttgtttgtttgtttttgagacagagtgtccctctgtcactcaggctggagtgcagtggtgtaatcactgctcactgcagcctcagcctcccaggcttaagtgaccctcccacctcagcatccagagtagatgggactataggcacatggcaccatgcccaactaattttttggatttttggtagagacagggtttcaccatgttgcctaggctggtctcaaactcctgggctcaagcgatccactcacttggcctcccagagtgcagggattacaggcatgagccaccacacctggccacatttgatttttattataaatattttcaaggaattgaagtgcaatttataaatatgagctaatcaccacttctataaaacatttttttccaaactcttcttcatagaaaaagaaattgaggcataaggtttacgtaattaattttcattcctaggaagactataaaaagttaaagctgcaccaagtaccatgggaagtccagagacatcatgatatacatagtgtggtgggttcccccaccctacccaccgtatcccacccccagagtctgagcaagaagccacaagtactgaggaaagagaagccacatgagatcactgcaaataacacgcagaggcaggcgacacagcaaacaccagggcagaaacaagctaagccaagctccagagaggcagccagatgagccccatccaacccctgctgaccaatcacatttcatttctgcatctgctatggaatggtttccaccaataatagggctactcgcacatgactagctggacatgtggctgtgcaatggtaggagacccagggcaaggggagtttgactcgtggtgtgcattggcctcccttaagacagcagtgttagcctcactgttgttatttttgctgctcagagtgcataggttggagccacagcagccccactttattcccattaaattcagatgaaacagacaccagccctcgttgccctgtgaagcatattacctgtctactaattgctgcttccagttcagggtaacctgccttgtccagaagaatatttggaaagagatcttcaatcaaactcaaaaacaagggttcatcctcatcaatctaaaaaaagaaaatgggaaatcagaccaattattctggtataaacatatcaatatgcagataaactggaaatgcccaacacagtccgggttattgcaatgtaaccactaacaaataacatatcacctttattgaagttaagaaacattttcctcatctttcccataaattaaaaaaaataaaataaagaggaaaagaacagggagaaaggaaagaaatggaaggaagacaatactgtctatgtgacaatctttccataaaatagtcagttttgggggataccatatagtctacaatttttaatttaaacttaaaagaatttttaaattagaaattaatagcaggtttgtgaattggaatttggtgtatacttttaatttaaaataaaaatctatcattttgtgaccctttacatagatccacggatagtgggcattgattatcagtctctatcgtgaaataatagtgtgaaactatcacacacttgtagagtttacacattatttcctaccaggctctaccagactccaaaggtgagatttgagttctaaaacacaaaaatgattcaaggtatttggcatcttaacatgtgtattttttaaaatccactgcaattctattggaataggcacattttggagtggataggaatcattacccaaaaaaatgtctgaaaaagtataatttaaagtgatgctctccagcactttatctgacaattaggcattttaaatgagcattttaaataaatattttgaagtctcatgtatgggcagttagtttaactgatatccaagtaggtggaacacttccatctgtgagtcttaccagtttagaaagattcatgtcccgtagtacacgcatgacaatcgtggactccgtatccattggattggctctttttgctgctcccaaggtccgaagaactgacagaatgttacgcaggccaaagtcataatgaacctagagaatgtgagatacattgggcttattttcaacattaaaatacttgcagaagccatatgaatctgacagaaattatattcacaataatgaataaatgctgattttccttcagaaaatgcatacacacaatggggtaaaatatttctatatagatatacgttttgagcaaatagggaatatcccaaagagtcctcccatgtgccatcattagcttaagcccttagatcagaactagctgctacagcttggcagggaaaaaggaataaatttcttcttggaatacagacatccctttgagcttattcttaatcaatcatacataaggaaatttgctcatatctctacagttaaaattcagaaccagaattaaactgggactgcactcatgactgtcatatacatagagatatatgtgcctttttcgtgataagtaagaagacaggagaatcagggagaaaaaaagcacctgcgcttcaggattacctgaaggaggaaggataaggacaaattagaaagctaagcccccagctttgtcattcccttactaaatatttacaaaagctcaattatgtcaaatttcagcatatataaagtgaataatcaaaatttatttatccaattattgtgaaaaacagtaaggtggttcctcaaaaaattaaaaacggaacgatatgatccagcactcccaattctgggtatatagccaaaagaattgaaagaatgtgccaggcacaatggcttacacccataatcccagcattttggaagaccaagtggggcagatcacttaaggccaggagttcgagaccagcctggccaacatgatgaaaccccatctctaccaaaaaattacaaaaattaaccaagtgtggtggtgtgcacctgtgatcccagctactcaggaggctgaggcatgagaatcacttaaacccaggaagcagaggttgcagtgagccgagatagcacttgcactccagcctgggcaacagagcaagactctgtcttgcaaaaaataaataaataaataaataaataaataataaaagcatggtctcaaagagatagcagcatatccatgttcatagcagcaccattcatgatagccaagaggtggaagcaacccaaatgtccattgacagacgaatggataaacaaaatgtggtatatacatataacaatattatttagccataaaaagaaaggacatcctgtcacatgctaaaacatgaatgaaccttgaggacattacactaagtaaaatatggcagtcacaaaaaatcaaatattatatgatttcatttatatgaactattggcaatagtcaaattcatagaaacagaaagtagaatgatggttaccaggagctaagggaagagaaaaagagaagttgttgtttagtgggcacagagtttcagtttttcaagatgaaaaagttacagagatctatttcacaacattgtgaatatactcaacattattgaattgtacactaaaaatggttaagatagtaaatttaattttatatgcttttaccacaacaaaaaaaatgtataggaaaaaactacagtcttctgctaaggtaattgggagcagtatgcctcacttaagactagtcatttggaagatggagcacataaaaaatattcaaattgagtttccaccttcagggaatttaaattctaataaagataataaaatagaaatgtgaataaacttgtataaaagtaacaatgacttaaaagtgttggtgagtaaacttaatcatgggaaacttcctatcagtgttggatgcagttaaatctgtgggcatgaagggaaagtcacagaatgttcaccaagacatcagtatgagtccaactattttgcacacattgatgtattacatttcactatgatcttgtgaacatgggtggtaggagtgagggaagtagtgaagtggtagtgaagataagagcaggagccagtgatgtgggaagttttctccattcaagaaacagcatggaaaaaatatttatttgaaagataagtgatatggtttggctgtgtccccacccaaatctcatcctgaactgtagtccccataatccccatgtgtcgtgggagggaccaggtggaggtaatgaatcatgggggtggctacctcatgctgttctcataatagtaagtgagttctcataagatctgatggttttataaggggcttttccccctcttcactcagcacttctccttcctgacaccacatgaagaagaatgtgttgcttccccttctgccacaattgtaagcttcctgaggccttctcagccatgctgaagtgtgattcaattaaacctctttcctttgtaaattacccagtctcaggtatgtctttattagcaacaggagaacagactagtaaattggtgccacatagagtggggtgctactataaagatacctgaaaatgtggaagcaactttggaactgggtaacaggcagaggttggaacagtttggatggctcagaagaagactgaagaaatgtgggaaagtttggaacttcctagagacttagagggctcagaagacaagaagacatgaaaacgtttgcaacttcctagagacttgttgaatggctttgagcaaaacactgagagttatatggacagtgatttccggctgaggtggtctcagataaagatggggaacttgttgggaactggagtgaaggtcactgttgctatacaaagagactggcagcattttgcccctgtcccagacatctgtgaaactttgaacttgagagaaataatttagggtatctggtggaagaaatttctaagcggcaaagctttcaagaggaagcagagcataaaagttttgaaactttgtgcccaatgatgcaatggaaaggaaaacaccattttctgaggagaaattaagccagctgcataaatttgcgtaagtaatgaggatttgaatgttaatcaccaagacaatggagaaaatgtctccagagcatgttagagactttcatggcagcccctccccatcacaggcccagaggcctaagaggaaaaatggtttcctgggccaggtccagggtccccctgctgtgtgtaggcatgggacttggtgccctgcatcccagccgctccagctgaggctaacaatgcctgtacccccattgtatctagggagtaactaacttgcttttgattttacaggctcataggtagaggggacttgccttgtctcagatgagactttggacttagacttttgagttaatgctggaatgagttaagactttgagggactgttggaagggcacgactgtattatgaattgtgaggacatgagatcttgaaggggccaggggcaaaatgatatgattcagctgtgttcccacccaaatctcatcccgaagtgtagttccataatccccacatgtcactggaggatcccagtggaaggtaatttaatcataggggcagttaccctcatgttgctctcatgatagtgagttctcatgagatctgacggttttataaggggcttttccccctcttcactcaacacttctccttcctgccaccatgtgaaaaggacgtgtttgcttccccttccaccatgattgtaagtttcctgaggccttcccagccatgctgaagtgtgattcaattaaacctctttcctttataaattaaccagtctcaggtatgtctttattagcagcatgagaacagactaatacaataagaatgagtgagtaagggctccaataagcagaagaaaccaagaatgttgggagacaaaatgttagggtcagactaaccagaaaggctcaatggccagagccagaagagtctgtgtgtgtctgaacactcataggaaaagaactttttagtaggaatgtaattaggttgaacctgtgggtataaaaagtaataaagattcaaagaagtttgaaattaaagcctaagtgataagatggaacaaagattatatatgttaggaagtgttattcatgttatagtctcatgtttattgcactgtgtcattatttagcatatatttctagtaatttttactgatatgtactaaaaaattgtggcatgatgcccacctcctggtggtcatgtccttatatgatatcaccttgagagtaggcaggacctgtgatttgcttcttctaactaatagaatacagcagagacaacaggttgtatgtgattatgtgtgtgtgattatgtggtcacattagattagactgtagcactcgttttgctgaaaccactttccttgctgactttgagaaagtaagtggtcatgttggggaaacccatatagcaaggaactatgcacagcctgtaggaactaaaggtggcctccagaaaatagccagcaagaaatcgaagccctcagtcttacaccctcaactaacagaattctgctaacaacctgagtgagctcagaagtagattgtccccattcgagcatcagatgaaaccacagccccagccaatactttgattgtagccttgttagacacaaaccacaggactcatttcagctaactcctgacccacagacaccatgtagtaataaatgtacgttgttacaagacacaaagtttgtggtatgattgttagatgactattatgcagcaatagataactaatgcagaactatatgtttaattccatgacttttaactatgaaacctcatgatgcctgaacctggtaccctaaacaatcgaggaaactagcaagaaggctgcaacatataaacaagacagttagtaaaccttggtcaaatactcaagtgagcttagaatgaagaagaataaatcattgggaggttcctacaaatcatgaaaatacataacacatataacaatgaatctataagtggtataaacagccaatgttaatatccataagtctttggctcttaaaccagtgcagataatattcacttcatttctatgctgtaaatattaatttatttaaatgtacttcttaaaaaactatgcatataaaattatttttgtagtaatacacctttctactcagtgtcaataaaatcctttgtcaacaagcccagtctagaatttctcaaaatgagaacattctgctgaatagaaaaatgaaacatgcctaagtgcataagacctccaggatgacacacctgcttagaaagctgctcctcacacagtttgtagagcgtgaaaaacttcctggccaaaacaacgttgtcaatgaagccacaactagccaacttcacccttatgataatctgacggtcaggcaccatcatggccactgagcggaaattaatcttcaagttttcagggagttcctgccgtccggcatagccaggattctaaacagaaaataaagcccaaggatgaatgatgcaatcaagcacacatcagcatcatattaaaagattcattatgtacacacaacaaatctggaatgacaaccagggaactcatttacgtatctcaatctcgttttacctggacaggctaagtcatgagctattcatatgatctttgcttaacaccaaaaggttttcaaaaggaggtaaagttacaatcccaatttccattcaggaaaacagatgacatatgaccagggagatgcatgaaaattgtgataagaaggctgaaattcagtagcttttctagcagctccttaccatggttaagaaaagcccaaattcagggttcatagtcacattatctccatcagtaaagataaaagactttttgtgctcctttttacatgtcagaataatggaaatttgctgggctgcaaccgagagaactggtagatcaatacggttaaattcatcaaaacaaccccaggatccagactgtgccagtccttcgaaaggaaattaaatgaaaaatccaattagtatataattttagaaaaccaagaaaaaggatattatgtagctgctaaaatgagccagatgtaagttcattcaaaagtaaagtgcaacaaatagatctatgcatcaagtgacccaaaacagcttacaatttggcacttcacctgtaaacacccaagataaaggaatatcaaaaaaaagtcaggaggaagtaacatttggtccacacaacctggcaagattgaagattttccaaaaaattttacaaagttgaaaatgattctaaaatgtggccaattgttgaaaacaaattttagcaaaatattccaccttggctgcaatttctcaccagattaaaaaatataacccatacccttaaaaatccgtccaagtcctcggaaatccatctggtctgaacaattgaaaaccacgacgtatttcccgaggcatcgtcccatgtctttagtggtttctgttttgcctgtgcctgcaggtccagcaggggctccccccatgctcattcccagagcttgagccagcgtgatgtaacatctgcatgggtagaaacatcactagaaccagccctcagtcacctggaaatacttctgagacatcacagtggcatgaaacgcacacaagattaaaaaacaaaaggccattgtccctacctaacatttcgaatacaacatcctaaaacacacttatccttatcaatgttaacatatgttgaggaaaaggagggggtagtctatgatcaactaagtttaaaaactccttaaaaggttaaacaggtttctttactgctgaatttttcaggctttcttatcataatatgcagagagaatctccaggtataaaaataatacattgcatttccaaaatgtatttggcaacattttcgcagaaatctacccccatctaaaatgtatatattctgtgaaacagatcgggatcctttcaaatagattaatccccttttgaatctaagagttggccatttgatgtagttgggatttaaaacacacactgctaaataatcacaccttgaatctatttctgtgagtatctactaaccttgcacatgctttcaattgcatcttactatatgagattaacaaataaaagatttggtgagagaatacaagaatgcctgcaaaggaaaatttttcacctgataacttgcagatcaattacttgtttgccagcaccacctggtgttaccaaaggagacaaattataaagtggtgccgtgtagggttttcttatggccaaactataaagcattcatccggacttgaaaaagacttccaaggaaatgaagtgactatccagcctgagcagtggaaatgaacactgagtgcaccagctgggggtggttccaggttctcaatgttactggaaacgagtgctataaaggcaagtaaatgactcagcccttaatgtatgcagagtctggatacagaggaaaagatctggtcatgaaatcaggagaatgcctgctctcactttgactctgccttttaacccaaggtattatttctcctgttgcatttttgccatcccttccaaagcagagtctgtaacaacaacagacaccacagtgtgctccacatgcatcatctcgtttcatccccagagaaccctggaaggaagctactgttcctttcccccactgtacagagataaggaaaaaggccacagagattgagtgacttttctcaggactgcggcaggacagctgagacaagccaagtcttctcactttccagctctgggacaagcccactctatccgggaaagaaaaataactaatgggcactaggcttgatacctgggcaatgaaataatctatataacaaacctctatgacacaagtttacctatgtaacaaacccgcacatgtacccctgaacttaaaaattaaaaactgaaaaaaaaagattaaataaaataccaaacacaaaaaagggaatacatctccatcaactctgatcactcggctgctgtgttatgcagaccctcgttacaactgagatcactgggtttatatttaaactgaacaagtagcaagttgcttcaaacagatcaatcctatttacatgaaaagcaggtgggcatgcctggagacttctccctggctcagctaggtggggcttcagacccactgctacactggtgcccaaactgcctttcggtgacaagcatggatctgtcacagcatctccctgtgtgtctagagaattctacatgtgagtgtatctcccttcttgcctcccttctctgctttcctttctagtctatctattggctattttcaaaaccgtttccattcatgaacagggtttgaactttatgtgttttagttgcctgtggtcaactccattttagttttctaaccttcagttaaactgctataaactctctgcggtcaggagctaggtttggttcacacttgtaccctcaactacttgcctaacccctggcaccttgtactatatgaacattggttgaataaatggcttgcgctgatccagtcattcattcttatctggtccctcctgtcccaacagctacaggaattagagatgcagaatgtgaccctgatgccaaatgaaaagcaaccaaccccatgaccccagggctcattagcactcgaactaaccaaatctatcaccagcattcatcgtaactattcatagcactgtcagtgcattttgtcacaggtaaaccagaaatggtttcaactcctattggttctaaactgctgaaaagtttcctaagaaacaatggtacgtgcatcagcagagtacatttcttccttgagaacttggtttagttacagactctttgattatagggcatgtttaaggagaaaccaaagacaaggttgctaaagaatgtgttatccaaaaaaaaaaaagaatgtgttaacataggccaagcacagtggctcatgcctgtaatctcagcactttgggaggccgaggcggatggatcacgaggtcaggagttcaagaccagcctggccaatatggcaaaattccatctctactaaaaatacaaaaattagctggatgtggcggcacacgcctgtaatccaagctactcaggaggctgaggcaggagaaccacttgaacctgggaggcagaggttgcagtgagccgagatcacgccactgcactccagcctgggcaacagagtgagtgagactccttcccaaaaaaaaaaaaaaagtgttatcagcaattttgacaagcaacagtgatagcaagaataataataataataacaaacatttgctgtgtcacgccctgtgctgggtacttacgttgcctctagtccacacaatgattcccaaacaagggaatgagggaggttaggtgtcttgtccaacactacacagctgctaggggcagagctgagcagtcagcactcaggcaacactcacagaagctgtgggaatgtcagagaaaggtacaagtcctgtctacatttcttatcaagcagataagatgcctccatcagccctcaatttcttctgccttctgcttaagtgacagcagtagtcaggacaattctagtcttcattaaaaacactacgagttttggagaaaagtgctgtatgttatcatattataatagctattttatcatctgaaatgtctgcaactctgtccacatggcattgagcttcccagaatccagggagctgccccagctgttaaattcacaggtcagtcagtgaagggctgacaacatgtcagtgcctccagcatttgactttttaaaagtactaatttcaatgaggagttttctcttgcaaaagggaagcaaatcttgcagtggaatctcagttactatcgaaaattaataactcacttcccacataatcaagttggttaaagaaaaataaacaaatgggcatttagggtaaacagacaaacttcagaatccctttacttacatacttgaaaatacttattttgcttttaaagttctcagttttttaatataaaaaaaatacaagacaatgaacacagtggaagaatcaaattgcagaaaagactgtaaactatgatacctatatgtgaaactgaaaaaggattttaatgtctaagcatccacagttttcagagggatagaaaataaactgttgatcatttttaaaaatagaaaagttttccctcccacacatgctacttcatgttcttctgtaccatgtaaatttttcaccattaagatgcaattttggaaataatcacttctttcatttattcaagaactatttatttagcatctgttatgtgacagaacaattctagcaaacaaatcacatgaagcccacgcaccaaggataagagggttatgagatttggagattgcgggaggtcgggagaccctctgaggtgactctctagcaggggactaaaggaagaaggaagcaagctatgccactattgaaggaagagggtgccaggccaagtgtataatgagggcaagggccctgtggcagggctgcgccacagctgtgcaaggagcaggtggcctgagctgaatgaggatagagaaacagagaagtagcagaggccagattgtaccaggcctcacaggcccacgtgaggacgttggcttttactttgcatgagaaggaaccatgggagaagttttggggcaaaggatctgacttacattctggtgtctgaactgagaacagactgtacgaggacaacgacagaggcagggaagccagttaaaacattgtcagaaggatgcaggtcaggataagagtagtaatgattcctataatcccagcactttgggaggctgaggagggcagatcacctgaggtcaagagttcaagaacaccctggccaacacggtgaaaccccgcatctactaaaaatacaaaaattatccaggcatgatggcacgcacctgtagtcccagctactcaggaggctgaggcaggagaatcacttgaacctgggaggttgcggtgagcggagatcgcaccactgtgatccagcctgggcgacagagtgagacttcttctcaaaaaaaaaaaatagtagtaatgatatagaaataactgtaggcagatagagagggtaaaaggagtcctcggtaaggtttgtttcttttaataaaagtagctcccgaaacatttcttttctaacagaaaagcagcttaaagagccaggccggcaagctttgatatgcaaatgctggtgattagaaactgggtccatccaacagggcaattcccaccctcttctccttgtcaccacgtgcgccaagcatcatggctgcctccagataactccatgtgtgcaggacatcattgcgatctgcatttacatattaaaaggctggggttggagggccagttttttcgagggctacatgaatgacacacctggtcaaaccaaaaccctaagccctatgcaaatcagacaccgcctcctccagcctcctaatataacctactgttttcccctgtttacgtggtttttctctctctgctcggagcacccctccctctgtctctgtactggggagctttttccttctttcttgcctatttaactttccaccccatgaaacgactccatgtgtgtccgtagcgtttatctaatcggcacaaggcaaaggaccctgctgttcctccagtcatcggagccataccagtaaggcaaaggggtgaaaatggtcacattctagaaggaacctgaaagcactgctgaccaaattgaaggtagattattggaaaatgaggtgagagagaaggaagggcttcagggttactccagggagtgttggattgcccatttggaggtgatgtattcacaggcttcaggggttcggacatggacatcttttgggggccattatacttactatcacacttccccccagcattctgataaaatggaatggccaacttgctaaaatgaagacaacagcaggagggcacttttgtgaggctgatcaaacacgctaaggttaaatatactgtaagcaaccaacagacatgtcacataggcaaataggtatgtgtgtctggagtttgggagagaagccctggtttgaggcagagtttggggtttttgaagccatgtgggatcacctaaagaatgagtagaggtggagaagagaagagcctggcagttctatgtttaaaggtcagaaacatgaagaggaacgagtaggagcaggtacaaagggacatccagaccactgggaggaaccaggtgagtgtggtgtcctggaagccatgtgatgaaagtgtatcaaaaaggagagaatgatcaactgctcccatgcagctgattgctcaagaaagacgagatccaggaaaaaacactggatttagcaagaggtctgggtgactttcaggagagctgttttatcagagtgatgcggaaagtatgacaaaataatggtccccccaaaatacgttctaatctctgcaacctgcaatctgtaaacatcttaccttccacagctaatgggactttgcagatgtcattaatgttaaggaccttgagaagagggaattatgttggataataaagtggactcaacctaatctcatgagtccttaaaagcagaagagataggtagaagagtgggtcagagacacaagacagaagaaggaggggagattcaaagcacgaaaggcacctgacccaccactgctggctttgaagatgagggaaggagtcaggatcaaggaacgtggtagccttcagaggctggaacagccctgagctgacctaagacaatggggacctgggtccttcaaccaggaggaaaggaattctgccaacaacttggaagagcgggaaacagaactcagtctctgggaagaaacacagccctgcagacacctgattacaatcccgtgagacccacgtcagacttctgatggacagaactacaaaaagaacacatttgtgtggttcaagcttctaaatttatggcaatttgttatggcagcaatacaaagttagcagagagcctgaatgaagtgagttgaagaaaaacaaggtggagagaaactgtgcttttgaggggttttgaagggagcatggagtgggaaggaaaccaggacaatcacggtagggttcgctgggtagaagcaatctcagcatatttgtgtgttgatgaaaaggattcagtagaaagtgaaaatggatgttgcttccagagaggaaatcctggagtcagtgggggtgttggctttggacagcgaacctggagagaaagcagctgcatgagaacaggcacccaggttaacgcacatggtggtggagatgaatgcgtctatcttctcaaaaaaaaaaacatgaaataaggccttcggtggagacagaggaagacaaggaagtgctggagacttgaaaggcagaagacataaaataaccacataagcattttatgagaaattcctatttgggaactccacttttttttttttttttttttttttttttgagacggagttttgctctgtcacccaggctggagtgcggtggcatgatcttgtctcactgcaacctccgcctcgggttcaagtgattctcctgcctcagcctcccgagtagccgggactatggccacgtgccaccatgcctggctaattttttgtatttttagtagacacaaggtttcaccgtgttagcctggatggtccccatctcctgaccttgtgttccacccacttcggcctcccaaagcgctgggattacaagcgtgagcgagccaccatgcccagtccatttttttaatgaacattatttctaatgggcaaatcgtcattgtatattattgtggggcacaatgtgatgttatgttatatgaatacaatatggaatgattaacgcaagccatttgacaataatgagcattcagtgcatacctgaagcgaaaatatacaatgtagttgatattacaaagttcaaattagactaagcaaatcacagaatattagccctgcaagcacccttagagacaacatagctcagggtccccagcccccaggccacagaccagtattggagctgaatgaggacagagtattggtccatggtctgttaggaaccgggccacacagcaggaggtgggcggcgggcaagtgagagaagcttcatctctatttatagccactcccatggctcacataaccgcctgagctctgcctcctgtcatatcagcggcagtattctcataggagcacaacctttattatgaactgcacgtgaaccctatcgtgagctgtgcatgtgagggatctaggttgcccactccttacaagaatctaatgcctgatgatctgtcactgtctcccatcacccccagatgggactgtctagttgcagaaaaacacactcggggctctcactgattctaaattatagtgaattgtataattatctcattatccattacaatgtaataatagaaataaagtgcacaataaatggaatgagcttgaatcaacccgaaaccatcacccaccccctggtctgtagaaaaattgtcttccacgagaccaatccctggtgccagaaaggctggggaccactggcttagctcatcttacaaatgaggggactgaatctagggaggttgcagtggcaggtgtcactaacacaacttgtaaatagcaggccaagggaagagttaacactctggaggcctttccagtgccctctcccaacttttacctgcattgatactcaatttctttcctgcttaaaaaaaaaaaaaagaaaatcttaattgtctcccagtaagaacagatactcaagcagcccccgcaaggcccactgtgatttgcacctgacaacacacaaaaattaattccctttcttgcccattctctgtccacacagtgtttacacatttaaactctgcctctataagactgaaggcaaaggaagcaaggtctgtgtcagtcacaaacctaaatcccatgtgaaaagaaagctgataataaagctaaaaatactaaatttcaaaggttttagtataaagagcctataaaccctaagagactttaagcaaaaatcccctgagcaactcgagagaataaaaatggtgggggttggggagaagggttccatcacctgtctgtaagtggagttattacaagcctgtcagtgcagcctaaaaattcattctggtatatgaacgccacatctgtgatgtgaatcatcatcttgtcagaatcttcgttaaagtaaaatctgcactgtttcagccactcaaagtccatgggactcttgatatgcatatgacactgaaattcaaaaggtatatgttagagctctgatgagaatcactcattaaatatacacgttattagcattcatgtagatcataaagtgaaataaatgaaactcacagacaaccgaactatttcacaggtgtcaactgtatcaccagccaagctattcatttattgatcagtaaaaaagaaactagaagatataggaataagaaaactcaagtgaaacccctaattatgcctctccaatttaagtgcctttacgtattttaataataagatattaatttcttaaatttcaccctgacatgcctaatgccatagtcctcaccatgaaatataatctatgaaaagcatgttttgacacacaaagacagcaataaacaatctcattaggaaaaagacatctcttaagactataacaaagtacgctgttggggttttttaatccagtaattatttttcccaagaattacatcgggccaaaatttctaacatctaaatgacaggccattgcctggaaatgcttttgtccagattttttaaccaaaattttaagccactttcatcattttctttgacaaagaagaaatctaaaattagcctgagccctttattcctcggaaaggtaagtagtgtgcttaactattaagacaggagattagcacacaatagctttgatgtgctgcctttacttccattatatcaggaccaatctttcataatcttttttacataatgggatgagacaaatccagaaaattattatgagaataagagctttttgcctctaatttattttatagtagaggacaaatttcactttttatttcccattttctatagctacacaactctcttttcccaccttgttctctatttaaaagcaaaaatgtgtaacacctgaatgtcagaagctctattaggaaaggccatttgcaatcaatgacataaaatgtagcaaaacttgttaagaatgtgatttttcaaaaggcttaagggaagtcctaaacagctctactaagcaatattactaataattttcatagcaagaaactggtgatcttcaattaataggtaaaaagcgaaaaagatgtatgaaggcttttcagatgctacatgacaattttaacattaaaaatcatcacgttaaaacatttttgaataaagtctaattgcctcaataacatcttagcatagatcatcagaatatgacttacgttcagttaagactgaaaagaaagctgataagctctgattacaaacatgattctttgccagaatttaattttttccttgaattcaatcaaactagttctactgggtaaatgcagatagtgtctagaatttgtttttctctacatgccacagcatttataaagaatttaccaggtcatcaaagatatccctttggtgcacatgaatagtaatcagagtctcgtatttcactcgttccgtggaactcagatccctcgtggtgacgtctatcaatgtattgagtagctccaggaaagcctgattagttttctgcatgatttttttatcaaacttggcatttctaagggcttcttctgaatcccgtgtccatatcatctgaattcctaataatccaaccttatggaaataaaaaaggcttcatgaatttgtatggcatatttatgtatttaaatagaaatacaatgtgatcaacagctgtgattgttacacaagtgtaaagccatgattacatcaactttgataccttttttcataacctatggaaattctatttcttatcattttgagtcatttatgttgaagtcacgtttctcattgtttcctgtattttaatgctgaatctatttttctttttttagtaaagtgttcaatcagtacattttcatgatttttgtacattgttacatcaaaagattgattagggaaaaaaccgttttaaattaaagacaatacatcaaatatatctataacccaaatacacatttaagtctatagatatatgaccatataatctgtagttaaaatctgaaaggttaagtatatttaatgggtccttatgaaaatcttaatactggtctagagttaaattatagccatttttgaagcttacaataggtaatgtctgagacttaaaatgactattttacaaaacatactttcaaatttcaatacactgacctgagcagggaaggatgaaagaaattcagttagttggaaacctgtttcttgaatatttgcggctgcctggcgaatcacaagatgcaatgaggactgagattcttccaaaagagaattaagccaaacttccacattgccctctgccatgacaggtttatccaattcaatcgtctcaccctcttgagaggaaattgacagaattcgatcatagatctatgttagaaaccaaaaaaaaaaaaaaaaaaagctatagtcatataaaaagtaaaaactaattattgacttgtccttcccaaagaaagtaaagctacagattataaaatactgtaaaagccaaatataaactacttcaaaacaataaaaaaaaaagccatgaaatctaaaaggcaatacaaaatcaattccaggccaggcacagtggctcacacctgtaatcccagcactttgggaggccgctctaggtggatcacctgaggtctggagttcaagaccagcccgggcaatatggtgaaaccctgtctctactaaaaatacaaaaattagctgggcatggtggtgggcgcctataatcccagctaattgagaggctgaggcacgagaatcacttgaacacaggaggcggaggttgcagtgagccgagatcatgccattgcactccaggctgggcaacaagagcgagactccgtctcaaaaaaagaaagaaagaaacagagcgagaaagaaaagaaaagaaaagaaagaaagaaagaaagaaagaaagaaagaaagaaagaaagaaagaaagaaagaaagagaaagaaaagaaagaaagaaagaaaaagaaagaaatcaattccaaataaaccatactgtaaggggggaaacttatttttaaaagaaatatttaatacaaatatgatgatttttaaaatctctaaagtttctcagatgaaatgaggcttctaaaacctaaagtgctgtactaagtcctccttagctgtagacagacgtgatctaccaaaaagctaatgaggcttcagtttcagggcccctcacttacacagaccctttccaaggtcctgaatatgaatttgtatttataattttacaagatttagcacccacacaaccaaaatctgcccccgattgtagaaaccttatggcaggagcaacaaaaaacaaaagcaacgcgatcttaagaaacagctgctaagaacaaaggctaaaagtctgtgggcatttaattcacaaaagggagctacacagtaaataagatactgaaagacacttaaattatcttccatacaacttgagacagtgagaagctttgctcctgggccatgatgtcctagtgccatggcagaggatttaagcgaaacatcagaaagaattttctgatgaatttagtcccttctttcaacccacacatcccataaaacaacaagaaacattgatttttgaaccattaaaatccatcctgttttccttcctctctgtcccctctaacaaagccttgttacagctgttcagccttttttatcctgattttgcaatggcttcttacattgatttccttgccccctttcattccgcctcctacactgtaccagagaatgtttctgaaacacaaatcaggtcactgccctgcttaaacacctcccatggctttttatcatgttcaggatgaagctgaattccgtaatgtaatgcacctggcctttggaatcctgcccatcccccttctctctttgctcatggctccctgttgtgggttgaattgtgtctctcaaaaagatatactgaagtcctaagccctgatacctgtgaatgtgacattatttgggaatagcatctttgcagatgtgatcaatttaagatgtggtcacctctagcctccagaactttgagagaatacatttctgttgttttaagccacagcagccctaggaaactaatacactccctcacacatccacgctgctgacatcctgggcttcccacacttccgagcgcccacacctcccttgcacatgctcttcttctgacctgaccatacttcccttcttcacctgcaaggttatattctacttaccttcaaaacatcagtgcaaatttatattctgcagaaagccctcccggacacccccatacaaccaggttccctgatgggcattctcacgttctttgtgcttaatgaagcacaataataacaattcaagtccaaaattatcagcaatttaattgtccaatttctcttgagtgtagtacataaaactgacttcagcgttgatcatgatacacccttcctgggaaccccaggccagcatcatgactctcagacagcaaggagcttgaccttaacaagtggcttttaattgcttcgaatggaatagctctaacactccctaactgggctctgaaggctacttgtttacttccctgtctcctccaccacagcacaagttcatggaaggttagcgtattcccagtgttaagcatgacatctggaacatggtagttgctcaataaatgtaacaccacatgctaggatgaagaaatggatgttactaggggtttgtatgaagcaccagagggaaactgaatacaatatctaacaagaagagtcactttcctagggaatttgggtggagggatggattagacaatagatttccgcagctgtgcaagtgtagtctccgtcaagttaaatgacctatcgtgagtctcatgcagcttcatgattctgtacacatggaagtgttaaaaaaacaaaaaaagtttgaataaagtatgccaaaaccagattaaaacaattacatcatgagggcaattccgtttagttaagacgctattttatgaacagctggtttttcatcttgttggatttcttactagttaacttggtgtgtaaaatcatgaatgctacataaatgccttcttaatcctaaactagcattttttttaatttgaatctacactttggatagtaagaaattacacagttctgaaggtaaattgggccccgagatttgtttttagtcactggccaagagctaatgaacagggaagcaacccttgttataaacccgttttcgaagagctacttaaagacagttgaggttcgaaggtacggtgattgttggcctgccattagaattaggcgaaccttttcgtggaacttgacagatttaatgttgtcaaacacattcagcaaatgggcctgtatagtgtgggagtccgacgcctgccccagaatctctagaagggcaggatctgagacgaagaaaaaccgaggaaagcacagtcgttttttctccaagtacctacaaggagaggaaaaacataaacctttataaccacacaaagctggtcgttcaaggaataaattaacctggatgggaaaaggggagaagattgtgtgacttgtgacaatctgattttcctacgtgacttctcactgtttttaatttttcaattttttaagaatgttttcaaataacattccacattctgatggagaaataattttttcccaaaattggtggcagaattccctcatttttcacaactataatgtacacattttgcacagtctggaaaatcttgtatatactaggtagagagtcagataaaaacactatgtagagagtaagataaaaacactatgtagagagtaagataaaaacacacccaggcaggttttggttttgggtttgggtttccaagcccagcactgtgccatctaaaagctccctacaatacttgaaattgtgacttaaaagagaatccaatgaattcgtcatccaagcagaagcaaaacccagctgtgacgagctccatggaaaagctgtggcactcgtctctgcttccaggagtttccaaaatccactgaatgttcccgatcactgacttgctttcagccgagctttcatttctatatttgctttctgttatggtcattcctgatgttatggatatgtgtattctgttgttttcttaactatagctctctatcttcattttctagcatattttgttataattatgatgcttttaattgtacttcttttttaaactttaccagctttttaatttttattttttttaatttttgctcttcccttatcatttgtattagtattcattttagccttttttgacctttttttttttttttttagacagagtctcagtctatcaccagggctggagtgcagtggcatgaccttggctcactgcgacctccacttcccgggttcaagtgtttctcctgcttcagcctccgaagtggctggaactacaggcctgtgccaccacgcccagctaatatttttttttttttttttttagtagagatgggatttcaccatgttagccaggctagtctctaactcgtgacctcaaatgatccatctgcctcaacctcccaaagtgctgagattacaggcatgagccaccacacctggccccaactttttattttaggttcaggggttcatgtgcaggtttgttatacaggtaaactgcatgttgggaggttggtgtacagattattccacacccaggtaataagcatagtacctgataggtagttttccaatcctcaccctcctgccacctccaccctcaagtagaccccagtgtttgttgttcacttctttgtgaacattgtattatttcctgtgtaaaattataaggaaacatttctgtttcataacagcagaattcactttctaggaaaaatcaagtctttactagaggattacttggatcagaaaccggagcctgatggcaacctcccagggcatgcgtgcggagtgctggacagttcacgattcgtcaactgctggactcgttttgctgagtggggtgtccaggctgaggacaaatctgagctacattcctcaagacaaaggagggcactcattgagaaaaaggcaaagaaaagaaggagatacaaagagagggtcatgctaagtaaggaatttgggaaagaaatggacatgtgtacagggatgatcatggataagcctgggcatgtgggttgaaatcattctatccagctctcacaggatcctcagtaaaacaagctcttgcagcgatgggatttgttcactttggacatgagacagcctggagagtctattttcttctattccccctcactttcttaaagtcttacttaaatgtttataatgtttacttttgttttagctaaaaaactaaacttttctcagtttaaaactactaattctgttatttcaaatatcccaatccttatttgaataactgtgatgtgtttgttatcctccttacagtagcccggtctgattctggtgaggaattgggtcatgttttctgtcccgttagaccagtatggaaggaggctgtggtgtgtgacagccaaactcctgagacggtatagagaagataccttatcttcacggacacagtctgattaccgcaactccgattacgatctgatctgtgtgaagacccttcctgtccatgctgatcctcgacagcttgggagggtgttgtttttgtataaatatgatttctcaaatgtctatacaaggcttacatatattgcttataacctcttctgggtaacaaaatcaaaagacagggaaagctcagttaaaaaaaaaagtgtgaacaattttagagtagacattttctctgcaggggttataaaataatgccaaaatgttgggtgacagaatagaatatgttcatagaaaaaagaaagaataaaaaaaaagaaaaataggccaggcacagtgactcacacctgtaagcactttgagaggccgaggagggtggatgacctgacatcaggagtttgagaccagcctggccaccatggtgaaacctcgtctctactaaaaaaaatgccaaaaaatagctgggcatggtggcatgcccctgtattcccagctactcaagaggctaaggtgggagaatcacttgaacctgggaggcggaggctgcagtgggctgagattgcaccactgcactccagcctgggcaaaagagtgagacctcatctcaaaaaaaaaaaaaggagaaaaaaaaaataaaggggggatttcgcatgtgtgtgtgtgtgtctgtctgtctgtctgtggtggtgggtggaagatgaggaagggagagaaaagcaataaactcagctgtaggtagtccagtagacagttcctcggcaagtgttttagtggtaactgaacctgcatgatgtcttagtggtccctgcccctcagtccttccatgttgaagaacctccagagcagggaaactttcagaaacccttttctcgttctctctgacctgatcctggtgttaggcacagagcattcctgctgggtctatatccaagaactgtttagtggtgcctgaactgcatttggtcatgctaaataattattaggctaaatggaatggcgcagcatcaatcattagacaacaatctttttgtccttcaacagttacttgacttgatctaataattttataagggagatcaactcattaatccctaagactccatttttctaaatctttatgttagaagaattacttgcaaatggttttgctttaaagtaaacaaagggtgctttactgacgttggcgttggctatggccatggtgtttaaaaagcctccttaggtttatggtgatactctatggcagcagtcctcaactttttgccaccagggaccaatttcatggaagaccagttttcaatttttccatagaccaggggtgggagtagtttcaggatgattcaagcgcattatatttactgtgtacttcacttctattattattgtgcacttatatttctattattattacataatgaaataattctacaactcaccataacgtagaatcagtgagagccctcagcttgttttcctgcaactaaatggtcccatctggagatgatgggaaacagtgaccaatcatcaggcattagattctcacaaggagtacgcaacctagatccctcgcatgtgcagttcagaatagggtgtatgcgcagttcacaatagggcttgcactactatgagaccctaatgttgctgctgatctcacaggaggcagagctcaggtgatattgcgagtgatgaggagcggctgtaaatacaaatgaaccttcgctcactcacctgctactcaccttctgctgtgcagccctgttcctaacaggccacagactggtgccgaggtttggggacccctgctctatagcataggcctttgaaacacccatcacctaaattagagtaaacttgcaaatatttgctacagaaaatcttggccctacctctagcttcaaggtagtggggtggacaaccatgtacgcatggttttgtttagacttttttttatatactttaagttttagggtacatgtgcacaacgtgcaggttagttacatacgtttagactcttcaactttcctaaaagtccacaaacttccacatctccccagctgtatgctgaagcctgtgaatttgtccttaaccagcagtgcagactccctgtcctctgcattcttgtcagggtttacatctctcacgttttatgctgcccaataccttccaccaacgtggatatgaaagtaatattcatggaggattcattgaaatgtatgcggtgattccattcccttagttccctgaatgaagccattccattagagaggctcatgtttgactcatgctgtgataagaaagcagatggagactccgctctgggttccttttaataggatacacaatagaaattcctccaaattaccaatttgaggacaacaaaacgtaatgtctccccaggtaacttttattctatgaatcctatgaacctatcatatgccaccctttaccttggaacctaggaaggatctttgctctataaatctaaggtccatttgtagtttttctctgcaccaattttaccctctgagcttattagccctttttgtcctttgaccttaactttctcatgcattgttattttccagcagccgtctcaaatttttttttggttagccgagaataaataagtaatccacattgcttacaagtaccctcttacaggtcttttttccatttttagcatagtcactttttttgttcaattttaataaactcctctctttatttcatcgagatcctgccaaagcaccatttgaagcccagtatttaagccatcaactgcatctatgagggcagcctggcttagatgacctgagtcccgcagtgcacaggacaagctggttattcacaggacactattacaggtcatgaggccatcaggatgtattcatggggaaagatcaactgtctcccagagtgggccaaggagacatcattatttaagttaaatgctcaggtgcttgagtttaacttccttaagtgtcaatgtacacttagcatattactatgtaacatatttctacttacattattttattgtgattaaccaaaggaaaaaaaaacaaacaaaaaaactttatgactcttggaattcacaacgcttctgtacacataaatgtgtgtgtagatagatattagacactttttaatataatcctgactgcatgtatatactaaacactgtttcatataatgagtataataaaatatgttggttctataaatgtttattcaagaagaatgtcagaaaataggtgtattaattttttaaagcagggactgtatgaggatgtttatacagtcttatcccagtgatggaagcaaccttaagtcctatgagtccaacatcaggacaaatctagcaagtctttgatgagaatataaggcttcaaaatatcagtttcatctgtgcaacagctttatatataaattcagccttagcaaaagaaaacaaatttggctaatgctatctagtctccctgtatccttttgtctcaaggataccgagagctttcaaagagccagtgaacttacccagtaagggatttctggcatatttccaactggtccagcaagtgtggtaacagctgccccagggtctcatctccaacacagcactggactacactgggcacttcatgtgcccgagtcatgatcttcacccaagatttatctatgttagaaaaccgcttggcttcctatgagaacaaggtaacaaagcacacttagatttggacacatctgtgatcccaaagacagtatctcacattcctccagctgaggctagagctttaaccagtccagatatccaagcaatatatgcctaatgtcacacacattttattgaagttcttattgggctttctgtgccatatcatcccctgtattaagtaagcatccttagctcaaccttggtactcccattatgttaagttacaacaagaaatgaatacaaaagtaataatacaattcaaggaaatatgaaaagaaagtacacacatttcttttcacaggttatctctaaatgaagtacatttcctatttttatattttctctattgagcactggattgtttatgtagaaaaaatatttaaaaataaagatacaaaattaattccagtataactggaatattgtaaaaaaatttaatggaaaatgcacagattatcttgagagggcaggaatcatataaattttcttccttttttaagacaggtctcactctgttgtccaggccagagtgcaggtgctcggtcacagctcactgcagccttgatttcctgggctcaagtgattctcctacctcagcctctccagcatctgggactacaggcatgtgccaccatgcctagctaaattttttttattttttgtagaaactgggtttcatcatgttgcccaggctggtcttgaactcctgggctcaagcagtcttcccacctcagcctcccaaagtgctgggattacaagcatgagccactgcacccggccccaaattttcattttcttctttaaagctttctgtatgtcaccaatgagtatataccatcaaatatgaaaggaagaaacaacacctagcaccttaaatattctacatgaaaatttctaagtccaattttagattcttcttcatccattaaaaagaaaaacatgggaatcctgggcaagatggccgaataggaatagttccaccctgcagctcccagcaagatcaacacagaaggcagattatttctgcatttccagctgaggtacctggctcatctcattgggactggtcagacagtgggtgcagcccacggagggcaagtagaagcggggtggggcgttgcctcacctgagaagtgaaaaggtttggggaactctcccccgagccaagggaagccatgaggtaccatgctgtgagggacactgctatctggcccagatactatgctttccccatctgcagaccaggagattccctcaggtgcctaccccacaagggcctgggtttcaagcacaaaattcggtggccgtttgggtagacactgagctagctgcagttttttttgttttttgtttctgtgatggagtttcgctctttttgcccaggctggagtgcaacggtgtgatctcagctcactgcaacctccgcctcccaggttcaagcgattctcctgcctcagcctcctgagaagctgggattacaggcatgtgccaccatgcctggctaattttgtatttttagtagagatggggtttctccatgttggtcaggctggtctcgaactcccgacctcaggtaatctgcccacctcagcctcccaaattgctgggattacaggcgtgagccaccacgcccagccagtttattttttttttcgtaccctagtggcacctgggatgccactgaggcagaaccattcactcccctggaaagggggctgaagccaggtagccaggtggtcttgctcagtggatcccatccccacagaacccagcaagctaagatccactggcttgaaattctcactggcagcacagcagtctgaagtcgaccgggaatgctccagcttggtggggggaggggggtccaccattactgaggcttgagtaggcggtttttccctcacagtgttaacaaagccgcaaagaagttcagactgggcagagcccactgcagcaccacaaagctgctgtagccagactgcctctctagattcctcctctctgtgcagggcatctctgaaaaaaaggcagcagcctcagtcaaggcttatagataaaactctcatctccctgggacagagcgcctgggggaaggggcagctgtggggtacagcgtcagaagacttaaacattcctgcctgccagctctgaagagagcagcagatctcccagcacagggctcgagctctgctaagggacagactgcctcctcaagtgggtccctgaccccgtgcttcctgacagggagacacttcccagcaggggccaacagacacctcatacaggagagcttcagctgacatctggcaggtgcccctctcagacaaagcttccagaggaaggagcaggcagcaatctttgctgttctgcagcctccgctggtgatacccaggcaaacagggtctggattggaaccccagcaaactccagaagacctgcagaagacgggcctgtctgttagaggaacactaacaaacaggaagcaatagcatcaccatcaactaaaaggacgaccacacaaaaactccatccgaaggtcaccaacagcaaagaccaatggtagataaatacacgaagatgaggaaaaaccagcacaaaaagactgaaaattccaaaaaccagaatgcctcttctcctccaaaggataacaactcctcgccagcaagggaacaaaactggacagagaatgagtttgacgaattgacagaagtaggcttcagaaggtgggtaataacaaactcctccaagctaaaggagcatgttctaacccaatataaggaagctgagaaccttgataaaaggttagagaaattgctaactagaataaccaatttagagaagaacataaatgacctgatggaactgaaaaacacagcacaagaatttcgtgaagcatacagaagtatcaatacccaaattgatcaagcagaagaaaggatatcagagattgaagatcaatgtaatgaaataaagcgtgaagacaagattagagaaaaaataatgaaaaggaatgaacaaagcctccaagaaatatgagactatgtgaaaagaccaaacctacatttgatcgatgtacctaaaagtgatggggagaatggatccaagttagaaaacactcttcaggatattatccaggagaacttccccaaccaagcaagacaggccaacattcaaattcaggaaatacagagaacaccatgaagattctcctcaagaagagcaaccccaaaacacataatcatcagattcaccaaggttgaaatgaaggaaaaaatattaaaggcagccagagagaaatgtcgggttacccacaaagggaagcccattagactaacagtggatctctctgcagaaaccctacaagccataagagagtgggggccaatattcaacattcttaaaagaattttcagcccagaatttcatatccagccaaactaagcttcataaatgaaggagaaataaaatcctttaaagacaagcaagtgatgagggactttgtcagcaccaggcctgccttacaagagctcctgaaggaagcactaaatacagaaaggaaaaaccagaaccagccactgcaaaaacaaaccaaaatgtaaagaccattgatattatgaagaaactgcatcaactaatggacaaaataaccagctagcatcataatgacaggatcaaattcatacataacaatattaaccttaaatgtaaacggggtaaatgccccaattaaaagacacagactggcaaatttaatagagtcaagatccatcagtgtgctgtattcaggagacccatctcacgtgcaaagacacacataggctcaaaataaagggatagaggaatatttaccaagcaaatggaaagcaaagaaaaagcaggggttgcaatcctactctctgataagacagactttaaaccaacaaagatcaaaaaagacaaagaagggtattacataatggtaaagggatcaacgcaatgagaagagctaactatcctaaatgtatatgcacccgaaacaggagcacccaggttcataaagcaagttcttagagacctacaaagagacttagaatcccacacaataatagtgggagactttttttaacatgttaaagaaatgtttaattacaaaattaagcttacacataacctaaaaattttcaaatgtactgcattttatagcataaaagtacaatcagtaaaatgattcactagtaatttaattacatttaacttaattttaagtaaaataaaaaatgcttctctctcactatgatgcagaatattactctgaacacctacctcatgcatcactcaatatgaaaagtaaactaacaagaaccactccacatagattttcatcataaatcttacattttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccataaatcttacattttaatgcccatactcttcaatagtgggagactttaacaccccactctcaatattagtcagatcaatgtgacagaaaattaacaaggatattcaggacttgaactcagctctggaccaagcggacctaacagacatctacagaactctccaccccaaatcaacagaatatacaatcttctcagcaccacatcatacttattctaatatcgaccacataattggaagtaaaacactcctcagcaaatgcaaaagaatgcaaatcataaaaaacagtctctcagaccacagtgcaatcaaattagaactcaagattaagaaactcactcaaaattgcacaactacatggaaactgaacaaccagctcctgaatgcctactgggtaaataatgaaattaaggcagaaataaataagttctttgaaaccaatgagaacaaagacacagtataccagaatttctgggacacagctaaagcactgtttagagggaaatttatagcactaactgcccacaggagaaagtggaaaagatctaaaatcaacactctaacatcacaattaaaagaactagagaatcaagagcaaacaaattcaaaagctagcagaagacaagacataactaagatcagagcagaaccgaaggagatagagacatgaaaaacccttcaaaaaaatcaatgaatccaggagctggttttttgaaaagatcaacaaaacagatagactgctagccagactactaaagaagaaaagagagaagaatcaaatagatacaataaaaaatgataaaggggatatcgccactgatcccacagaaatacaaactgccatcagagaatactataaacacctctatacaaataaactagaaaatctagaagaaatggataaatttcttctagaaattctaccagaggttcaaagagcagctggtaccattcctcttaaaactattccgaacaatagaaaaagagggactcctccctaactcattttatgaggccagcatcatcctcataccaaaacctggcagagacacaacaaaaaaagaaaatttaggccaatatctcttatgaacatcaatgcaaaaatcttcaataaaatacaagcaaaccgaatcaaacagcacattaaaaaggttatccaccacaatcaagtcagcttcatccctgggatgtaacgctggttcaacatatgcaaataaacataatacctcacataaacagaaccaatgaaaaaaccacatgattatctcaatagatgcagaaaaggcctttgataaaattgaacatcctttcatgctaaaaactctcaataaactaagtattgatgaaacacaactcaaaataataagagcgatttatgacaaatccacagccaatatcatactgaataggcaaaagctggaagcattccttttgaaaaccgacacaagacaaggatgccctctctcaccactcctatccaacatagtattggtagttctggccagggcaatcaggcaagagaaagaaataaagggtattcaaataggaaaagaggaagtcaaattatctctgtttgcagatgacatgattgtatatctagaaaaccccattgtctcagccccaaaactccttaagctgataagcaacttcagcaaagtctcaggatacaaaatcaatgtgcaaaaatcacaagcattcctacacaccaataatagacaaacagagagccaaatcgttagtgaactcccattcacaattgctacaaagataataaaatacctaggaatccaatttacaagggatgtgaaggacctcttcaaggagaactacaaaccactgctcaaggaaataacagaggacacaaacaaatggaagaacattccatgctcatggataggaagaatcaatatcataaaaatggctatactgcacaaagtaatttatagattcaatgctattcccatcaagctaccattgactttcttcaaagaattagaaaaaactactttaaatttcatatggaaacaaaaaagagtccatatagccaagacaatcctaagcaaaaagaacagagctggaggtatcacgctacctgatttcaaactatacttcaaggctaccgtaaccaaaacagcatggtactggtaccaaaacagatatatagaccaagggaacagaacagaagcttcagaaataacaccacacatctacaaacatctgatattcgacaaacctgacaaaacaagcaatagggaaaggattccctatttattaaatgatgttgggaaaactggctagccatatgcagaaaactgaaactggaccccttccttacaccttatacaaaaattaactcatggtggattaaagatctaaacataagacgtaaaaccataaaaccctagaagataacctaggcaataacattcaggacataggcatgggcaaagacttaatgactaaaacaccaaaagcaattgcaacaaaagccaaaacagtgtggtgattcctcaaggagctagaactagaaatgccacttgacccagcaatcccattactgtgtatatacccaaaggactataaatcaatctactataaagacatatgcacacgtatgtttattgcaacactgttcacaaaaggaaagacttggaaccaacccaaatgcccatcaatgttatactggataaagaaaatgtagcacatatacaccatggaatactatgcagccacaaaaaaggaggaatccatgtcctttgcagggacatggatgaagctagaaaccatcattctcagaaaactagcacaggaatggaaaaccaaacactgcatgttctcactcataagtgggagttgaacaatgagaacatatgggcacagggaggggaacatcacacactggggcctgtcagggggtgtggggcaaggggagggatagcattaggagaaatacctaatgtagatgacaggttgctgggtccagcaaaccaccatggcacctgtattcctatgtaacaaacctgcacattctgcacatgtatcccagaacttaaatataatttaaaaaaaaaatccaaacctcctacttaaaacctttaagaaaagaagatgaaaaacatgcacaaatacaaatcaaaaataaagtaaaattttagtgagtgaatacatttcactattgcctccaaaataaatggtctgcagtctgattttatctgtcatctgtaattaaactgaaaactaaccaaaaaagaagttcagaaacctatgtgatgaaaacatttaaaataatcatgcttctaaaactgaaatatattgttaaaatgttataatcttgcatacgacttaaggtaattgaataagaatccttgagaattggttaaaatgttcatttaaaaatctcaaaatatactccatatatacccagtaagatgattacgatttgatgataaatatatacttgacatcttgaaaagaaggtctttttgttttggagattttttctgcacatttccacccctcaattttactgtacagatataattgggtacattgtatagtatgcattactttaaaatgtctgtagtagaaaaacttagcctaccattgtcaagataactgcaccataattctacactgttccaaattctaccttgaaattatctaaagaagcatatcaattatgcgaccacttattttttgtttttttaaccctctatctcctatcaaacctccacagttttacagcattcttactctgattgtcacccctttcctttccacaattcctcactccctttgaagaataacagcattaacagtgacaacaaaaagattgaaggaagggggttcaatagaagtggaatattattgcattatttaagggggtaatcgctctgagagctttctctgaaaaatctgatgaaatcataaagaagattacaaaaccttgggcagctgcttggcaatgtctcctcccacaaagacagcttctaaataaatccacaggttttgcaccgtcatccagctctcgatgatgtctgttgagttggaaaggtactgcacccatttttgaatctgggctttgaatggcatattgtacctaaaataagaaataggtttagggtttggttttgtttttgttgtgctgttgtttcaaattaaaaaggtttttaaaaatcttaatttttaaccgctttctttacaaccttaattatgttgctggcttttaaagtgatgcaaccaagtgattaattcatccccacttactgttcattgttagtctagctttttcccttttgatccagagcatagagaagggtgggagatttataatctaaggagtagatcaggcattagacttgattccaccaagcttccagggtaatataattaccctcagtgctgctatggctacgagaataatatttgccctactgagcttctgtgcctatttcatggagtctctggtttttcatataatatggagcttttatagaaccatcagtggggaccagacaactaattcaatcttcaaatatgataacacctggactctctccttagcctccccttttctgagtctctttctaacttcccacgcacctgtgtccaacccactcatgtttgatgtacatgtgtgcaagattactgcctcttccatagttaatctgtcttccccttttcctctttgagacagactgcctgtgggtggcctcccaatgtccttttttccttctgcttttccatgtgggctcataattacccagctaaattactgaatttcccagcttccctttgcagtaatgtgcagtcagaagactaagttccacatcaacagtgcttaatttagcggaacactggaatgatctcatagctgaacactggaatcatctcgccagcattaaaaattactgatgcctgcctgggtcctacgtacagagactctgattcaatgggtctgggaagtggccctggcattgggatttttttaagttccttcagtgtatctggtacgttgcaaagattgagaacaactcttctacatgaaatgtgagtagtggcattggatgtaatgggtagtatggggaataaggtcacacctgggaaagacagatgagtgagccagaccaagcttgggtccctgatgatgtggtaaagcccccattccaacctgaaccacctacattaggaattcttttatgcgtgagcaatataaacatcagtgttatattagccattttgtatgtggtgtttctgttatttacagacaaacttaatcctaaatgattatacagcctacctttgtgtctcttcttctctttcttatcccttcatggttctctctagccctacataatatggacttgaagtcgtattattgcataaaagtttaatttccatattcttaattgttaaccaaattgttttaatattccatgcatctttctgaatatttgtatgctcttcactagaaatataggtccatagaaacagagatctttcccttatttgttgttctacccacagcgcctagaagagtacatcacacacatagtaaaggttcaataaatatatattgaaaaaatactcctcccaataactctatctgtagattagatgccattgaaaagaaaagtttccccaccccaaccagataatttttacttaatttacatgagtgtcttttctatctccctagggtatattattgcctgtctatcctttattctggtttggtatgaatagtaaccaagttcattaaaactcactaaatcctgagaagtccaaactcaagattactaatggtctaactttatatcccaatattactttagtgtaacaagtaaactgaaataagagaaatttttttgaaatagtatgaagtacacagtatttccaacattaaaagtattgatacacatatatatggagaattgggtgatattttaaagctagaatagaacaacaaattcatatctcaatggtatccactttctgcacaattaccatatatttgagaagattctggggaacaaaaacattatttcagaaagagcaaatggaagcaatgaaacaaggaaatgtaaattcatgactgtgtggtttgtatgtccaaaatgtgaggggtggccactatgcattatatacatgtaatgaaagttcacatgtggacaggcacagtggctcatgcctgtaatgccagcattttgggaggccaaggcgggcagatcacctgagaccaggagtttgagaccagcctggccaacatggtgaaaccctgtctctactaaaaatacaaaaattagccaggcgtggtggctgttgcctgtaatcccagtactcaggaagctgcggcagaatcacttgagccagggaggctgaggtttcagtgagctgagatcacgccattgcactccagcctgggtgacaaagcaagattccatctcaaaaaaaaaaaaaaaaaaaaaaaacaagttcaaatgtaccccataaatttgtacaaatataaaaaatagagtatgtaaacaactaagagtttctagtccacagatattggtaaaaaaggtttttcgagtaaaatgattattctgaaattcaaaataatgttcctcctggattctacagcctgtagagctatgagctgtgcagtcaggcttgtcagcagcaagctgaaatgttcccaagagccgagtggctaattatacgttgcattattttgtccagtggatggtctcagacataccccacaaatagaggataatgaaataaaaccagagttacacatgctctaacatgtgcctgaggccaaaatgaaaacaagaataattgaaatataatctcttgatgatgtatatataagtgggtacctgagtaaaaatatgttttggatataaaaattaattaatcaatgtaattaaaacaagtattttcaacattgagtaaactatatgaaggctattattgtaatggatttttcattaattttaaatgtttgctattacggttctcaaatctaagggaaaagatagatggttttcccacctgttgctcagtagggatcccagcaacatcaagctgtcctccatgttggcgatgatttccgaggtactgtctcctctcaagaggagctctccacgggttttaaagctgccgaaggtgaatgttttattgtcccattcattaatcacttgcttcagcttttgctcaatgtctctctctttcaccgcactgatacagatgtcctatcaaaatggcaagctctcatgttattgcatgaaagtcacacgtccttccttaatagtctacgtgcaataccccatcttcactatttgcttcatatatatataaatatatatataaacttttatatttccagacctaaaatgcaatataataaacagaaggtgtatacgcagatactgatgcatgaagagagatggagataaagatatgactgaaaaatagaactttaatttataaaatttcccagcaaacttgcccaaaaggaaagatgacagaaaatatatgcaaatcacttttaaattttgaaactttaatcactgattcaaaattcaatgtatttctgatctacctctaaagtcaagtgaatgcagcatgtgaatgaacacaggtagcagaaacctgattctcccatggctctgttgactttcccagtctcctcatggcctcaaccttctcctagaccattagtcaagcccttcctttaccctcatttcttcccacctatgttccccctctgggtgagctcatttacacccatgacttcaatcactttcatatctccaggcaagacccacatccatttgcctactgaacttccctgctgagatgtttcaaggaaaccccaaacacagtctgtgaaatatcagactcatgtccctaatcaagaccatgatctttgcaccttgtcacccaatctgatcaccttcccatgttccccatctctgtggtcagcaccttcatccacttaggtctctcagcaagaaatctagagttcatctttagccctccccttccttctcctaccatgttcccttcatcaccgaattctcctcaaatatccctgatcctttctctcctctccagctttactacttcccctctcatctaacaagccatcatttcttgcctgagctactcttagaaactctcagttggtttttccatcattcttcccttgtcctccttcaattatttctccaaagatcactaccagagtgatccttacaaacggtcaacctaaccatgtcagcccctgctgaaaacacacctcccagctggtgcccattgctcgataacatcatgtaggcccactccacctccctggcctctgctgtctcctctctgccctgcctccacgcctcagccacatgggccttcttctggttcctcaaacacacttcagatgctccatgcataatgcaccatctgcctggaatggccttctttgcactttccaagcccctcaccccaaccacacaaccacactcccttcacccagccagtcctacgcatgcatcctagtcctccctagctttatcacccccaggtgaaccaaactcatctaccataggctttcacagaacaacatacattttattcaatggtatttgccacagcttataactgtgcctttatttgtaaaattatttaataatctgtaaatgcaggactgcattgttatatcctgatgcagaatctgtcccatcttaggccaaataagcatttgttgaaggaactagtggctgaatgccaggagaagagtttcaattgtctgagtgtagtttactgatccaatattccataatatagaaatgttatcaaataaatcccatgagaccttgcaatcttccatcacatcatactctacctctatttcctctttatatttcagaagaggtgcctccatgatatttcttaacttaaagctttcattccccacatccagactgtgcccggtgagggtggttatcctttcccagtgccgctccatcatggctttactggccatgtattccagcagcgggcaacactcgctgaaatcatcaatgatcttcttcaggtccaaaaaagcctgccagtccttcaaggcccggggaagctttcgacatctgtgaagggacaccaacatgaaaggccattgaaatatgatggtagacatcactggaccaagacggtctgctagtatttctattaaaaacagtctctttgaatacttatcctattttaaatcccatgacttgcaggctgtctgttcatataatatacagatgacttttatattacagaaaattgtcctctccattagaaaagattttttccaacccttcacaactattacctagttagaggcattattttagagcgtagaggtgctgctcaagctaattcaattctacaaacatgtactgagaacttactaagcacaaagcatagcaaagtgtatcaggctgtgaagtgaaatatgcaacaaatagctctttttttttttttttttttttgagacggagtatagctctgtgcagtggtgcaatctccgcccactgcaacctccacctcctgggttcaagcgattctcctgcctcagcctcccgagtagctgggattacaggtacgtgccgccatgcccagctaatttttgtatttttaatagagatggggtttcaccatgttggccaggatagtctcaatctcctgacctcgtgatctgcccacctcagcctcccaaagtgctgggattacaggcatgagctactgcacccagccagctctccattttctttaaattcaagagctacaacaatacagaaaaatcatgggcccctgcttttgttccagatgataatctgacattaacttcaaatgtttcataagtgtaatataaataaaaatcagctcccaccaagctgcagaaaagcccctaacatgactcatcctgatagacagaatgtgcttgtctcattgtgtacacacaggagtaattaataaatagcatttgacaagagtgatgtcaatggacaagaacaatgcagcaagatgtgcttttgaaatagctggggtgaaaagagaacttggctgcctatcaaagaggaaagcatttgaagttcaattgctgggcatgctaaacatttaatttcttacctgttctggaattctaagagttcattgttaattttttcaatattcacctctgaccaaagaatatcataatagctatttacagtttctatgacactgttgtacagagtatatattttctgtagaagatttagttgcttctttatttcaagaagctgaggatactgtgtagctggcaggccaaaaagctcctctcctccagtatatgtgatgtatttccgatagatattatcaaattgattctaataaaaacacaagtgaaaacgcatcaaaatgatttatacatgatcaacatacaaatgaaaatataagatttgcaaacaagcaagccagagatgtatgatctctgggcacatgtaaataggaatactaagttggcataattaattcatagaaactacttctaattgtaatcctacaatatcgtatttttaatgcaagtacataccatattccacaatagggccctctatcttacaaagaagaaaacatatgtgtgtttaaaacacaacaaagtttcattgtttagaaagtcatagaaactaaaaagattacctgaaacatgataagcctgtcactggcttcctggggcttcaagccgctagccattggaccattctgaacaaaaagtaaaaaaagaaaaatagaaggaagtgtttgcatataaatttcatgaactcaatccatatttaaatattaaagttaggtttcatgcatgataggaaacttcatttttatttgttagaaaaaaagggcctcacaaagtgattcatttagacatatgtttctagtctaaaaaagccaaattaatgccagaacttcccttagtcaagaaacttttaagattaaaaatatgtattattcatttcttaggtaacacagggaaagaggagtcaatgcctgttctataagaagcacatataaagtctgcttttcagctaaatgctaatatcatataactcatagatttttatcattctaatacccacttgtaaagtggcctataatcttaacattccaatcagattttccaacattagaaaatcttaaatatgtggatttctgtgcttcttcatccatggcgttggtacatgggtccaatcttctaacttgattaattttgtggtttattgtgctactagttaatgggtacaaattttaccctaaactctatatatttcccttctccagcatattataattgcctggagatgggtctcattacacaacatatttacattagaagattcagtacttaaacctatatggataattaaaatatggactccgtgggggcaaggcttgatctgtcttatccactactgtgtagtcagcaccaaggacagcgcccggcaattgctgagctctgtgttatttgtgtaaccaaggaacgctgtggaaaggaggacaattataactgcatgcgaatagtacttttctacacaaatttagaatgctaccaaacaacttcagtaacagaccaaattatacactgttagcccttttaaatttatcattttctgttgaaattattatgtatgaaatccgatttggttaggctttccatccccacccaaatctcatcttgaattgtaatccccataatctccataatccccacgtctcaagggagagactaggtggaggtaactgaatcatgggagcggttttccccatgctgttctctcagtagtgagttctcatgagatccgatggttttaaaaggagctcttccctcttcgctcagcattctccttcctgttgccttgtgaagaaggtgccttgcttcccctttgccttccaccatgattgtaagtttcgtgaggcctcccaagccatgctgaactgtgagtcaattaaacctctctcctttctaaattacccagtctcgagcagttctttatagcagtgtgaaaacagactaatagaaactctaaggggaaagaattgtgaaaaaaaatgtttttctctcatgaaaataaaattcccattccctgggaattcctaggaagtttcacagaaatttacccataatttttagacaactacattttgcatgttgtattcactcatccccgaaaacgcacacagagaaagccagagacataccaaatcatagtccagataaaactggtgacaatcttggaggaatacctccacagcactaataagctctttcttgaaactgggctgcagtgagactaatttattctggacttcgccagcacgtgccagcagcttctcccaagcatagtgcagtgtatcaactttgtctatctcttcccttgctatcagaagtccatatctgttaagcagggcataagattcctaaaaaaaaataggaaaaacttaattttggccagtcagatgcataaatctacacacagccatttattaaatgataagaatggaaaataccagaataatagtgaaactaccctgagagttctagttattctacttcaaaccgcaagaggttaactgtgcaactgagctgttcagctatagtttcctcatctataaaatgggaaaatcttctggctacttcacaggatctttgagactattgaaaaatgtcattttaaatgcattttgaaaaccataaaccattagacaaataaaagatatttttacttaggcccccaaattgtatttgatcactacaaaattctatcaagtaaataaaaaacaaaataatttaacttctaatattagaataacaaaatcaatcagggttttaactctgtcttatttcacgtgatcgataagaggttccaatagtaagacacaagggaggattcttgaatcagagcctgggccaagtcattcccttcagcatgtaaaatcctggatggctttcttctctaaaaggttaaaatgaggctaaggttggttttcataagaaagaattttctctaaatatctctagtctcttctcccaccattactcctccccatagaggtggaatgagtgcctgattattaatttgggggaaaacattgttgatctgagcaaggatagcccagtgcctttctctctcttccctccctctccgtggaggcatgcctgtggtcagcacctcagtgccataaactggatcagggtaataccaagacctacagctttccaacactgcctctgatggatgaggaagtataataatcctgggatttagtgttcactagctcataatgtgtgtgtgtgtgtctgggggtatgaaagggaggggaataactggagtaatacactaagttatgtcttccgaataacttccatcaggcataaaggtgatgttttgatcttgtctacttgattctacttttgttcttaattcctaggtgggagaaaataggattgtcagttactgtacctcctcttcatacttgagggtatcccctgatcctgcacaaagaaatgtctctttgccttgatgtttcaacccaaggagagcaggttggaccatgtgatccccctggcccaacacagcagaagtgaaaatgtgtagtagtctgtaccattctcatggtaatgtgaaaattttcaaaattcaaacagggatgcagaaaatgggagaatagagtctgatctcgaccatcagagtataagcccagacattccagttatagtgtgatgaaaagatgatgattttacaactggagttttttttaatgctacaattaaactagtctcatttaaaaataacaaatatagtgacccacttctgataagacattttcatctggaggttaacagcaccccctgaccccacggtgcctccatggctgagaagtgcttttccttaacgtctccactcttgggtctttgtcaacaatcacaagtggcaaataagatttaaagacatgcaccaacaattatgattatggaaagttattaatgatattaataattcacactcttactcatttctaatgatgatataaatattacaagatgaataaaaatggaattcaaaattacacacacatacacagacattaaaaggagctggaaagaaatataccaacctcttggtatgtacttgattgacaatattatggtaattctgaagttttgttttatacaatcgttttgtgttttctaatttttctacaatgctactttttaattagggaaaaaagagtttgtttgtttgtttgtttgttttaaaaaaaaggctgttgctaagactgattttgctggtggcctaacatgagatttctaaggagactccttagaaagagatgatgtttactcaagtgaatctattcaagggtgtctgcttgtaatgaaatcaactgtcttttttgccattgcttaaattacactatgtatgttgataatattataactaataagtaaataaaagcagacttcactgcaaaaaaaagacattttcatctggaaaagatagtatgatatggtatacaaataaaagtgatgtgcaacactgatcaaattacataatttcttcgaccctcagtttccttatgtgaggagtaggagccatagtaaggatgaaatgagttactgcatatatggacactgttaacgccccatccaggtcccgattaccagctggtattcccatccccgactactgagagtgctggctataaggactgcagctgtcccttccctggaagatttttctcagctgaatgtgagccttctcatggggaggttatagcccatttcctactgacttaggagtagaaagggtagtctcctttgcatgaaggagggcccaactcaattgatgttgtagagtgcccatgggatcaggctgaagttagtccatagctgattgacttcctttcctgattccctcgcccctcttctttggtgagcactcaccaataaatcatttgcacagaaatctttatctcaggctctgctttgaaggaccttaggcgacatgtgaaggtgaaaactggcccatggaaggcaatgctataggggttcggtatcatcaacaatattgaaattattgtcttggtttagtaaccatttagtaacttcactccagacccagtcaatatttcagctaatagcatccaacatgtagaaatatttctataatgaacaaatgatcattagttacctcaataggtcctacttgaaagtcaatggagatttgctcctcccttatttctttcagcgctgccattgcaatccgaatatcatctaggtccttaattggacgatttagtttcttattgaattcttcaataagcataaaaatgttttccatctcactccggtattttttgttacagtggcgtccaatgacaaccatccaggcctttgtctcagcagtcagggcgaacttcaagtcagctgtaaaaacccaaatgtctacagttcagttttaaaaactcgaatcagtacgaaaagtcaaactgtcgctgttctccagtagtaaatattttatagcttattgccctctaacccacaaaaaattgaactggaaaaaatcataatttttcctactcattatatattcattcattttttaaagtttgtttttacaacaactcaacacacatttcaaaatgtttttttaaaaaagcacatatcagaactctctgggataagcctcaaaggtttgttattgttatttattaaacaaagggtaaattttaattcaaaatataacagacatctcctttctctgacttagtctttttttcaaggtttagcagcaaagtgtgcaaaatagtccagaatcaataattatgcagaagaaaattttttaaaaatccacaaattggttttaaagcttgaggcccataaagtcaatctttaagacaggtagaactctctggaatacaaatctaggtaaagaggcagaacaataatggctaatttatataactatatgaaagaaaatgaaccaacctgtgtacagagcaatggaacccacacagacatattcaggctcagcattaatttcctgctctaggttttggaaatagagaatctgggactcaaattcagaaagcaaggggctctgtgtaataaatgtcttaatggcttcttcttttcccttttgccaaatgtgattgtagcgtttgaagcaatccatggatgtaataacttcctgaatgcaaataacagatttatgttaagaaggaagaatctgaaaggcacaatgatataagtgaatatttaccaactgctggtggttcctatggatttattaaaatgtttagtgaactgtgtgattatctggaaatgccaaagaactgggactatatacaatagtgtggacagtagcccagggctagtaacagtttcactgttatcatccctagctaaatgggagaggagcagtttctagaaactagatgacagttcttgaagatcctgtggacagggccctcttggttggagctgggccttagatcaaaaaccacagctcaagctcacactacagggaaggtgctatgaaaaacatactctgaggtcattctcctctttcccccctcccctcagatctcctccaagattcttcattgactgaacccactggaagcctcaatgggaatctactgacatgttgcctaaggtcagataggtggagggaatggagattagatcttaggggcatgaaggacaaacagaaaatagcgagcatcacttcaatgagagattgcctggaatcacataaaatgtataattcatataactagaattgacatctgaacaatactacatctaaccaaccaggaacatagtgcatgtttccatatcttgtcatctttttcaaaaattccttaagttttagcataatcttcatagagaccccagatacttcttattatacatgtttctaggtatttttcaatgctgttgtcattgtaaacaagatattttccactattattataactggctatgaatggcatatacatttttttaaatttatttgtaaatcaacagtctagtttgctaaccaagtatgcatctgtaaagatgaaatgactctctggcaattggtaaataggggacagtgctgacataatgcagaggtcatgttttcaaatgctatttttcccagcaaaacaaatgctactgctttgtaccagctaaagcagcaagtcacagaggagtacagtcctgtgtgccactccccctccatcacttcttccttttggattgatttggctaccacctgtcttaagaatatctttgcatatggttctcactcataagttagtgctaaaaaaaaaagtgtttgcatggacatacagagcagaatgatagataatagagactcagaagagtcagatttctcatcaacttcagaagggagggctatgagaaattcactaacagatacaatgtacattatttgggtgatggataccctaaaatccctgacttggccactatgcaatctatacatacagcacaattgcacatgtatcctataaatttgtacaaataaaaatagataaataaataaataccaatcaaagcagaaagaacaacaaagaaagaatgttctttgtagagtttggcctgatttttgtagagtttatctttgcttctatgcctccacaatctcttccttttcccacttctaccaagcttctttcatcttttatagtaaagttctgtaattactatagtgttattaaatatgtgaatatttcactaagattgttactgttactattttactatgattattattgttttatttattaccctggttacaaattgcctagattttgtgtctgcctcaatcttgtttttctcatcatccctattatttaatattaaatatgcaacttctcaaaacaggacgattttcaggaacatgtttattgtattctatgaaaaattcatataattatctttccattggtgactaacttaactcttgttgggccacaatttcttttttagattagcctcttggatttacttggcagacaattgtatcatctacaaataattaaaattttgtctttttttatttaattactatttatttatttatttatttttgtagagacgagatctcactgtgttacccaagctggtctcaaactcctggcttcaagtgatcctctcatctcggcctcctaaagtgctgagattacaaacatgagccacggcgcctagccaaaaaatttgtctcttcatttctaattcctttgtgaatcaagtttttccactgccttatattatgatttcagagttacatctgcatgaaaaacaaatttagctgataaagaataaacagtgcaattatctgaaataactgagcattacaggattctaaatggtctgattattttaagtaaattgcaccaagctgcaccaaaccaagaagcagttccactccagctccccacatacagctaaaatgtccctccgagcctcaggttcaatggatgttgatacttcccatccattaaaatgcagaaagctaaacctatcactgcctatcccaaccacaaatgattcgtttgcatgacctgaagtgttgacatgcagaccaagaatgcattgcaatagcatgtagacatattcacatatgtatgatggtttgaagaattaattacagattattgaagattcccagaaatggatagaagttccagaatccagagctctctcaccacccaagcttataatattaagaatataccctaactaaatatgttggagggtattcttttaaagtgtctgtctttattaaattggaactttttcacatgaaggtaacctagaccttgaaaggaaaatgacctcagtaggaaaattagatgaactacatatgtagagttgttctgattatgtaaccaaggttattttgattgtttggtccagctcaacgtttctatattttttttttcgagacaaagtcccgctctgtcacccaggctagagtgcagtggcaccatctcagctcactgcaacctctgccttctagattcaggcaaatcttatgcctcagcctaatgagtagctgggattatagacatctgccaccatgcctagctaatttttgtgtttttagtggaaacatagttttaccatattggctaggctggtctcaaactcccagcctcaagtgatcccccaccttggcctctcaaagtgctgacattacagacatgggccactacatccagcctcagctcatccttttaagccaggttgtgttagaagttgatgaccaacctatgggcatgctaaaggcaggtcaggtttacattctaatccaatcagctatagcaacaggaaaggggcagggatcataggactttctgtggttgaggcagaatcattcagaaaggtctatggctgtggagggctggctatatctaatactatgactaagtgtacatatattctcccagaaacaatttggctatcctataaatctggaataagttcttcaagttgttataaatgccaaccttttctactattttaaggaaaactaatatctgagcatttccttcatataaagtaaaagcaaatgcaataaaagtgacacagaggccgggcacggtggctcacgactgtaatcccagcactttgggaggccaaggcaggtggatcacctgaggtcaggagtttgagaccagcttgaccaacatggtaaaaccctgtctctactaaaaatacaaaattagcccagtgtggtggtgcatgcctctaatcccagctactcaggaggctgagacaggagaatcgcttgaacctgggatgcagaggttgcagtgagccaagattgcaccattgcactccagcctaggcagcaagagtgaaactccttcaaaaaaaaaaaaaaaaaaaaagacacagagataagtattttgtggccagcactgtatgttaactatgatttcttcctcttagattttcataatagtggttgatcatactagagaaactagtggatcttattgctgatttattttcttttattttctaggaatactgagacacttgaaaatatttctgaatgtttattgttatcatgaaatactttgcttatcattcagtatagagcttaataatctaagtactagataaatatttattgagttacctgaatactgtctctaggggaaaattaaatacaggaccttcaatatattaagaaaggaaaattaaaagtccataaatgcaaaagatttccagttcccttgggaacacattaaaactaaacttaataatatttcctcacattgttacagcaatggtagcttttcagagtgctttcaaatgaacgtaactcattgtatcaaaactgagtaatagaaaaaatgcacttactgagcaacaactattccttaaacactgggaaacattattaacaagtcaacaagtcttactggccatgtgaattagaagagtttttttaaaaaataaaagatgatttcagggttttaaatctttttgtctgtaaaatagatttgcatgaacaaaaaaggggaagttgagaggggagtatgctgaaagaaaaaattgccttgaatgtacattcatgtccagttcaagtttgtattgatagtactaatatcttctttattctcagtttcatctaatttctatgtggcaatataaataaatttttatctgatattttataacatttgcccgactactcaaatatgaaaaaatgactacaaaccttattctatttcaaatatgttagtatcactggttctttgaaggtgaattataacaacagtctgacttgtagtttggaacatattagattttttaagttagattcatttgtattaaaagaatatattaaaagcattaaacaaaacacaatatgagagtaggaataattttttttcaccttgcaatctagaatgaaagatcttcagttagacaaacatttgctgagcacatacaagatgctccctgaaagcacagtgtgtgagacccaggctacataaaggacaactttgtgatgttcactttcacacaagtgcatgttgcaaagcaaaaggtccggctgccagaccctcttgacatacctttttggtggagttgataattgtgctaagcacagaaactaattttacaatctctttgttttcagaaacattcttataatagttcttggtttgcacgggaatgggtaaatttacagatgctatctccaaggtatctaaaaagaaaaaaagaagagaaaactttacactactcacacaagaatgtactttcaggagatgaggatatttctgtgatagtaaagcaaggacttctgaaaatcttctcctttataaaaacaatgaaaataatggaaagagttgtcaatgtcaacttttcaggactctgtaaattaatcaaagcttgcaataatccaaaaagtgtttattcaagaacaatgctaaatcttggtaacaacagcaagttttgtggtgttttgacttgctctagtcccactgccgctctctggctatagggtagccttgaaaaacagcagccttacaaccattataactggaggaaaaaaacctaccagtagcctagcagtccctggaagggccagcctgggcttggagctccttagggagctccatagaattctcactctttgagctgtctgggagctccctggaaaagccctgttcaaacagtttatttttatttgacctgactcagagctctctgagaaaaaaagtcctatcctcatggcatttgtcaaaagactatcagcaacaattgcttaacttcacagctacctgaggcaatgatattagttgggggcaaataagaggttggccaaaaaagttaaaactctgggaaaggagaagaatgaagtcagcaacatggctgaataagaatatcctggctctccctccacccatggacacacccaatacacatctattctcagatcaattccatctgagagaaagtcagagaccagtggagagactcctgcttatgttataaccaaaaacatatccgcatcaaagggcaggaaaagtggagacacacttggacatggatcctgctccaggcactgaaccagagaattgggaaaggaatctgcaacacacagtttctctctgtggaaatgaggctttggacctcacatgtatcaccataactcttaaggttccccatggcttggctcttaattcaccaattctgagagtggagtggattagacacacaagagtctctctggaccacaagaaaaaagtgatggctttacacaggcatgaagcacttacagaggcttcattctgtggaagttgtgcagagacggggctttaaaaccatggccccttgtttctctctcacatcaagtgccccaacatttacagctgccacccaagggactacattctaaaactcctatctctgggagcagacgggactggcatttgtgtgtctctctagaccacaggaagaagcggccatttaatatgagcacacaagcacttcaacaggctttatcccccaggagcagtgcagagaaggggcttaaaaaacacagtcttctgtttctgtccagaaggggttaatgctatgcactgagtgccccaacttctgcagccacctcccaaaggactcaatcctaaacctcttagctacgtgaagaaagggcattaggcatatgtgaatttccccagatcacaaaacagaaaggaagtttcaatggacatggaaacactaccaggggctacaccccctcagaacaatgcagaaaaggatcaagaatgtgcagcttccattttctttctgggaaggggcttctggcacccccccgcctagtgtctacttgatggcctggcttctaaaaactgtacatcagagagctaatgaggcaaacaaacaggagccctccagcagctggagccacagctgagcacttcatgagtgttccctctggctcccctagtgataagcctaggcctagccattctttctggaaggagctacgacacgcaccaagtgccataacttctatagctcctacccaaaggactgtctctttaatgatctagctagctctgggagtcagtgggtctttgcacttttgagtagccagagaccatggaaaacaacgaggtggatgtacaatgggccaacttccatcagttatctcgccagaatcagaggatgcagcctgaacatgatggcaggcatttgccacagatcctctctctggcttaatgcagagaactgaagataaatgcctgtgctcagcttcactgtgaagacagaaaaaattggagcatgcattcaacactccaacatttccagctacatctagagaatctagctcctaccttaccagtcttaggggtactgacaggacatatcatatctgaatctccagggtaggggggacaaaaaatagagacagcagtctggacaaacactaagattagagaggcatcttgaaatctctggttagtcgaaatagtgagatcctcccacatgaggtcagtctgacaagactgaaagaggtagctgtcttttataatacacagaaaccaacacagagggtcaaagaaaatgaacaaaaacagggaaatacagttcaaataaaataaccaaataaatctccagaaactgttctgagtgaagtggacatatatgatttatctgacagggaattcaaaatacagatgctccttgacctatgatgaagttacatcccaataaatccatcataagtcaaaaatatcctaagtcaataatgcacttaataccctagtaagcctattgtaaagttaaaaatctgtaagtcaaactattctaagtacagatgctctttgacttactataaagttacttcctgataaccccattataaagtcaaaaaaaatgtgaagccaaaccattgtaagtcagggaccatctgtaatattcataaagatcctcaccaatatcaagagagaaatgcaaaaacaaactgagaacttcaacaaagacagaaagtataaaaaagcaccaaacagcaaacataaaactgaagaatgatgtaactgaacacaaaaatttaatagtttccacagaagactagatcaagcagaagtagaaaaaaaaacagtggattcaaagagaggtcactgaaaatcatccaatctgaggagcaaaaaataaaaagaatgaaaaagaatgaagatatcttaacagacttatgggacaccatcaagaggaacaacttatgcattattggcttgccagaaagagaaaagaaagacagaggaaacatactcagagaaataatggcaaaaacttccaagcctgggggaggaaatagaaagccagctccaggaagcccaaaggacattaaataagattaattcaaaaacactcacaccaagacacattataatcaaattgtcaatagctaaagataaagagtgttgaaagtagcaagggaaaagtgtttcattgtatgtaagggaacactcataagactatcagtagatttcttagcagaagccttgcaggttagaaaggagtgaagtgatatattcaaaatactgaaagaaaataactgctaagaatactatatcaagcaattctagctttcaaaaacaaagggatggtataaactttctcatacaaacaaaagctgagagagtttatcaccacaagacccatcttgcaggaaatgctaaatggagattaagctgaaggaagaagatgcttattagtaacatgaaaacatatgaaaatataatacctcactcataaaagtaagtatattggcaaatccaaaacactctaatactgtaatggtggtgggtaaatcattaatatttccagtaaaaaagttaagaggcaaaactactaaaaacaactagagctacacaaatttattaagggatacaaattataaaaagatgtaaaatgtgacaccaaaaacttaaaatgtatgaggtggggagtaaaagtatagaatttgtatatgcaatcaaaactatgttgttaccaacttaaaatagcctataattagtataagatgttttatgtaagcctcagggtaaacataaagcaaaaggccataagagatacataaaagaaaaaaaaagatccaaaatatatcactagagaaagctatcaaaccacaaaggaagaaataaacaaagggtctacaaaacaaccagaaaacaattaacaaaaaggcaagagtaagtctgtacctatcaacaattactttaaatgtaaatgtattaaatactccaatcaaaaggcatagagtggccaaatgaactaaaagaccacaaaaaaagacccaactgcatgctgcttacaagagactcattccaccttaaagttcactcacagattgaaagtgaagggatgaaaaaataaagttcatataaatgaaaaaacaaaatagacttaacatcaaaaagtgtaaaaagagacaaagatcatcatataataaaaagggaataaattcttcaaaattatattataatcgtaaatacatatacacccaacattggagcatataactatataaagtaaatattaagagatctgaagagagacacagactagaacacaataatagtaggggattttagtaccctactttcatcactgaacagatcatctaaacagaaaatcaataaagaaatattagacttgaactacactttagaccaaatatacctaacagacagaatattccatctaacagaacagcatatacattcttctcgagtgcacacagaacattctctctatggtagatcatatgttagacacaaaatgagtcttaacaaacttaagatcaaattacaacaaatttgatcttataacaaattataacaaatcttccaaaccaagcgtatgaaactagaaatcaggaaaaaaatcaaacaggaaaaaccatgcaaatgttttaaatatgtgaaaataaaacaatatgcttctgaaaaaaacttctcaaatcaggtcaaagaagtaattagatgacaaatttcaaaatatcctgagacaaatgagaatggaaacatgacatatcaaaatttattggatgcagcaaaagcagttctaagaggaaacggtatagcaaaataaacagctaagtcaaaaaaggagagagatctcaaatacataacctaaaattacaactcaaagaactagaaaaaggagaacagacaagcccaaagttagcagaagggaggaaataaagatcagagcataaacaaatgaaatagaaactagaaaaacaatagaaaagatcaacaaaacaaaaagttggttttctgaaaagctacacaaagttgacaaatccttagctagactaagtaaaaaagaggactcaagtaaataaaatcacaaatgaaaggagatattactactgataacccaaaaatacaaattatcatgagaatgctaagaacaattttgtgccaacctagaagaaatgaataaattcctagaaacatataattaacctaccaagatggaatcaagaagaaattgaaaatctgaacagacctatagtaagaaagaagatcaaatcagtaatttaaagtctacaatcaaaaaaagcctaccaccagatggttgcatagctaaattctaccaaacatttaaagaactaataccaatatttctctagcacttcaaaaaattaaagagaagggaatacttccaaactcattttacaaggccagcattaccccgataccaaagctagacacatacactacaatttaaaaaaaaaaaaaaactacaggccaatatcactggtggacataaatgcaaaaattctcaacaaaatcctagcaaattatattcaacagtgcattaaaagatcattcatcatgattaagtgaaatttatcccctggatgcaagattggttcaatatatgcaaatcaataaatgtgatccaccataacagaagtcaactaaaatggtgatattaaaatacgtggaccttgatattttgtcaacttcaaattggctcatagattaatattctgatgtaaaataaattgagaattacatggaggggttaaaaaacatttaagctcaatgaatgttgatttacaatgcctcttttaaaagactaaaagaacatttaccttgaagttcattttctcccatttcaacatcagaatcactgtcttcattactctgcaaagcagccatttttctttcttgtatctttttctacaatgtaaaaggatatttttcagttctgtcctatctgtaaaagaagtggtttccatatgaaaccatttctgcaccccatacccaccttggacaacagttcactgctccactgtctgacccccttagggacactgatgatgcactccacggctttgttcagggtctgctgtacatcttccagggcaggggccatgacgatgttgggaatggccagagtgacgcttgcccggaaaatgggcaaactgttctgcttcatgttagaggcactgttactgtctgagttaacccaaaacaaggaagaattcacatttttaatacaaaataagatttgcttcctttgtaaccataaaaattaaaacaatacataataggtataaaatctaataaatatttgttgaatgaatgagtcaattaaaactaatggaggatctagtattgctcaatataacaaagcagttcaggggaacccaaggcattttttgctgtttacagcttcttggaatactctccacaatgaaacccactgtgtgggatcaggctaaattataaacacttctgtaaaatattaaagatgattcttccaaataacaagatgccaacaaattagctaaatgtagctaagtaagccaggaatgaagaacaagactatcggcataagccaaagttagaacaaataaccactttggaatttcagataaatcataggcctttcctaccatggtgtgtaaaatccaaatgtggagcagttaaaaaaatggaaaagaaataaagtgtaattcgccattcatactgaaggagcttttaaggttgaacataggtataggtatgtagatacagacatgtatgtatatgtgtctgtgtatcatgcataactttacgtagttgcaaatatctgtaatagaaaagctgggaaataattgtgattgaatatttagcctatcagccaacatttattaagttctaataataacgctgtgccaaagaaaagaactattctccatcctgaatgaagtaaaacataataagccatggcaccaaacaaaaaaaaaatctttcagagtttccacttttatttacccacttttaattaaatattgaagatgctttcctttaaatgtcaatattcaaaatatatttaaaaattttattatcctattatttcagttttcattaattactattatttgttttctttttaccatttttaacttaaaatttaatttcaggatgcctctagatttgacagatttttgtggcccacctgagaaatacaacacctatttctgaactgtgccgaggaaaagatgatgctattgaaaatgaggaaaccacctggaaagtactaaattagcataaaaatagtaaaatacatatatatcctttgaagagtgtgacactagtaagatgtttccactttgtaagactggctaacaaacctaatgatttaacaatgaaagaatcgtttccatataacttcctttaaagtatgtatttttttctttcaccaattaaaataattttatattttttcatcttattacaaaaagattaaacgtactaccaattttcatgttattaacaaaaacttaagcaaactatttaacctccctgtgctgtgctctagttctctgatttaacatgagagtagtaatagtatctacttaatagaattgttgggatgatcaaagttcataatgtttaaaattacgagaaggcactaaataaacggtggatatggccaagtgcggtggctcacgcctgtaatcccaacactttgggaggccggggcgggcggatcacctgagctcaggagttcgccaccagcgtgcccaacatagtgaaaccctgtctctactaaaatacaaaaaattagccaggcgtggcggcgtgcgcctatagtcccagctacttgggaggctaagctggagaatcacttgaacccaggagatgaaggttgcagtgagctgagatcgtgccgctaccctccaacctggtcgacagggcgagactccatctcaaaaaataaaaatttaaaaaaagatgaatatttttaattatttaaatttaacaggaatgtacatgcacgtgcacacgtgcacacacacacacacacacataccccagcaactatgcctgatcatccactaagcaaaccacacaagattattaccccggaagttaattgtgtgagaggaatgaatacgtttgcgaatggcctctagtgtattccttgtaactttcagaagagcatccatgttctgatggttgaaatgagagagtaactcgcgggcttcttcccctaacatctcagtttctttctttttcctcgtgactgtcgtcaaaagcagggcattggccctggcattaatagatgatgtcaaggtgtcaaaatttccttcttctctttttgctgttacaagatgaaagagatagagatagagataagttagatggatggatggatagatagacagatagatagacagatagatagaatcatctgttgcaattaaaggataaattacatgcaagtttagtatcacttaaacatcacacttcttaggaagtgaggacatcaaaaagtaggaggaaatcaggaaccagagggactgatggaagcatctccttctcaatacaagaaaacagccaacaagagaggcaggagctatggctggaaaagctacagtggcccccaaggacctgggttctggtgctacctcccaccaataaccctaaaactttggggggataatttcccttcttcacatccacatctctctgttctcctctgtcctgcaaaaggtgcgctcagtctagaggctctccaaggggaattccagtcaataatccatccaactctattgataaggtaaaataaaacacccacccacacataaatgcaaagaaagctaaccagggccaatgcaaagtgcatgtttgcaaagtttaaccaaaaatagtaggaattaacaacatagagtcactaaaatatgctcagggccataatttcagatttatacatatcattagaaaatcgagaggatgtttatagaagtatgaaattaattggtatgtagaaaatgcagttttagtttttagtaaatgtcatagaaaaacaagaccctttcattaccccatctcttacctgaactttcatttttgtaattaacactattctcattggatattttttcactttcttcttcagataaaacttccacatccagcaacatatttacaagctcattgactgcctcctccactaatgagcttttaaaatgtagtatttgtgcaccatttacacaaagatcctaaccaaaaaaaaaaaaaaaaaaagatagcacagtggtatatggtttatctagcttttgagagcacagaaacagtggtagcaatgctgtggctcagcctccaggtgagatttcagccccagtgatgcttggccacatccttcacaatagcacaggccaggtgtcctctaaaggaatgtgtttaggacaagagaacccactggatcagtgtagatggaccaaaattacaggcacttctccaccagtagagaaaatatcttcaaaagccatcagcagcctctctactcgtcacatttccttcatatcacataaatcggatccagccacccttctttctctccttgtttttgccaacaaaccatagtcatcccctcattaatttcaaagacactacccacccttctaactatattgtgcatttctcaagaatggatttaataaatataaactaacatgatttgaggcatggtgatcaattctggaggagattaggtagacagatagttatagatggatgatatagacagaatcagtgatttaccacctggttggaaagtaagcccatgaaacaacagactgtcagttaggcacagtgtccagctccattccaagttccagcattatacatctttaaacttatacggcttgaaaactaggattcaaatccttgctctgcatgatcctgaaaattcttttcagtctcaattccctcatatgtataatggtgatatagtagaactcactgtagtttttgcaagtattccataaaataaatgcaagtaaaatactaagagcagtgcctggcataaagtaagcacacaagaagtgcttgttattattattggttggaaaatcacaaacatccacaggacctaaatatttgcaaaggttagtcaactcattccatgtaaactaactcctcaattctctgagagaacactaatattttttaaagtctgaatcttaagtcctctgactctaccttggagagaaacacacatgtggtctccattttcagggccagctctcacagggaatcctcaattaacttgcagctctttcagtcctctcagtaacacaagcacatgtttgagatcataaaattcctttgtattgagggttctagaagatgagattgataacctctcaaagactaatatagttccaacaacgttgtttacatctcttaactctttctctctgtgagaaggcataaccataaaaatgtaaatagcatagaaattaacaaagcagaatataaacgcaatgaggaaaaagaagtaataaatagactcattaaaatatcccccaggacaaataaaataaatgaaagatgctgcctccacttatcctgcttcatttcaacaactaacctccatgatgacacccaaaagctgaaacccaccaaaagggcctttctttcaatcctgagtggtgtcctccttgaataatcagcatggggctccaccatttcctcattcccatgatgctttagctttggcaaaccaggaacctactagacgccatgtcttctcaaggtctcttcacccttactccctggttcatgccctctcctaacacgatttcacacttcaaccattgttttgctaatatcctttactccatcactctctcaaccttccactgccccacccaggagacgcccaacccaaatgaaccaggtgacctaccctctccaccggcacacataggtcatggtgaggcagatgcttggcactgggaattcatggtccccaaactcaaactggcccctaatgctactcgggaatcattctacatgactatagccacctccctctaccaagctccataatagctgtgtcttcaaatccctgtgtcctcaaatcgttacaccatccttcctcgtcatactcaaagaatgaccttgatttctacagcacaaagcaaatggaggtcatgacacggggactcaaacaactcccactgccctcatgcagaagacaaatcggcctccatcatgagccccttttcctcttgttttggtgaatgcaatcattctccttttattcgaggttaactccacaacctgagttctgaatcacagcttctctggcttcctcagaaaccaagcctacccctttcttcctctctactaattttccacctgagcatatgaacacccaatgtacttcaactcaacacctttctccagctacaacatgcttccacctcagggcctttgcacatgctattctctctgcctggcatgttcttccactaaaatgttcacatagcttgcactctcactccctcccttcaaatctaaccgtagaagtcatcagtgaccatgaacataaaatcacaactttctgtcaggtactccttttctccatcatccttttcatttttctccataattgaattatgaattcaaataaacaaactcaagagaaatgatttactaatacctatattggtaatcaaaaatgcaaactcaaattgggttccacgattttgctacttaaagtaaaagtagtaaactataataaaacagtgtttgttggaagtgaaattggtagtactgcattgctggtggcattgtaagctgataatatccttttgaaaagcaatttggctaccaatatcaacagccatccaataaggccatactctctgacacaataattttattttggggagggaataacattaaaggagaaaatacatgatacatgcatatattcactgcagctcttgacaaattagcaaaactttggaagccatctaaaggttcagcaataagaaactggtaagtaaattacagtatatcaactcaacagaatattctgaaggcaccattaaaaggctgcctatgaaagccatgtagcaacatgaagaatattttgtgacgaaatgttaactgggagaaaaaagtactattcaaaacctgatatatatggagtagagatcgccactttattaaaaagcttaaaatgcattaatattataataatgatggtataattgattaaaaggctagtttctttccatttttaaaatattctaaaactttcttttaaatttaaatttaaaacaagtgtatttttataaaacaatcatcagaaaaggggtaagactaaaaccatggaggcaagtgatttttcagaggaagagatagttttttaaatgatgaggaagaacaaggggatggttaggtgtacccacagttagtgaatgtgaggaggagggactagaaatttctaacatgtagacagtaagttttgcgtataaaatgacttaatataacctgccatatatgcagaaaggggtgaacacagcaggcctgaaactgctctccttagaaagtcctgcttgggaggtggtcccttggccggcgtctggaagcttggattttaggagggttccccctgttgccctgctgataaagatagtttgctgtgcctaaactgcttgtgcaaacaatgtagtttatgctgaacacctgattccttctgggagtctggaattctggtccatgctaagcagagtgtgtgaccagacccagtaagaaccttgggccctgagtctctaataggtttccctgggcagaaacattgcacagaggggacggtgagctccgggcaagcctcacaggagggagacagcatgaaaaagcctggacagggactccccagacaccacctgtctttgttccttatgatccggctgcatctcttaactatgtcagggcagtgcaactacgtgctgagttccgtgagtcctcctagtgggggtggtcttggagaccccggcacatcatattaaaatcatgatcaaggagtccttatcctcaagatgcccactgggaatattgtaaatgatgctaacgtgacatgcctgaaggggcacttcatggagcactgctcccaggagcttactcctggcacagggaagaaagtatcccatttgcaaatgtgttggagaaataatgagctacgaaaagttaaatgaagggccgggcgcagtggctcacgcctgtaatcccagtactttgggaggccgaggcaggcaggttgcctgagctcaggagttagagaccagcctgggcaacacgatgaaaccccatctctactaaaatacaaaaaattaggcaggcgtggcagcgtgtgcctgtagtcccagctactcgggaagctgaggcaggagaattgcttcaaccggggagtcagaggttgtagtgagctgagatcgcatcactgcactccagcctgggcaacagagcaagactccatctcaaaaaaaaaaaaaaaggttaaatggagatcttctgagggcctttatcttaacatgttaaagtgtagcggatctgtaagcacagtctttaccctaagcagtttgcactcactccctgcctctctcaggattcccagcaatggctccagaattgtgtgctatagaacaccagtttgggaaaccccccctcaacaaaaatgtttaaagaagaaattttgtctagaagctgttcaaaacaattgtttcgttaattaaccctagcttatgagaagcacttctgcaagatagctctatccttcattaaaaaatggaaaaattccaagtgtgttctatggcaatttctctcctactgatctgaaatgatgtgttccccatagctaagtgaccgcttacttagatacatttctcttcactggcaaattattgtcagaagattccatgtctgaatcacttctatcacagagcactgcaagtagagaaaaaaatctaacttataacttcaaaaaagtgacctttataggaaaatgaatcaccaaaaaccttaaacaaaaaaaatcaaggttttaatgacctttgtcatttggagaaactcttcacaggttagtggctcctcctggggaagctgacaaagaggcgtgctgctcatttcttctagaatggcatcaatgcggaactcaatcaaatcattgaccctgtcaagcagcaactccaggtcctctttgggaaaaaataaaagtaaataaaagagattaggtaaagcattttgttttttaaaaaaatcaacacttgattaaatgacagtagtaaaatcagctttaaagattctcagttacgtatgttccccagatccccactgattcacacttggttgtcgctaataaaatatccaagttgttaactttctaatactaatactctgtagggagaatggaaaatctatcttggtagccccttctaatttgattatgatcattcttattataaagtttttatacattttataaatgcctccttagggacttttagccaatttccttttgttttatttcctggggccatcgttccttctctgtaaccagtttctgagctcctgcctgcctaactctcactcatacttaaagatccggctcaagtgcatttccccacagaggccctgggtgaatccatgtgcattggagtggtccctcctcctgtaaaaccacagatggagcatccttccgtctctgcggattgtctacccatgtgtcttatcttctttagaattcatattttttatccttacatcttcaatatttaacctggtgcctattccacaagaagtattcaacaaatttgactaaagtgaaagttccctattttttctttcactgtaaatatcatagggtacatttttttagttgtgctgaagtaatattgaatgctaagttcaatggatgcaaaggccaactctgaagcaaactaacaacaactgcacatcaaaagtaggaatgattactaatggatatccatctaagggtaatacatttttcaacagataccatacagtaaaatttctctttttctaatactcctttctcctgggaaataaagctgaaattgaatacaggaaagtcaacgttacataccaacgctgtatcggagatgtaaacacctccttaaataaatacctttatttcctaaagaataaaagcctaaaagttttctattttttctaagctaattattaaagaggctactcaagataccaaatagttctgcctggtaaattgattgaatactaaaagagagccaacactttcacttaagtatgtgtgagcaataaaattctctacgctttctaacggactgcttcttcatctttaaggacatctgtgttaagctgaaaaaaatagtccccaaggatgtccacatcctaatctcctgtgaatgttaccttatatggcaaaagggattttgcagatgtgatcaagttagggattatgtaatgtgcagagtgtcccagattatctatactctcttaaatgcatgatgcaaatgaccacctgtaagtaggattggcttactaatccaattaaaatccagctgcacttgagattttacatagttttctctcaaagaaacttcatctttgttctattttagttccttaaattacaaaaagaaaaacataatagaaaacaagaacaagaagtttctctagaaactagttccttgtctccagctaacaatctaataaaacatccaaattgttaatactttaatactagtgttctaaaggaaggatattactaaagtctatcttggtcgcctgttctaatttgattatgataactcattatcatgtttttatacatttcataagtgcctccttaggaaattttagccagtttcctcttgttttatttcctggggaggcgtattttggaagaaatattaatttagagcaaggaaatcgggttctaaactcattattatttcttacatctatgtaacattaaaagccatttagcatctctggcttgatattcattcatattcaaaaactccattatcatttgtctttgagtccagctcccaatctataatgcataacaaaggtgaggtatgggctgaatcataatttctcactctactcccctccaacccagtacttctcaaatattcttaaatatgaagtacctggctatttaaatagctggaccttctgaaccctaagttttttggaaagtgcggtgaaaatctactgataagacaagctcttgacaatttacattataaatggactaggtactatgttaacagccataaattccagaacaagagagagacctgaggggcggagttgggggagagagagagagaataaaaggaggcatcacgagagctatctaaaagggaagcccaggaagaggtatccagaaataaggtaatgggcttgaggggtaggaacagggttacagtgataaagaaatgaagagagactaagtatataaaattattgctattatgaatctgcaagtatatggatgtctcctacacacccagctgagaataacacaaaagaagtataaatgtaaacagcctggatttaattatttcacattgcattcataaatcgtaacaccattttgtatcccatcaatttttccccacgcaactccttcttcacagaatccataaatctatacaattataaattatcaatttacaataaaaaaagaaaaaaaattaaacagcctgatattcaggtcctttgtagtctgtttgaggagaaagatgaaactgtactaaaccattagaagacaaccaaaatatcaagtctctggtcccaaatataaatccaacaggaggtcacaggaggaagcggtcacaggaggtagagtaatcagagtagccttctaggggcaagactcactctgggctataagagtggggaggactgggctatgcagaggagagggtgtaagacactggctaggagaggacaatagcaatgtctaagtctttctgagaaaaaaaaaaaaaaaaccattaccacgttccaaactgtgctacactgtctgccacagaggatctgtaaggtgttaatgtgtcctcctggaaggcagccaaggaattctgggaaatgccacaagcaaaaggccacttttggagacctactgggacactggcatgttacaggctctgaaaagtcgtccagcaaagaaacctgtccaactgctcctcttggatttcccagacatatttgagcccttctttgcaacatacccgtacacattccagaaaagcgcattttatggaatatactaccttacatatattttagactattatatctctttttaaggaaaattgtgtttgtttaaatttttcccatttatcctgttgttcagcactgtactctatccaaatctccacatctttcaaatcaagctctcaaaatacactaacctatttatataaaaagctgaataactctaaagatactttaaatcctaatgtccaaaaatacaaataaatgaaaatatgtggttaatctctggggataaaattaaatagtgaatatttatagtttccaggaaattactgaattcgcatgttttggaacacttccttatgaaacagcttaagaataacactccccatttcattatttatatctccatattgataagaaattattcaacagatgttaggaactcagcctttagaattcagaaatactaattattcaggcagacttactgatctttgcaaaagtgttttctaaataagcctcaatattcagtgatgtccaggtcagtgcagccaagccaggttggagagcttcatccactttggccaagtgagggacaatcaattgctcaatggcagcaggtatttttgacttcactctctgatattcagctagcatcatctgcaatgaaattggggttaagtaatcaattaatatctcacttctaatgtctgttaatatctcatgtcttatacaaaatgactacttttatttagggtcaaactgtagggctctaatagcctggcaggtagagtagccaaaacaataaaaagaaaagaagacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaagaagacaaggactctctccataattacaaattcctaatccaaaaaaatacaactgaagatgaacaagaatttaagactaacagtgtctcacctcctacacagcctaaaaagggagaaaatctaaggccaagtaatttttctaaaccatgcagaaacacgggaatggcaccttcacctgctcatcaccaggcttgtttgttcctctttgtacactgatacgacatgcgtgctgctcctctggggacctcttgtagactacacccatcacccaaaacatgtgggtcgccagaggtctacctcagccctttgctaggattataggccaaatcttgttgccaagacccaaagcacaccgggaaccagtattgatctcaactagtgtcacggctttgaatttcatccagatgccagaaacaaacacatttacgtctccagcccagatctcactcctgaaagtctagattcacaaatggcagcagcctcccaaagtttccacatcaatatatagcagacatttcaaacttaataagtcccaaactgaaagtctgttcttttcccaaaacctcttcccagtgcatcctccaactcagctgatagtgactttatccttccagtccacaggtcaaaacccagagtcatccttgattcctctttcactcacacacatacaggtaatccattaggatatcttgtttgctgtctaaactgtacctagacttattgggagagtgagtggaagcagggagacaacagtagatcatcccaataatttaggtaggagccaatgatggcagtaactgtaaatgtggaaagcaagtcagatcctgcttccactcaccctcccaataagtctaggtacagtttagcagcaaaaatgatcctttcaaaatgagaattcagatcatgttactcctctgctcacatggttacatagcctcccatttaattcagggctacaaacctttatacaaaggacttggatagatgcttgttctagaaagatctacccgattttgtcccattacttctctgatctcatctccaaccactctttccctctcttacctgcacttgcctgactgtcttcctttctggtcctgagcctcagggcctttgcacctccttcaaataagtactcaaatgatactttctcaattatacctgtcctgactacctgtttaagattataaaccaccaccaaaaccactcacacattttatcccccttttttgtccataataactatcactttattacaatagactatattaatttacttacttacagtgttcattttctgttttacccaattagactataagttctacaaggacaagaattttgtctgctttgtccagtgagcctgaaccagtgcctggcacataggagataataaatcaatatctatctaattagttgttatcagaaggatttttcatctgaaatgggcattctcatctttcactgaaaggtacataatgtcaaactgtgtcagtattatttacataatgtcaaactgtcaatattttgttcatatgtaaccatgtcaatattaataatcattaattataagaaactaactttaatgtgccccataaatacagttggtattaaggtcatatatgtgcatgttggttttaccttgataatagatgaatgttttccaaactgttttgcctagagtactaggtccaaagagattctataagaaaaaatgtccctttgatagataaattttgaaaatgctgcatacaatatctcccctcttgggtggtcacagctaatattaatgattcttagaaacctgcttaaggaagtaagaagccttgcaaggctttgaaaattttgttaaacacagtatttcccagatggacctcataatcctttcctcatataatgtttttccacaatttctataagattctttcaatgtccataaaagccactttagaaaagtctaaattttctggttctattcgcagctacttacatatttcctgaaacttgtatccactgcttgttttttttcaatgtccaccagttattctatctggaagcagttcttagaatctgcttctagcaggcattctacttcccacctttaatcccagaagggattactcaactgctttgacaaaagagaaacccaggcttagaaggtgaagtcatttacccaaagataatgatttgaatccagattaaattggcttcagaacctatatttgtaactattagcctgtacttggtcttctctttctagttaaactgtcttccaaggaagagatgaagaaacaaattctcagctactttggcatatctgcaaaagcctgaaagctctgtcaaatattcagcacaataattctgcaacacttcagatggtcacctaaacctgccaatagatctgctttgaccagctactcaggttgagcagaaacttttaactctcaacctccaagataataaatgttaatgagatgataatttactcccttgaattgtcatttaaaacattctttgatcctcttcccttcatgggggaggggggaaccacatcccctttttttgaatctgggtaggtttacagtccaacagagtacaacagagatgatgctgtgagacatctgaggctattataaagaccatgtgacttctttattgttcactgtagcgcttgttcttgaaaccctgagctgccatataagaaattctactagccagaggcctccatactggaaggccatgtatagatgtgcctgttcacagtcccactggagtgtaccttccagctttcctcaggaaagaaacagaaactagaagaacccttcttggaccttacagattgaacatctgccagttgaataccaataaacaacctttgtcaacaatacatggaacagaagaatcacctatgcaagccccactcaagttctttacccataaagtcatgatataatgatacggttattgtaaaccctacaacgtgcttacaagtgtttgttgcctgaaacagacaagtgaaacaacaactctgcaaatacaattaaattatcagtaattccataatcttataattatagtttcttagtaaaaatattattttctttatgaatatgtaaattgactaagtgagtttcctaatgtgaaagagtctaaaagggaatctcaacatgctgactggtattttatgagtctacatttgaggaatgtctgtccattgccaatacaactttttaatatgacatgaagtggtgggaagacgatggactacaagtctgggttctggtcttacttctgccactttgtagctatgagacctttgctaaatcttttaacttctctaagccacagttttgtcatctacgaaataaaataatagtattctgtcctacttacctaacgtagtggtagaaaagatcagatgaaataatgagcatgaaaatggctttaaatgtaaagtacagtgcaagtgcatggacttagtattgtcacgtgatgttaaccactatgaaattttaacaatggtttccatgttgtcagattccatggccgcatctctgatctcaccttcttcatcccctgggtagcagcatttgccactggtgaccagtccctctctcagtagccttttcatacccttggcttcctttttttgttgttttttgtttgtttgttttttgagacggatctcgctctgtcacccaggctggagtgcagtggtgcaatctcagctcactgcaacctccatctctaggttcaagagattctcctgcctcggcctcccaagtagctgagattacaggcacatgccaacatgttcagctaatttttgtatttttaatagagacggggtttcaccacgttggccaggctggtctcgaactcctgacctcaggtgatctgccagtctcagcctcccaaagtgctgggattacaggcatgagccaccgtgcccggccatccttggtctccttgacacttggtttcttcccagctcagaggtcagtcctctgttttatttgcacacctgtcttcttctttcagatctgttaatactggaacaacccaatgcttggcccagtggccctccattcttctctgtctgtattctctcccctaagagatctcatccaggacaatgacattaaataacaatgatattctgataactctcagaagcatgcctcccactttggcttctccactgaactccagacttaagtatccaactgcatggacaacactgccacttggctgtctaaaaactatcttgtacttaaatgggaactactgattccctcctgctgctccaaatacactagtttcggttttcgccatctccataacttgaacttacagtcagggcccctgcatggtattgtgcaagttatgaagaatgcaacctacacagcattctacggcacccctgctttaattcatggaactgctcacaccaaaaccacaggtattattcctgagttctcttataacctgactgttgacataactctaaattctccaaacaactctgctgccatcccagttcaagctctcatcttcatcctgggccagtgcaacacttcacaaacaggcttcccgctgatacccctcgtccctcttaacatccattttccacccagcagtaagaataacttttattataaaaagagatcgtgcctttttcagtggctcgaaatcctccaatggtttcctggtacactcaaaataaaacccaagcttctcatcttggcctgcaagacctgtaacggcctggccccagccaactctgcagctgcaccccatggcactgtcccctcagtcactccattcatcctggccactttctgctccttgaatatgacacatcaccatatttttttataatacattccagagctagccaagaatggggggaaaaaataaaagtagtataccttcatgttactgaagttccttttgtatctatctcgtttctggaagagggaagttgccagtggagagacttccagacccatctgggccatgcactctgtttctctaaataagattaatatctgagggtcaaagtttacaaacaattcccctgtgcctggagccttcaccaataatgaagcctcaagacctacatgaatttcttcaatctgtgggaagaaaccaacatcattactatcagaaagttcaattcatgcagagtatctagctcagctatctctaggaataaggatcattaaatgttcttccatggatttgagcttcctaaattaagggcaataagatcactcactcttctcctaaatccagtctcatacaatagccttcaagttcttggtgttgatgttgggcagtcaattcaataaaacctttcaatgactctaacactgataaataagtggacactgcaacagtggtggcgtctcaaaagccatttagctacctgataccttcatgcctactctattattcttcctaataaaagtttcgtaagacctcctaaactcagtttttacttatctagaaaaacaatgaacacagctatggagacatcgcatcctgacagcctacaaagaaatacatgtattggtaggatatgctatgattaaccagttgtacaacaaaagaaaatttgaaactttgtttaacagatgtgctagtgtttactgacatatttaggatctgactgaattttaaaaagcaagatatcctaatagattgggcataggaaccaataaacaagatcttctcactttggagttcgtaaattaaataaaaatggggttctgttacctggcttgtggtttcttttcaaatctaataattatttttctttgtggacatattacactctgaacgcttagattcaacccatctgccttacaaaacacctacaaatccagctttctaaagaaataacactgtcaaatgctagaagaggggttcccatgattccaacaatgggaagagtataaatttagggactcacttgccgaagccacgccctgtggaagaggacctcaaactccaggaggaccttggccatcctgttgtaactgcgaattataggtttggcttctgccgtgcttagcacagctgggtgctgctggaaaagctgcatgggctgctgaatcctatggaagagctggcgggcccacaaaatctttccagcgatgggaggctggtttcgagccagaggaggatcgtatttctgctttgtatacagctttgaaatcatatcaatgtcagccccatagttctcaaggataagttgatatttgtcatcaataccaagattaggtatattcaatctgatttttttaaaaagttaaaagcttgaattaatggaataaaataaataaaatacacaataaaaatatctagtaatctcatttattaatatttattttttaaaatgctaatggaaaagaatgagatatttacatggaatattaaaagaataaaaataaaactcatccataaaatgtaggcaaaactattaacttgggaagacatttttcaaattatctatacattaggaaatattattataggcagtcacaaggtacttcaaagctaagagtattctctatttgtagaaataaaataaatcctgaatccttaaaaggattaatcctctgaaaaacttaaaaactatgaccttgtgacccaaattgccaagagaggttttcctttccatcagaatatgaaataataataataggaataacaacaataaaagctaaactatcccaattttagaaaatagacaatttcttgaaaattttacctttcaaatttcttcaacattcttagagcttgatttgtgttttgaatctttgcaaatgtaacatccatgaacttccgcaactcgttctaaaacagaataaaatctgatgatgaacaatagaattgggaatttactgtttagcaacaagataaaagagctttccattctgtgcaaacacatataacatggaacaaaatgtaaccgaaaattgaatgagcttaaaagaaaaataaatgcccagaagccagaaacaaagagagacttgaaagccagatcagccatgggagttggcgccacgtcaggttccacgggtactgggccagacacagagcctggggggtggcactggggccttatcgcaatatggggagatgggctatggggtcctaacattctcaacagagcctgtggaaagcagggatccttgaagtgctgcccagtacatgcaaagggaattgattcacaagttgggaaagctgcaaagaggcttgacatctgcccaaacccttgaataggaaaaaaagtcaccctacaatagggttcccatactttctcatcacagctactcacttctaccactgcaatgccaaagcacccatagacagtacacaaacaaatgggcagggcactgtctggctcttggacatagtttgctgacccctgccctagaggaactgaaatcccacatcggtgccacacctagataaggggtccaggtttaaactacacatgaaatgaaagggatataacccaagacattaacataaaagctagtctgggaaagtaaaaccactaggaccacagaattcaagaaaagccactctacagaaacacttccaaagcccagggccaaaagattcctataggaaaaaaaataaatacataacttctaaagaagctcaaaaagtttttgaaaacccatgagaaaatcatctttgagagagaaggagcagaatgcacaaacagaattagtaaccaagtactaaaaatgatagagcagtctaaaggagactatgaaataagtatatttaaagtgattaaagagtaaagaagaaacagaaatcataaaaagaacagaactgaataaaacaagaacactcagatttttaaaaataaaatttagacgtataaaggggaacataattacaattcaaaatacaatagatgcaaattataaacacctgaaaagaaaactgatgaactacaagacagttttcaaataaaatcacccaaagtatagcagagaaataaagaaatggaaaaatacaaaaaaagatgttaacaaacatggaagatagaaaaataaggtgtaacatatgtctattggaaatcttggaagaagaacctaagatatttaaaatgagaaaggctgagaattttccacaattaaaaaaagacttagtcctcaaatggaagaagcacatcaaattctgaacaagagaaatatgttttaatcacacccaaaactcacagaaagatgccaaaggtaaagagaaaaacaatattaaaagaaaaataatagtaatattaatattaaaagatagaaatattaaaatcacaaaagggagaaatcaaatttatctataaagaaataactatttgatagcaaatacctcgtggagaacaatagccgacaaaaatcagtgaataaagatcttctaagggctgacggaaaataacacccaaactaaaatcacatataaaacgagaataatattcaagattgagggcaactttataggcatttgggtgtaaagactggatgagtttaccattaacagactcttgttaaaataaaactaaaggatatacttctttaagaatgataatgaacccaaaaagagggagagatacgattactaacaagatgcaagaataagcaaagcaaactgtaaacatgttgctaaatttaaataactattagtaataacaagtttgaaaagtttagcagcaaaggtaaaactaaaattcaagacaaccatagcatgaatgagaggtaggctgataaaacagttaaactctttaaagtcaggtatatatgctaaaaccactaaaaatataaatacaatattaaaaatataaatagaagaggaataaagagaataacaaaatttaatcaacaaaatataaaaaggaaaaagtcaaagaaaaaaagttcacctcacttaaaattcaaaatagattgtagaagtaactctatactaaaaacaacaatcaatgtaaatggcttaaacttgcaattaaaggaaagagagtctcagctgttttttatatatacatatatgttatatagagagatatggattatatttttatgtagattgtacatggatattatatataaattatagatatatatattatagatatatggattttatatatatgtggattatatatgtgcatgtgaattatatataaggatattatatataaattatagatatattgattttatatatatggattctatgtatgtggattatgtgtgtgtgtgtgtttgtattatacgtatataatccaaccattgctcttttaaagagatatgtttaaaatataataattaagaaatagtaggccaagtacagtggctcacacctttaatcccagaacattgggaggccaaggttggcagatcccttgaccccagaagtttgaaaccagcctgggcaacatggcaaaaccctgactcttcaaaaaatacaaaaattagctgggcatggtggcatgcacctgtagtctcaactactcgggaggctgaggtgggatgatcatttgagcccagcagatcgaggctgctgtgagccaagatcgcaccactgcactccagcctgggtgacagagcaagaccctgtttcaaaaaagaaaagaaaatgaaagaaagaaagaaatagtaggaagtaaaagaacagaaaaaaatgtttatttcaggtaaataataaccaaaagaaagtcgaagtagcaatataaataattcacaaaattgattgtaaggcaaagagcctcattgaagataaatatggtcataatttagcattaaagggaacaatttctttggcagatatgccaatttcgagtctgtgtttaaccaattgaatcaaaatatatacacagatttttagaaacccatggatcaagcatgctatggtttaaatgtcctctccaaaactcctgttgaaatttaattgccattgtgatgatattaagaggtggcaccactaagaggttattaggccctgagggttctgctcccatcggtggattaatgttatcgcaggagtgggttgttataaaaaacgagctcagccctctcttgctttctcaagctctcttgctcttcagccttctgccatgcagcaagaaggccctcatcagataccggctcctcaaccttggacttctcagtctccagaactgtaagaaataaatttcttttttttataaatcagccagtctgcagttatgttatagcaacacaaaaagaactcagacaaagaagatcaaaaaacattcagtataccactacaaatattagaatggtcaaaatctagaatgctggaaacaccaaatgctggtgaggatgtggagcaacaagaactctactctaattcattgccagtgggaatgcaaaatggtatggccatgttggaagacagtttgatggattcttataaaactaaaaacactcatactatatgatccagcaatcatacttcttggtactcaatcaaagaagttaaaaacttatatccacagaaaaatctacacaccgatgtttatagcagctttattcatagttgtcaaaacttggaagtaaccaagatatctttcaatgtgtgactggataaattgtggtacatcacaactgaataatggaatgttattcagtgctaaaaagaaatgagctatcaagccatgaaaaggcatgaagaaaatataaacgcatatcactaactaaaagaagccagtctaaaagggcatattctgtatgcttccgactagatggaaaaggcaaaactacatagacagtaaaaagatagtagttaccgggagagggaaggatgaataggtggagcacaggggacttttcggtaggaaaacactttgcctgatattaccacggtcgatgcatatccttgtatctttgtccaaacccatagaatgtataacaccaagagtgagccctaatgtaaactgtggactttagatggtaatgatgtgtcaatttaggctcatcgattgtaacaaatgtaccaccctatcaggggatgttcataatgggggaggctatgcattctgggggagagtagggggaatatagtaaatctctgtacttcctctcaattttgctgtgaatctacaacttctctttaaaaagtcatttttaaaaaatatttaatgaggtgtaaaatatttgaataacccaattaaaagtgtgatatagtgacatcaaaagaccccaaatccagacagaaaacactactcttttcaagtacacatggaacatctacaaatcttaactacgaactaggccacggaggacatctcagtaaataccaaaatactgacataaagtattccatgttctcacatcaaaatataataatttaagccaaaataaaatgagagccaatagagtacaataaaaaagctaaaaatgctttcaaataatccatgagtaaaataacaaatcataacaaacattacgtgatactttaaactcaacaacaacatatgtactacatattaaaatttgtaagaaacagcaatagtgacccttcgtggaaaagatatagactttcatgcacctattttaaagagaaaaagaaaagaaatggaaattaatgagctaagctgtcagttgaagaaaggtaaaaataacagaataaattccaaagaaagaagaaaaaaatgttttaaaacaaaatgcaataaaattaaaaacaaagaagtaagagacaagattaacatctccaaagctgctctttgggaaaaataataatacagactaacctttggcaaaattaaccaagggcagtggggtgaacgcaagttcacaccgagagcatctgtcaaattagaatctagcagaacgaggccaggcacggtggctcacgactgtaatcccagcactttgggaggccaaggcaggtggatcacttaaggtcaggagttcgagaccagtctggccaacatgctgaaaccccatctgtactaaaaatacaaaaattagccgggtgtggtggagcgtgcctgtaatcccagctactcaggaggctgaggcaggagaatcgcttgaacccgggaggcagaggttgcagtgagccgagatcgtgccactgcactccagcctgggcaagagtgaaactctgtccccccgccaccccccaaaaaaagaacctgggggagagaagggggaatatggtaatgatattaatcaaagaataaaaattgttctaaaagcattaaaggtgaaacgtgttgtaaaaagaatgacttaaatatcaaagattttaaaaatccttttcatgaacccctcaaatatgttttccaaaatggtctttatgggttctcctgagaacgtcacacatcttatactattatgtaactatgaccctccccccaaaaaaattgcaccaaaaaactaagcacaatttattctttgtgcatcctaagctttagtgcagagctataattaaaatctaaattcagttaaacaaaacatagaaaaattatttccttattttatatttcatgcttcaagacaaagtgaacaactttttttcaacttaccagtcagaagttttaattaagtctttgcaaacttgaagagacattaattgatgtagtattaaattgaggagactagtttgatatgcgataagaattagtacctaaatgggtttgatttcagataatgttaggtcagaagtaatatggtaagaaaaccagttggcaatatccagaccaccacaggagatacgacctgtggaggagatggagctattggcagggtgggggatgggtaagccgcaaacctcctgcctgatccagcaaagctccaaaactgaaggagctggaagcctattacaatacttccttgccctcaatagtttcagctacttctactggaagtatatgtattttttaagtgacattatttctcctgctaagtccacatcctaggatgaaaaaatgttcctgcattaaaaaacagtacagttagcctacctaaataaacatctacattttttcactacataaaaaatctctatgtataaattatgcaaaactagagcatttataacccttccactgcctccctctccttcagacaccagcaaatctctactgagccctaacacttttacctggttttccttgcctttctaccctatggcttcgcaaaggcctgggctgaactctctgtcaacatgtaagacctagacttttcttgttctgagccttggtccatccttacagtttgtggggtctgggttgtggaatcttcatactcgtcttcacattagttttggggtctcagctcctactcagttttcctttaactcagcttgccacctcaacacccatcctttactaagtagtgccttctccatctgctgggatcagcatgcttctagacttccaacagcccacttggttccaacatgctgccctctttgacctgttagtaccagcacgaaccctaaatctggagaggattccaggctctgatccctttgacaccaccctgatccaaatcactcatgaagactttcacttgagattccactgttgctgagtctctccaagactcctggacgcatcaccgcccttactccattcagagtcgtgggaaggtatttttgccccagttttataaagatgagggctgaattcatgagtgggtgagtatttaaaggacagactgcagaacaattagttaagagaaagagaatggacaaaggaataaagaagtgtaagtcaaagaaaaactcattggcaaaccaaagacagaagtgaacaatttctgacatggaagacaagatggataatagtgttgactttcttttaagaaggctgagtagaatgggaactaatacagtagtcccctcttatcctcaggaatatgttccaaaatccccggtgggtgactgaaaccaaaccttatatatactatgtttttgcctgtacatacatacaaacataataatgtttaatttacaaaataggcagagtaagagatgagcagcaataataataaaatagtacaatttttaacaatatactgtaataaaagttatgtgaatgtggcccctctctctctcaaaatattttattgtactatactcacctattttcagaccacagttgaccctgggtaattgaaaccatgaaaaatataaccacacaaacatctttctagcatcaaccacagcctcctctctgaagcctttcctaaccccagccaagcagaagtatcagattatctttccctaggttcacatgatcagattctacgtaatgttttccaggcctgatctccctatacatttttgtaggccttgagctatgtctctttatttttgaatcctcactttttcatatagtatcagagtagtattctttcctaagtagccattttaactccatttgcccttttttaaatgctaaattcattactctgttctaatgtatgtgcttatattttcatcatttcaccatctgcctcctatctgactatgagctgcgagggcatatctacttgatttatttctgtattcataacctacagcatagaagtctaatacataattgctgtatagcaaacgtttgtttcattgcaataaatctacatcttcttattaacatatgggaataaaacatgatccctgcatttgaggtgctcaccatctatattccacatataagctacagaagtaccatgtggtcagacactgctgaggaaacacaggtgaacatcagaatctgccattactcatcaatttccaacaaaaagagaccaacattcactgtccttatgtctgaatctgcccccaaaagaaatcattgcttaaattattataggtactctctcttcccatcaaatgaagcctgctgcatgccacaatggttaaaaaagttgaattccaaagccagactgcctggctttcaccccaactccaccccttgttatgcctgtgactttaggcaagccacttcccctcacagtgaagtttcccagtttcctcctctgcaaaatgagagtaacaagagcacccactttataggattattacgattattaaatgaattagcacatacaaagtgcttagaacagtgcctggcacatagaatgagctagctttgttatgactcattctaacactgaactcgctcctcccaaggtgtctcagagctccttttactttgaagtgcacaaatttaatgcaaatcaaaaaccctgggaaagaagaaatagagtggctattttcctcttatagtcagaaagatagacatttgcacctcactgggatgagaaaatgtccccatattcattatggtagatacctgctgggtgtcttcccatcttaccctccctgactcccctttcctgataataaacattccccgtgacccagtggatcccatcccgcctgtgtccaccacaggatctcacagttgagaggcccagtactaggcacctcaccagaactggctagcccaaccccttcctcgggaatctggagctggcctggtcctgtgaaacagtctcagaagctgctaatggcataaactgctcatgtgagctgcaaggcaagatggctggtctgcagtgagcaggtgaaagaaggaagagaaaggggttgcaagtccaagcggggtccaggtgctgagtcggtcctggcgccaccgtttctaaggccagtggcagccctgccttggaatctgccagacattgctgaccatttgcctgagctacctctggtcataatcattgctacacagtgacaaacggaaataagagtctacattccaatcgtgccgcaatgttcaacagaagatgaaagttaactttctaagaacgtcaatggaagacatgtggaagtctgatacacatcattagccaaagctatatttatgaccctttaatccatgaaaaacagccttcaattattaatctgaaatcacgaaacacaggctgaggttgctatcggtcacctccatgatgaagatacctctgccttctgattgggtaatgattaacggcattatacagaaaggaaaaaataaacacacgactgtcaacaggaattttattatacaacctacatgaaggtcattagtctgcttgcaaaactcttcgtaatcttggtcaaaatccattttccgctggtctaggaaattgtattcctttttctttatggttgccacaatgccctgaaatattatgagataaattagataatatttcaatattcttatattacctaactaaatatgacccttaaatgtagagcctatacaataattgccagaaaaaaaataagtttaaaggaagccttatttttttactcacattgttttgtgcttattattttacaggcagtataaggttgccctactgcattcaaagaaatcacttggaaagtattttcatgatgttttatgtatttttgaaaaaatgaaataaaaaccacacctgaaaattgggaaagattttttccactaaaattttattgttaatcatatctgaaataatttttaaagcccagagtagaatttactaaaatattctgtgttgaatagtttaaatcttctcagaaaataaataaggctttcacagaacacaaacaatataggaagaaaataaatgatgttatatctacagatgagttactaccttccaagcttcaaacatcttaaaaatgtcagaccagaatccaccacttaaaacctttctaaaattaattgtttcctactgccctgcaaagctgcagcctgtgactaggaaagtacaaactaggaagttcatctccttgaaaatactattatcagaagctttgtttgctttcaataatgagctataatgctctgcgattcttcttaaccaggtactaagccattctcaaactcaggtgcccacactgttgacagaagcatataatttttatgaagaatattgggcctccttcttctacaatctcctcttcaaagtcacttccatttaaacatcaaatctctcaatagacaaaagtgtataaacagcataacttcttgaatcaagtttactagataaaacaacctactttttcatgctgcataactacaaaattagttctatttagaaattgtgtgtgtatgtatatatatatatacttttttatataacgtgtgtgtatgcatggaatgttatataaaatatatacacacacacactatatatatgcatggaatgatacaatgtctaggatttacagtgctgatatcccttaaaatcaaaagaatcaaaagtatgtgtgtgtatgtatatatacacatatatacatacacatgtagcttttccatacttcttttagacattttatgtaacactatatacatatatacacacacatatatagtgttatataaattgtctaaaacaagtatggaaaagctactacattttgatgtagtaattttaaagatttgggaacttgagaaaatcctgctctatgactggatttaatggtcacttaagattattaagttaaataaaggaaatgattaatcgtgacctttacatcaactactcaaactcaatctacttaattattttcttgacagatatttattgcacatctactatgtgccagtaaacttaaaatgtttcctgctatataaaggtattttctttatctctcccaaaacttggtatactcaggaaatgaaaaagattccttatattgggctaaattgttagagtacaaaaattagtgtgtagtggttaattatatgatccttttcaaattcaagtaccaaaaaaaatttaagatttagtgtcactgtcccccaaaaaagaaaaaaattgactatgtccatattaagaatttaaagcaaattgtttgtaaattgtttttctaaaatcttcgaaatgttattaggtcactatgcccactttcaaaactaaaattagtcacacagataccatgacaagataaagcagttaaaaatcaaaataattagggaaatcacatctagaataaaatcaggtcctttatattttttaatatgggtccaaataaaatgcttaaatgcagagataattgagtgccacaaagtacctggtgtcaactagtgcctgatacagtatactcttcattaaatatttcttgcaagaataaataaaacaataagttacaattaaacatttttcttgtgctactaatgaaaatgcttttttaatggtgattaattttagactattggaaagtcattcttataaccacacacctgaaaagaacatattagcaccattacacaattctcaaacaaatctaatttctttattgttaaaaggccatgagattatttatattttactttacagactgatgatttgaatcattctaaacactgttatttgcataaaatattgaagtttagttgtggattatgttataaaatatagctttaaagtacaatacctggtatttagtggccatgtcttccagcccttcaattgtggaatcttgcaggactgaatacgtcttgagggttgtaaagatgtctattatcttggcaaggcgtcggtgaaaagtttcgaattttccaaaaatatacatctcgctaaaatcaaattgttttgcatttggattttgtttaagcttttgttttgtcttgtgaaagcagagctggtattccttaaaatcaaaagaaaaatatacaacaaagggaacaagaaaggtatcaactttattttcttaagtgaaggcgacagcaaaattaggatggaattgtaagccttttcatagtttcatgcctttgcttgtactcactcatcagcctggaaaatcatcttttcacctcctctaatctagcaattctagattctaatcgggttactcacgatgcaactcaaaggtgtggctttcccatcttggtcccatggttttggtaatagcatccttctatgactctctctccattcatcttaaagatgcttaaggaaaactacctcatattagctgtctttgtatctctagtacttactgtgatatcaggacatagtaggctcccaaggagggtacaaaaaggtgaataaatttcctgggaaggtatattaacattccattttcttcatagttaagaatcactgttctttttatcaaccaatgatataataattacaaaatgatttaagatggtctcaacaaaaataagataaaaagaatagaacatctaaatactaaactgaccattacctgtttcagtttaatcgcagatagtattttttcttcaacaacatcctgtggctggttccagatggaagcggttccattattggtaatataggctttacatgcagatataatctgatttgtcacctgggattttccaataaaatgatgttaagcacataaaacagccatggattgtaaactggactagaaggtccttaactcttctacttctcagagttcacaatcttctaacttgagcttgggtttattttttttccatcacagttataatccaccaataaccctttgatattgtcaaaatcatttgtgaaatcacagagttggaagcaccatggaaaatcgacaatttaggccaccttgtctatgcaggatgaatgtcttaacaaaacaaggaaggattcatttccttccctgaaaactgatgagtttccccaaatctccttaggtagcctgctctaatatctaactcacagtttactagcaccatgtaaagtactgccgatcctgatcttttcatgtgaccatgatcagcaatggaaatgtcaaaaggagaaggccgcagagagaaggaaaactaatgtacaaaaccactaacattttattcatctctccaaacttcacaaaaatcctcagaaatgtattaattttttggataaagcataaggaaaattaaatgactatgctgtatccatggaaagatatgatgcccaggatttacagtgcaaggggtgggggtataggtgaaacaagatcagccatgcgtggatatctgctgaatctaggtgatatgtacatggcattccagtatacgattctctccttttgtacctaattcaacatttccataatgaaaggttttttacaattagataaatggtggtttcattattttatgctaaatcaagttttgcaaataatatgcataaaatcttaattaataacacacatttacttgtgggtgtcatttacccagggaatactctcgcaaccctaacatataattttaacgtataaggaagttgggagggaatcttgcagccatccctcctgtctacctgaactacctacatgacagaaggaaaacgtttcctattgagctcttaaggctggatgtctttattcccaggaagaattgtgcttcctactgcgttagtattcagaacacgagtcttgattcatcaaaaattcttctattttaatataacacttaagatttttgctttgataatgaaaaagtcatttacttcttagagactgttcaaaatgagaatagcaacagtgcttaccataaacacttacgagttaggacataaggtttaagcatcgttatgttttttggcagaatcattataattgctttatagattactagaacattgcaagtggcttttattaccatgattactgttctaataacaccaagtaaacaactgtggcatcaaataaatttggaacagtggcatatgaaatatgaaacaggagatagccagttaaatatagcttttcttaattaaaatttacccagtaggaatacatgatgtgctaaaccacataggaaagaaattccaagagcaatcttttttcatttgtattatataaataataaaatatttattataataattactttgggaaataatgctttatgatttgctagaatcagcctctgacatcaatttaattctatctctattgatagcctaagcctttttaaaattttaagatacatacatattgaactgagccaatgtggtaatttttaattatcaaaaaattgatcactggcaaagaaatacaaatgaacatggactctacatcatgcacttacctttacaaacagagatgtgatcttctcagaggtattatagtaatgagagatactatagatcattttaattgcatttataagtgtaggaatagcatccatcatggatagctgaaagatatcaccaaagttttcagaaaaaatcatcaaattcagcaaaattctaatagactaaccattccatctgcattaaaataaagtttaagagctttctattaaagatttaaaaatactatttaatgctttacatgaaaataatatatttaatattaattttattagtcacatatggttaatcaaattttatttcagtggaagaaacattgacccactgttaatgacaagcaacagcaagttaactgttaactattattaaggataaactgttaataacagttaatgttgtactaagtaaaagcaggcacttccgaaagctaaaagattaaaaaaaaacatcactagctaatgacttttcccacagttctttggggtatatagttcagaatgtcctttgcaatatttaatggaaaatgtaacatgcaataaatgttttaaaatataacatctcatatacatcttcaatagataggaggtagactgcttagagaaatagatatagaaatacagatatttgtgcgtctgcgtgtatatacctatatatatgtaattttcttgaaaataaagtttctaagacctttccaatgaactgtaatattgatgaaacaaaattcaatattcaattcagctagtgcaaaaagggttatctatagactgaaagagtagaaatccttaactcacgggatcactgctgtacaaagggtcacaacatttttcaagtgtatacaagtatttcacattgtcctttgcttcattagttgcatcagtgattcgaatatccatctcccgccaagtctaagcacaatagggaaaagcaattttaatgtaattattaatagaggaacttccaacacaaccactgctaagagtcaccacaagtccattaggcgagaccttctgtccatctcacagaaaactgaatccagaggggcgagagatattgctatgctggaaagcaatttaaaatttttgactcaatgttttaaagcatatcttccagggcttctcatataaaatctatgctatgactatcacagagcaccaggagggcagcaccgccctttaaactcacacgttctcccctgcactggttagcagacccatttgataccacacttccatattttctatctttcctctattctaacctgaactcccttcctatatccctatacatttatccattaatgtagtaattgtttattatctgccaactgtatgccagtactgtgctatgagctaggaacttagaaatggaaagataatctaaaagtgagagaagtaaaaggaaattatttagcacgtcagtacattccattgacttcacggaagtctgactgatagtatttctgaactgtattgcaaggctcacctctgctatttctttgaggaataatagaaggtaaatctatagcacgtttattgcaacaaattattacgtatcaaaacatgcaaatagctaataacacccatgcaaatagttaacaaacagtctttccagcaccagtgccaggtgagttaggcagcctctatgacggtccccagtgaccacagactccctgtattcaagctcttgtattcatcccttctccttgatcatgggctgaatctagtgacttgcttctaataaggagaatatggctaaagtgatgggatgtcacttccagaattaatttacataaagactgtggcttctaggttggggactctcttgccctccttcacttgctccctttaagggaagccagctgctatgttctaagctgctctacagagaggcccatgtgggaaggaactgaaggaagcctctagccaacagccagcaagaaactgaatccagcaacaaccagatgagtaaactcagaagcagatcttccccgcgttgagccctaagatgaacccacatcacagctgtagcctcatgagatacccagagtcagaggcacccagctaagctgcacccagattcctggcccatagagtgtgagattgaaatattggctgtttttgttttttgttttttattttggcagagtctcactctgtcacccaggctggagcgcagtggcacgacctcggctcactgcaaacctccacctcccgggttcaagcgattcttctgcctcagcctcccaagtagctgggactacaggcacacgacactatgcccagctaatttttgtgctttttaagagatggggtttcaccatattggccaggctggtctcaaactcctgaccttgtgatccacctgcctcggcatcccaaagtgctgggattacaggcgtgagccaccacgcctggcctattgactgttttaagctgctaagtttggaggttgttttgcaatataaaactaatatacaaggactaaaaaataaatacagatagggtgagttttcattattattatttctagctggtctgaaatcataaaacatagatatatatataaacatgctatcatgttctgtcttaattacatacaatgccaataacacatatacatacacgtacaccagctaacaattgcctttcattcaaagactatttccgcagcctccaaagtgatgtgagggaagtattatgtaattttaaatgtttttcatcaaggtataataacatttttttgttcctaatcactctatgccttgaaaatatgcatagagaactcttattcccatttcacaaggcaaaatgaaatggctgacgaccttcagcagtttcgacttggccgccgcaagcactgccagcacagccttcacatccgggcttttcaattgttccaaaaggtagttaaacttggagagtctttttttccagtgctccagctccgctcgtggcccaacgtcatccgcttccttcagcagctgattgttttcagcaagaacctgcaaatgcgcggggaaaaacacgagccattgcacggggctggagacgctaaagttataaacaagcaaaaaacaaataaggaaatcaattatcctatctggatcatgatatatgcgtattccatgcttccaataacaatcttttactcacttagcatgcatccatttttaaaacttcaacgaaaatctctttgaattgttttaactgaaaacaacttatgctttcctcttttgaaaatagtttatattttggggggtttttaaagatttttgattcatacttttttcttttattgatacttattttacatatttatggggtacatgtgagtatttgttatatatgtagaatgtgtcatgaccaggtcagagtatttggggtatcatcaccttgagtacttatcatttctacgtgtgggtaacatttcaagtcctctcttctaggtattagattggtgcaaaagtaattagccattgaaagtaatggcaaaaaccacaattacttttgcaccaacctaacagtttgaaatatacagtatactgttgctaactacggtcacccaatctgcaatcaaaaactacctatttaatgagctgtaatgagcttctgaaggccatgacctcaggaatttttcttggctattcatttactctataaccttggaggaacatggccttgttaaattgcatggctcaggctagtggattttaattgtgcttactttgtaatgtaatgtccaccttcatgccttcattgaggacttttctgaatttgtgtttaaggtgaagtctcaagctcccttttggaggacatactaaattagaaaactcctcatgcttctacaggggttctctccaaagtaaattagacattgagaaaagaaactggcaaagtgcagcgtttgagtgatataagtatatgcagccattttctttcatttcttagaattcttactacctcttcttaattcatgacagtaaaggaaaaccacattggacctctcacctcctcaaggatttacagtaaaacgcttaacaaatggaatgtcgtatgtcaatacaccttcttccattgtctagcgcagtaatgtggcacctgaaattgatgtttggtttctcaaaattacctgttctgtctgtttgatccatactttcatgcaatcctctatttttcccaaagtctcagggttatttgctagagtcaagtagtccgtaggttcctttagggttttcagttcaagtatgtcacactttcgaaggttcacctaattagaatgaaaattaaataatcagatgatgcttttgtaaaacacacagactgtgggccctgtgttttccactttgctgcactctgacagcgctctggaaagcccaccaggtagcacatacctcctctccactcccacgtgcctttgtccacgctgcccccagactgatgggaccttccaacacttccctgtgatcctacacaacctcacaattcaacccaaagcccactgccctctcccactcagaaagaatgcctcctcccacctggggacccatcccattttggtaatacttttattgcaatatgaagtggacccatatgaaaaaaacactgcttttttagatagaatgccagcaattttatttttttagtagtaaaaatgtttgctttattcatgtatacatatgtaacaaacctgcacgttgtgcacatgtaccctaaaacttaacgtataataataataaaattaaaaaaaattttcaacatgtagaatgccaacaattttatttggtccaacctgcaatttggtctgccctccatcacagtcaatcacaaatataatttgggtgttagctggagtcatcctgtgtctgtctggataaaatttgcttaactcccccattccacatcctttggaaagcgtaatgccccttccccaatcccagcaggatcagcattcctgggagaggagggcagagtgtcacactgtcatcattaccataggatccatttccctacctgcccctacatgcctgatctgggctctgtcatctctcttattaccttatcttctctctctctccctctctctctgtctctctctctctctctctctcttgctctatctctctctcacacacacacacacacacacacacacacacacacacacacacaagcgtacatccatcaacctctgccccaagtaatcacaaacacagacttattataaacagcacaaatcatacagaaactaaatgtcacctttgccaaaattattcttaaaggcccttttgatcattggctgaatcacaggatcagacttgctctctccaaacatatcaattcctctttccttcttctgcttcttcaggatctcttcccacctccatctgccgcccacacacacccccccacacacacacacacttcagttccaaattcctttcattctaggatgcacagcagtgccacaagcatttctgactcttgcctttggagtcactcatctgactgactgagtaaagccctacaacactgccaacgtttttatggaacccctgaatgtgttgatcattacaaactgtagaaatttaaatctaatcaccaccacatcttgaaggagcaataaaattgcctacaaaaatttttgaagaactgaaacatagaggaattaagaccatctaagagaagcattacacacttatgtactgtgcttgttgaccacctgatcatttttaaaggaacagcttattcgtcctcaccttctccttcagactctcctgtgcacccgacaggacgttcacaaagccttccagggagctcaagaactcctggcgaatgttagctgcgtcctgaaggccctcgagctcgccccagccatggctcgtggctctgagagcaggaatgaagatgtccgacagcaaacgtctcacactgttgagcaggcctccatctgccgcatctaacatgttaaaactcacctcctggaaaacaggcaggagatcttttattgtaaaaatcatcctcaaatgcaacacaactactaagtcatttcttaaatgttgtcactttaccaaatacccagtaaattattagtttgtgccaggtgtggtggctcacacctgtaatcccagcactttgggaggctgaggtggggggatcacttgaggtcaggtgttcgagaccagcctgggcaacatggtgaaaccccatctctactaaacatacaaaaattaggctggtgtggtggcaggcacctgtaatcccagctactcaggaggctgaggcaggagaaatcgcttgaatccaggaggcagaggctgcagtgagccaagatggcgccactgcactccaacctgggtgacagagcaagaccctgtctcaaaaaaaaaaaaaaaaaaaaatcagtttgacaacctggttaagaaataagctttacactattctaaattgtaatcatcaaaataaaagcatgaaataaatagaataccagatgtttaccagtttatttgctccaagaagatagtgcacctgtcagagggaaggggaaaacttgtacagatgcattttactttgcacaaaaaaaaaaaagttatatatccactttcagaaatcttatcttaaatgtataaaatttgccattaagtaaattatgcatggggaattcattagaaaaagaaagccctcactgttatacacacacccagaaggttatatcaatttgtgttaataaattgaatattaagtcctcttactcaaaagatttaaagggaatgtcctcttaatttcttgctttaaatttttaaaaaatacttctctgaaagtagttttagatactgtagtgaatacaatgattgtctccaccagaggaatatttgtgtgcaagttgtgtgttttttggtaattcagagtaaacaatggctcttgccccttacctggtggatgttgtcaggggtgatggctttggaagggtcagtcctgatgaagaacacacataccccagtaagagccacatcgtttccctcggtcacgaacaccttaggttttttaatctttccagaaacaagatttacccctcctagagagccaagttgtcctacaaaagcaaaataattttagtttcacaaatgctttttgcagtccatgtggttccctttggaatgaagtttccttgttaaaatattgccattgttgacttgtccatgtgccttagatgggtccacctcttgaacaatctctagcatgagccgtacagggatcttaaaaaatctgtttgattccagatcataggttcacttcaaaactgttgtttcaggggcagtgaaaagagggaaggaggacaatgtatctactggcatgtactgtgttccagaccctctgctaggtaccctgtgtacattattaaaactcacaacccggctgggtgcggtggctcacgcctataatcccagcactttgagaggccgaggcgggcagatcacctgaggtcaggagttcgagaccagcctggtcaacgtgatgaaaccctgtctctactaaaaaaaaacaaaaattagctgggcgtggtcgtgggcacctgtaatcccagctacttgggaggctgaggcaggagaatcacttgaacccaggaggcggaggttgcagtgggcagagatcacaccactgcacttcagcctgggcaacagagcgaaactcagtctgaaaaacaaaaacaactctgaggcagctgtgacatgttccaagtcaaacagccaataggtggcagagccaaggtcgaaaaccagctctgactacaaaactcggaacccccacttccccatgctgtccctactctgtcatagtcagcatacctggttatatttcaaatactgctgcagtcagggtcttgtagaggtaggaccacttaatgattaacaatgtgggctctagagtcagattctcagaacttcaatctcaggctgcactcccagccacgtgaccttggcaagttactttatctttctgtgcctccattttctcatattcacatcttaaaaatgagaataatatggccgggcgtggtggctcatgcttgtaatcccagcaccttgggaggccgaggcgggtgaatcacctaaggtcgggagttcgagaccagcctgatcaacatggagaaaccccgtctctaccaaaaatacaaaattagccaggcgtggtggcacatgcctgtaatcccagctactcaggaggctgaggcaggagaatcgcttgaacccaggagatggaggttgtggtcagccaagatcacaccattgcactctaggctgagcaacaagagcaaaactccgtctcaaaaaaaaaaaaaaaagaatgatactagaacttagcatctgaaattgttgtgaaaatcaacacactgtgtaaagtccttagaaaagcacataagaatactagcctctgtaagcattattattatcagtacttgaacagtcatctttgattatccaagcatgtggctcattgagtagataatttaagtacatagaatacactctgagctgtttcattgtgttcttacctgcccaagaaatgtttagatctccaaatggaccggtagctcaatcaggatcactgcagtgggaggatggcgctaatggtggactttgggatggggagtggaccagaagttgaatcctaaaatcctgggattggaacctcttggagtaatcctccctcagggatcttcctcccatggtgctaggctagagaccttgactgtggcttggacagtgaaccctcattaaaggtaactagaagatcaatctccccctcattcaaaattgcatcccgctcctggctaatatcacctgggtctcatgagtaataagatgttaggcaacaagtttcaaccaaggcaccaacgcatgatagacatcagaaaacagaatttcaaaggaaaaaaaaatctgcagaaatttcaaagctgttgtcctagaactgattagacatcttctccctggcccccatcagaatgcaaaagggtcaagagcgtgtagactaaggaaggattttgtgaggacagttatgctaagtattagtccattttcatgctgctgatggagacatacctgagactgggcaacttacaaaagaaagaggtttgattggccttacagttccacgtggctggggaagcctcacaatcatagcagaaggcaaggaggagcaagtcacgtcttacatgaatggcagcaggcaaagagaggataagacccaaggaaaacagatttccccttatcaaaccatcagatctcatgagacctattcactatcaccagaacagcacaggaaagacccgcctccataagtcaatcacctcccaccaggttcctaccaagacacgtgataattgtgggagttacaattcaagatgagatttgggtggcgacacagagccaaaccatatcatgctatgcaaacggtgaggttataaagtgttcctacttttacctcaggtcaagaatgagactgcaactgtcccagcttgcccaggacaggggggtttgctgggatgcaggactttcagtgctacaaccaggacagtcagtcactccagtcaataaacaaggtcttcaacccaaccacctaaagagcttgatttatgtctcctggagtttaggaacaaaatgactgggatatgacacctgaccaagaaatctaagcacagtgctcaataaggcagatagagagaaactggactgcacggggagctaacagcaccaccatggagggcagggacctaggaacccaggtggggcccctgctgaaaagagccagactggagccaccttaaatcctactcaaaaggagcacctgagggaggatgggacagagtgagcgagactggtggcttagactaccaaatttcagaggccatcatcaggacagcctgtcacctcgggagaaaccaccaccgtgcccacaagagcaaggtaagagtgcaaggtcagcagctcatgacagcgctagtccagtaaaaattttcctgcccctcttccctcttacctctgccctgcctctggcctcacacagtcagccactttagttaagctgatgtggacaaggggtagaagacgaaggtagggagaaaagcacatggtcctccctcttctcctactgagaagttcaaccttcagagaaatgggaggttcaaggatgaggagggaagaatatttcgctttccatcaactggacagttttgctttttgagttaaggttgtgtttgtaatttgaaatgactatagaattttttgtaatctaagaacatccaggaaagtcacaggattgcttgcattctaatccaagttcagaaggactatcaccagtgagaagatttaaaggttaaacttggttttatgtttacatcctacgaacacttcttggtccaagtaaaatttacgcagaaggccagtttcatccagtgctccgttcatggataaacttgatctttcatttgagcttatgttttgcaatctggtgtagaaaccaaaccttctatctcttgatttttcacttaaaatgtaataagctttctaagcacaaaatatcaaattgacagctttgagaaaatgccagttcgaatttgcatgcataatttcttcagtttttaaacaaagaagtatagtcttactatatgccaagagcaatagctattttcccttttatcaaatgggtcataaaaaggatgtatataatattttaatatattaaataatacatttaatcagatattgacttatcttcctacttaggcctttaaaattacattaatccacttaaaagtagaatagactatgccagttgaatctatagaaagatttgcaaatttgggccaggcacggtggctcacgcctatatcccagcactttgggaggccgaggtgggtggatcacaaggtcgagagatcgagaccatcctagccaacatgctgaaaccccgtctctactgaaaatacaaaaattagttgggcgtggtggcgcgcacctgtagtcccagctacaggctgggactgtactttgggaggctgaggcaggagaattgcttgaaccccgggaggtagaggttgcggggagccaagattgtgccactgcactccagtctggtgacagagcgagactctgtctcaaaaaataataataataaataacaacaacaaaaaaaagatttgcaaatttttcataaatgagaatgatgaaacctgtcatccaatattatttatttaaagcagagtcagtagaaaattaacacaatgtgatagctaactaaaaaggggtgttacacatgctggcaataattcctatgttaaaaagaaataatgcctatatacatgtgaaacaggtgcccattataagttctagaacataaaacacagaatgaactagaatataagaaaaggaagtcaaacgtaatctactttattatcttcattgccagcacagcctgagaaggaatatgagacaactccaataaagttagaacaaccaggctaaataccaactgtaatctgtcctccatccttgaggtgaaacagaacttcttccacagggccacaccctacacactaatggtttcccacatggacccacacacgcatctccctcccgcccgcaaggtgaaacaggtccgttctcacagtagctttcttcttcaagctaccctcagataaatctaataacacatttctgggttatgtcacatcaaattcagatacctgtttctgcttcctccacatcttgatagtaaaacatgaggtgtcggagacctccaacagcaaaaagttgatcaattctttcaatctgggaaaaagaaaaaggcaagataatgattttcaatccaaattagaaactgcaattaaatcagcattaataatataaaaaaggaaaatttactgtcatctttcttattcaaacaggactgcatctaatgtatcctataaaaaagggagcatttacatcaaaagaataaatgtctcaccatagtaaagactctgttcaaaaaagtaatttcatgaatcatagaaatatttgctacttatgcacatttgaaaagcattgtccatctatatttgcaaattccctaaagtgttgagctgttgaagggagatttaaatagagatgagtgcttcagtcaactgcagataagcaagaacaaacctttcaaaacttagtctaacactctagagataattaatattaaattgcaataatcaccaaaactgccatgagaacatatctgactatgaacacaccttccagtaagcaacctggcactaagctgggactaagagtcccatccctgaggctcactgtaagtctacaagtctaacaaatggcctgctaccaacagaaacacttcttttaaatagtcaatagcactgtttggaattcatatgaaaataaaaagataaaatccacacacccattaggcattaggatggctaccaccaaaaaacagaaaacagcaagtgctggcgaggatgtggagaaactggaacccttgagcactactggtgggaatgtaaatggtggagccgttgtggaaaacagtatgaaggctccttaaaaaactaaaaatagaattgccacatgatccgggaactccacttctgggtatatatcccaaagaattgaaagcgggctctcaaagagatatttgtatacccatgttcatagtagcattactcacaatagcttccacaaaagatgaaagtgacagataaagcgataaacaaaatgtggtatacatatacaagggaatataatccagccttaacaaggaggggaatcctggcacatgctacaacatggatgaaccttgcaaaccttacactaagtgaaataagacgatcccaaaaagatgaacactgcatgactccacttgtgtgaggtacctatggaatagtccaattcctagagacaaaaagtagaatgcgggggttgccaggggctggagggaaggaggactgtggagtggtagtttaatgggtacagcgtttctgtttttgtaataaaaagcattctgaagatttattgcacagtaatgtgaacgtacttaacactaatgaactgtacacttaaaatggttaagatggtgaattttatgttatgtgtatttactacatcttaaaataatgtttttaaaggataaaatctagcctgaacaattaaatgtgaaaaataagtccccttcaatttccaccatgattgaagatgccacagggacgaggaggaaggactccccaagattcaattccaggccaagaatgcagtgaagggcatgcttccatcacagccagtattgaagctcctatccctcccctctgtgcttgagagcctgagccagatgctttctttaaacctccaggttctgacatccctgggttctgaccttgacataggagtttaacctggtatccctacagagctgaacttttgcctgcttcttccccttgcatattcccaaatccagatgtctgaattgggaagcagggtggagttaagcatttcacctctggaacaatctccccaagtggccctctctgcttttatgcctccatattctgggaataatattatctacctcctggtattatgaagatggaaatgaagtcatagatgaaagagactgagaacagggaccgacacatggtaaacattcaataagtgtcagctatgaggagaaggagaaagaggagaagcacatttcctcagctcctgcttgatccatcctgtagtttacccattttcgtgttatccattcttaattgttccccaactcctactaaccccaccagagtagcccagcaggaaggaatgaagccagtggtgtgccacagatggctcgtactggcccaggatatccaatggatcataactctttacaactcaacatttcgttaacatgatgatagtagtttggaaccagccattgtgggagtatttacaccacagaaattagcagattttcaaactagtacctccctgcctacttcctccaaccttgcccaaatccagttgttaaaatttacaagactaccactgaaaagaattcccaacggtgtggcaccctgtcagcaaaaagggcttgtcttctttcttttttttcctaatgtctaattagtttctttaaaaaatcttcaggaatcatcatagggctgcttatgtgcttttctcactgcccaggaaattatatcttcccatattttggccttccctaaccaaggtcaaacacaaagcaaatcacacccccagttttaaagaaaaattgtagcagaagatgggaacaaaagcaagcaggttaggaacaaaagaaagcaggttcagctgccaaaccaaagtgaaagccagaaaatcatggcacaaatccagtgcctagaacaggggaaatgcacaaaagacgaatcggcaacttgaaacgagattctgttccccggctttagtttccaaaatggcatgagagcccagcttcactggatgtagagagatgcagacaatgccatcagaatcacggaactcaaatgacaattagaagtgcccctattcaacatggagagctggagagccttaagctcattctgcaagcaccagtacagagtcagaatggagccctgtccacgttaagacaggcacctccctctgggcacagcatgggatcctgccacaggactgtgtcaacagaccatctgtgccctccatcatcaagtcagtgagaagtgaaacgcatcccacctgattcccttcaagaatggcatcctccacttcggttttgttcaggtccaaacaggaagccacaattgcaaataagtagttatgcctcgcatccaaaagagcccgcttggcttccttctctcccttcagtctttgctaaaagaaaagaataaaaatgttacatggaaactgctgttctcaagtggattcattttgtaataatttcatacaattgttgttttttcaagtcttaggtatccagataatagacagcttaatggtaccaatttttatgtactatcttctatttttagaaataatttatttctcttatgaaaataaagcatgctcattgttgtgaaattgcagaatacagagaagccaagagagaaaaatctgccatccagaaattattattgttaacattttgttctaaatctttacacacttatttctatgcatatataagcattcaacagaatatcaaaaaaagagatctccatttttgtaaacattttcctaagccattaaagtaatattttttctacagtatctcctatctttattgtttatctacagctacatatttggtcttgaaattaacttctgaataccattgcttgctctttaactatcaattgttaattatgagaataaggcatgcttaatgtaaccaatgttggcagtttgaagcatgtctttccttatactgtatgatcatacaatcctattcaaacatatgcacacacctatatttacatcatactataaaatgttttcatgcatttctcccttaacaatgcatcacggacttctttctagtttaatacagactattccatcctgtgtaatagctgcaaaaatattcagtatgaatgtaccatactttattcaactattttgacactggtagacgttcagcttccaattcattcttggaataatacattacctttaatgccaaccagtagctcccactgggaagaggaaaagtggcccctctggatcccttcttttaatcaacaaacatttgttaaacccctaatatgtgtcagcactgaagagactaacactacctggtaacctcaaaaaagctcatggcctggctggcaggatgtgagctgaaaatttaaatatgacagatggcatggcagttgccacagaggcatcagatttatgggtctccaaatgcaggggcatttatgggtctacagagaaggagcaaaaagaagggtctcccactctagcctggagttgataaggggtaggggtggggatgacaggacagctttcaggaggaggtggctgaagcctagcattgaaggagggttggtcatactcctaggacagtcgcctttctgcatacacaaaggctgagaggcacacaaaagcacattctgaaaaccacaaggtagccaggatgtgtgaactaaaaaggactaggaaaacataataggaaatgagaaaaaagtcagataataaatattttctgaaccacattacaaagtttaactgttatgtaaaatccacggagaatcactgatgagtttcatatcaagagagataggtgtttagctgtctgtgcagcactgaaaaatccatcattctggcagcagtgtggaaagtaggctggtgtgatgcatgcccagaggcagtcaggtgggtgatggtggcattcccagacactgggttcatcaagaggaacaagttgaagcaacacaatcataagttcagcttttggatgtgtaagattttgaggtgactcaatacacaggtggacgaggcagacaggccactggaaatgttcaaggggaaactgcattgcagatacagataacatgcaggttctcaatttagcacgatgactttatgagacagaccattcttgttgtgaggagcagtcctgtgcaatgtgaggttttagcagcgcctttggtctctaacttctaggtcccagtagcctccaccaccaactcctgagaataaaaaacgtctccagacattgccaaatggcccctgtgggacaaaataacttctcctgttcagaaccactgatatgatacagacatatatatagatatagacataggcacatatagacatagacatagagaagacggtcaatataaaagctacaatgtcaaatcagtgtgaaaacaatgtggtacctgttggagttgtgcagtacagaacctgcaaaagtacacatcaacagctctttcaaccagcaggtggtatgtgcattcaataaatatttgtcaaatgaatgaataaatcaaagtttaaaccatgagtgcagatatgattttctaacaaacatattgaaatgaaaacacactaaaaaagtgaagaaaattggggaccaccagtatcccaggagcaaggagaaaaagaagtgcaaataaagaaagctaaggatgaggttgggcacagtggctcatgcctgtaatcccagcactttggaggccaaggcgggtggatcacctgaggtcaggagttcaagaccagcctggccaacgtgccaaaaccctgtctctactaaaatacaaaaattagccaggcatggtggcatgtgcctgtaatcccagctacttgggaggatgaggcaggagaatcacttgaacccaaaaagcagaggttgcagtgagccgagattgcaccattgcactccagcctggatgacagagtgagactccacctcaaaaaaaaaaaaaaaaaaaactaaggatgaatgtgcaaagagatagaaaggagaccaagaaaccgtagtagcaataaatcatggagagtgaccaatagcaacaatgctacacaggattggttgggttaattaggatatctttagggattgtgtttacaggatggttgcagcttctcacagctcttttgcagtgtgactgtgccactaacctgtcaagaaatagactgtatttcccctccccttgaatttggctagccctatggccagttttcaccaaaaaaaaaatctgagggtaaatgagatgggacttcctaagctagttcttaagagatcttcaccttctgcctttgcacttagaatgttgcctcagaactcagccatgtagggagaccacatggaggagaacaaaaccttctggtcagcggtaccatctgaccttctagctgaccccagcaccaactttcagccatttgagtaagctgtcttggatgttccaacctaagtttcccctacagatgacagcaagccagccaatggcacctgcagaagaaccacccagcagagcccagtcactcacagaataaagagagataacagatgattgtttctgctttaggcccttaagttttggtatggtttgtaacgcaaaaataaataatagagtaattttgttagaataatttcattggttggacagaaataaatatagacttgagaaaaggatgattgggaaaagagaaatataaaaatgctgaatataaactactttttccagaaacttgactataaaggaatagggtatggtagtaatagagaggaaaatttagagtcaagaaagaattttttaaggtacaaaagacttacagaaaagtaaagatgaaaaagttggagatttcagagcaattgaaaggttattgctacacctatgtaattgacatacatttctctgaacttgaaggactacctatctgagagacaactttgctggggaggtggcaagaggcaggattcaggtttaaaaaatagataatctacctgttttctcaccatttctttaaaaacaaacatgttagttcattccatagacatcaaataaaagtacatttaaaacttttttcaaatgtcactaaagccaggaagatgtcctgttgttttgaattgttttctgccttcctggcagggagaaataaaagacttttctctaagtgatcactctaagtttgtgctaaatatctttagcagcttgagaactcagaggtcaaccagggagccaggaattcagcaacaacacaaagagatggcaaatgcttggtagccaaaactaaaaataaaagaagtagacagccagaagattcaagatgtaaaggaactgagggcttccaaagagcacagagatttaaaaaagattcttccatggcaaggaactgaggcgttccaaagaacacagagatttaaataagattctcccatggcaacacattacttcataacccaattgtttctgattccagagaaaaaaacatcctaatgaaaaagagggaaatcactccctaaaatagaagactaattattctatttttacttaaatatcacaggagaaagaaacttccaaagcagctttatttatataaagctaattattgacatatttttaagtaaatgttttcagaagttatttaatatatttaaaagcacgttaagacttgaatatattttcttatgtaaactgattgttctattgcctgaagacaagtaatatgaagtcaatcctagtgtcatatagatgaaatgccacaatgtttatcaatctcaactttcattgcattacactaaggtatcctgggaatactgaaattgctttttaactaccataaaaaagtcaataatgtcaaacaaatatttagcaattagaacagtgcactgtcaatccgcagacctaaccctgcagctttctggctgctaaggaactgcagcaacaagcagtcaggtgactagttctttgggggttggcttgtcctgctggcctttgaaacacctaggacacttggaaagtgaaggcagagagggattaagaaggcaggaggtaaactatgtcaagacttttctggagtcctactaaaattgttttgcattgcatgaaaaagcaccagtgaataggggtggggaacatggccagaaatctattcaatgtccaaggaaatctagagcagcattaaaacattgcggcaatttgtgatatgttattactgccttagaatgggagagtggctaatgtactacctcacaagaaaggagctctgcttcccaggtggccaatcctccacagacaaaggagcactgatgtcagaatgaggtggtaaggttctagtcccagctctgacactaattgcaagacctcacatctttcatttaacctctccaggccacaatttcctcaactacaaaatgaaagtgttggactaggtgacagccaaggttcattccttcttcaatatgtggactacttctcatgacttcaaacgtttacacaatctacagactcaaaattttaaaatacaaatcctaatgaataccccaaaaagctcagtgactgtctcaaaagtaatctatccatctgatgtttaaaaaatactaacatttgcctttaactctgtagaaccaaagtccaagtctgcatgcttatatacacaaactgtgtataaactacatacatgatcagtctttcattttgtctctaggcttataatcctcaactatatgggagaccttatagaaatgaagataaaagtaaaatggagataaaagtcccaacttgaaagaggtttgtgagggttaaattgcatgcagtttggtgatcacactaaatcaaacagcactcgaattaaaatggcatgaccaaggatttgatcctggacatcaaaatttaagtgaaacaaaacattttcataatgatttcttttaattgtacaaatgtttaagcttcctacacccttatgaagctctgccttgttgacaggtttgttcctgacacagatctactccactgaccccattggcagccagcagaagtggatggaggatggggctattgggtctgagagttcttttgtgcctaagcaaggacatcttttcccagaccctcctgaagtgtatattttgcattgtttgccctggttgcattgccagcttggttctgttagtcatcatttgctcactatgttttggtttaattgtcacaaaatccctatgaagaagacgttattatctccacaccaggaaatcaagactatggaccattaactgctttcccaaaagcacacaactaagaaagtggcagggttgggaatcaagcccttgctgtccacaggaccagaccaagacataggatgcccaagggcaactaagaattttgcataacttcaaactgatattccataagcactttttaaaaaatatgcgcttaacagttatctagtgtgctctagcaggagaccccatacaagggttatacgaggagttgtagatggagaccagttaactagcaccgatttcctgagttatatcagtggtattttagtgccagtgtggactggtacccaggtgcttccagctgggattaatgtattcagttctcactgcactcctgtgtctctcagaaaatgataacaccctcaccccatcttctactcctgaaagtgtctcggaggttagttcctcatttgggtagtcagtaggtgatgctccagattccccctactcactgctgcttccatctgacagtatcactgttatcgacatcatactgcatataccaggtcctcatacaatacctttgcacggggaagtgggtagggaaaggaatgggttctgcagccaaagaatatttggttgttaaagaaaaaagtttttctaggtgacatgattagctttgttgcacgtctgaatctgagaaagagaaagagatctgacttaaggaagttcagttgcacacgttgaaatgaatatatttctatttgtttgacttgagcattttgttctttatatatgtgtattcatacagtaatgtaacaaatataatagagaataatataggttaaaatccccatctgagatcattgtaaataatgtattctatgaattacagccattctcctatccccatccaaggtttccgtttctatggtttccattacctgtggtcaaccttgttccaaaaatgttaaatggataattccagaaataaacaattcataagttttaaattttgtgccctttggagtaatgtgataaaatctcatgccgtccaaatccataccacctgggatatgaaccatcccctcatccagcatctccacactgtagacattacccaaccattaaccatcaacatcatctgctcccggcacccaatcattgacatcatcatagctcaatgatccaggatcacccaaagcacacggtccccctgctataccatcagatggtcagtagcagtcaaacactatatcacaatgcctacagcattcacctcacttcatctcattatgcaggcttcgtgtcacctcacatccacacatgaagggtagatacagtacaataagatattttgagagagaaagaccacattcacacaatttttattacagtatatagttataattgttctattttattattattgttgttgttaatcttttactgcacctaatttataagttaaagtttgtcataggtatatatatgtacatatgtatatataaaaaatgtaaatatataaacgtacatatatatacatatatatgaaaaaaacatagtatatatagggttcaatcctacccatggtttctggcattcagtgggggtcttggaatatattccccctggataagacagaactactacatggttaaagttccttatcttaaataactaaagtaaatacatccatgactgatttccctttggctgtcaatgtcaacctcaagtccacagataattgatcacttgatgagaacacagtgctaacgaaaccaaggacatggatttgatcatctcaggccagctaacttcactttatttcatcttccccaactgtggatgaatcaggacaaattcacgagcagaaaaagaaaattattcaacgtgtatgcctggctgaaatacctggttattggtaaaatatgtgtttcttttctttctttaaagacacccaaatggtttagttctcctatctgccacatatattacctgatccttcttatctcctgagcagtaaaacaaagtaaataacaagagaatctcatcattcctacaggagtaccagctttacagggaagggatgttttccattttgatttattcgatagcagcagtgtcaacaacaggccctggcacactgaagatcctcaattaatatctctaaataattttaaaattattttacaagtcactctcacgtaattaagggctggaacaaattatcctagaccaacgtgagtccacgattgcagaatcaaaattaagtcaataggatccatgctgttgtgcctggaacataagtgactacacagaattctaccctgggtaggatagtagctccccctcaatttacagcaaatacagctaaccttgctttacctgcctcccgttttattttgttgaattagagaaactgagggaagcagttctctaactcatttacccttagagccctctacaatcaaccctgtttccctgtcttcccacagagaaaagcctccctctttgtcttccagcttctctgtttcaacccacagggccccgtctcctttcccggcctctctcagagagaagaggctgctctgtgatgcttcccagcccagcctaacctgctctctaattggctgggagaaccacaatttagagactctccactcctaactgtacttttcaagtcttgccttttctgactcccctttcgtttcatttatcccggtgaagggccacagctgcagaggaagcacggcacctccttccagaattaagcgcacttcagtaaagtggtttcgggaaagaaaagagatgacacgctggctaatcccactcacagcaggtgctttagtgaagccctcctctatttaacaagagccacgctttccctctattgcaaagagatagcacttaagcgtgtggtaccatccattttcttctgtccagggataaactttggcatcctgtctatttttgctggagttcccaaggcctctagctctccctatttactcactcccttacctatcattccttccaggcaaataaagaactctctctttagcatttacgatgtgtgaattttccacccagaccaaccccaaatctgctgtaggcatatcccggtgtccacagcctcacctcccccgacattccatcatccaaattctaacttagagtctgttttctgcacaccaaatttctggacctgaagtgagatctggtggaccttcacatggccatatatcctctttccctaaccccacagtgatttcactccaaaatcagaaatgcctctcatgtagaatttcaagaggtctctctggcagcagggaccatataactcaaatggcccttacccatatgctaaaaatatatatatataatatgtcaccattcacgttatatatggcacaggagtggaattccaaaacttcccttattcatacaacaaaccactgtgcttaaagctggccactcattggaatcattggagagctgtaaaatactgatgcctgggcctcccacccctgagaaatcctgatttatctggtcaggtgcggggcccaggcaccggcatttctccaaagctcccctggtgattctaatgtacagcccagcctgacatcactgttctcaaggaagtcattttacaaattgatcctgatggattagtatgaccgagttctcacttgaggtagaaacttaacagagaaagcccaaggacataaattttgggatcttctaactctaacttctccttttctccttactagacttgtgcaaaaattgaatgatagaaagaacaagttcagctctaaattccatggtgtctagaagggtttttccctgccatatcacagagcacagcacttagtacaaagtaggcatccaagagagatttgtggaatggataagttttgcacatacagttacattcccccagggtctagctatggcatgataatgatggggcatcttttggccttaactagttcaggctagagagtgctcagtgggcctttacaagcagcactggcacaatggctcatgtctgttatcccagcactttgggaggctgaggcgggaggattgcttgaggccaggagtttgagatcagtctgtgcagcatagcaagactccatctctacaaaaattacaattaaaaaattagccagatgcggggatgcatgcctatagtcccagctactgaggaggctgaggtggaaggattggttgagcccaggagttctaggctgcagtgagctacgatggcgccactgcagtccagccagggtaacagagtgagactgtctctaaaaatggaaaaaaaatttttaaatagacagtacctctctcttcccagctaaaccctagatccattcaccttccagtgctctaaggaaatggttttgatctgctctatgtgaaatttgttgacttggccaaacaggtctgggcctgattaacagcacactgaaaatggtttggttaatttgccagagaatgagaaaactgacatcttttcagatttcaaaagataatctgagagcaaaggttctttctgtcttggcttctactaagcaccccactggaaacaatggctgccctcctgcagagcttctcggcgggagagggaggtgtgctctcttcccccacagcttctacccacaagagattcactgttcagagaaaacctgcagcaatctgaaagttcatgagcaacagcattccctaacagaaacacatacagcacaaaacaggaacaacacacattccgctgcagtggggagaagacttttctccattttaaaaccagctttgcaattaggtaaatttgacagtctagaggactaccatctatctttcaagttgttcttttttctggaagtcaacaaagtcaaccaacaaagttatagacttcagtttcattttggggaagtaaagaaaaacagaattcaagtctggaattcatgtccgtcttacacctgtaacttggtactaagcattctttatctctgagaaaagcagaaaaaagacagacatcagatctggaccataatttttgcaaatgagcgaatgaatatatacagaataatttcaagtttttaaatgaaaataacgtgtgtttattatacaagagaaaagatatatggcttgactttgtttatggtacatttggttgttactggcatgatatttatggataaagtcaattattacattacagtagcctaattataacatagcatcattgcaataatagttccagaccttagcgtggaacttagttaaatatatatggacttgtagttaaatacatacatacttatagttaggtagctctggaatgtttcccattggtcattttcgatcatgaagttataatataataagctatcttatcagttgacaaactttccttgcttggccaaactttagtcaggttcctgaatcttctcctaggcccatctgtacacttccttgtaaaatctagttttagcaaagaactctgctaagtcagttaacaagaacccctgtagagggtactcaatatctgatcaccgtcagtcgctgattgggttcctcatcctccaccatcccccacgtgctgtctcatccccctggcctttcttcagcaagaatcctggtaggtcgtcagtttagccagaatccccctccccattgatgtctcctctaagcactttcctatccactgacccctgccctgctccttggctacaaatcctcacttggccatgccatattcacagttgagcccaatctctcccatcactccccagataggtccttatacctaacacgacggtcgtgaataaagtcttactttaccatgctttaccaagtgtcactgaataattttttttctttaacacagtgcactaagtagaaactgtgtaattatttacataatacactgcaatactattaaggtaattctgttaatattatacttcagtggagtgaaccaaaccagcatcctaaatatataattgaaacctccaaaagacttgacttactctcaaaacatagttcatgtcaaggaagaataattcattaattatacctgagattttatcatcaattgtggtgtttcagacttggtactgaagcacaggaaaaatgttcagacatgtgaaatgtttaattcattcaacttattccacaagcatatattaaggaccaagcatatactatggaccaagctctgtgttaaaggaagattattttaaaatggagagaactcgcaatctagcaagagaaagagacatgtgggtaaatgtcatttcactacagtgatgtgacaaggactctataagacatcgaaggaaagtgctgacagggtacaggaaggaaactcacacctcctcctcaaagtgtcaggggacgcttctcagaggaggtaacactagcacttggtcttgaagaataagcagtgcatggactggctggagtcagctcttccagaatggtcttctaactctagcaagcaagttcaggggcttggctgcaagacgttcaccttgggaaggatgcatcagaatcttgtggcttgggcaagtgaggggtggcagatggtggcatacttaaaaaattcagaggtagatgcctgctcttttgtggtaaaaacaacaggctaggggggatcatgtgagcttctggggatacacaaaaagacacagtgatcaagcccagtaggaagcatgggttaatggttgagaactgagtcctagagaaacctccaatttcttctgacgttaattggcagtggaagaggtttccaaatccctctctatgcatttgcataataaaaagctgctgagctgagccctgtgctagggaagttcattcttcaatgtgatttccaaaggcacagccttgcatctcactgtctgtgacctcatttgcaggcatatagaacaggggagtgatttcaaagcctaaaccttgcagcctagaatctgccttaactatttctaatcaccaactaaagtttacaggtttgaaagaatacaaagtgcccaaaccactatgaatgtgtttttgaccccaggaaagcatcttcccaaaagatgcagcatgaatttctaggtgcgtagtttaagcggcaacgtgcagaaaagcctacagatgcaaaattttttttatttaaaaaatgaatatgtagcctatgcaccaggtgaacattagttaaaaaatgtgtttctcgcaaattcatcagtgtgtgactttgaacctttttcaagtttgttttttccacccaggtgtgacagatgataatccaaaacacacatgcaaaggtacagacaacagcaccttaccgttaaaactcgagtgacgctatgcttccagagctgtctcctcccaatcctaaacattgtagccgtgcatggacaggctggagtcagctcttccggaat

SEQ ID NO: 2103 - DNA, 41999 bp, Homo sapiens
agggcgtcttcggctcccaccccggggcgtgggcctgggggtccctcttcactgcgcagccacctctagcccgccgctttcgggactctcagccttcttttcccttccctgagggccggccggcaccacaacggggccaaaggcagtaactcggttgaaaggcgcgccctgggacaggtcagcgggctccgccatgcgcggcacgcatcccgcaggagcgggtgccagagcagggtaggccgggagttagcagcccagccaggccgctggactcgggctaggggcggggccagcgcagggggcgcaggcgcacaccgcctccgcggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttcctacacgggaaggtaccaggaggcaaccctgaggtgggatgcgggaagcagtgaaccaatcatcgcctcggaggcagatttttttttttcggatctcggctggaaaataccaatcattatcactccggggaggcgggagtgcgccactagaatgcatagaggggcggtgaaaggcggcaagattgcctttgaaattaaggcaatgaacacatctagctctaatttttctaatgtctccactagaaatatctactgggagagtgcattgcagattaaagatcacatgttacattccccaagccattcatcatccatttatgtatacagggactaggaacccagtcaatgttagatgtctcgctcatccctgtccgtggaaacgacatgagactgtaggagatgtgatctctgccttacgcgacttcagccgtaacaggagaacaatatattataattgttaattcagttctacgcacgcactttcatgcatgccagacactaaactaggtactggggatgtggagacgaaagttaccatccctgatcttcaggactacggaatatttctggcgagacagatacacacagcttgctccaataccaacgtgctcagcaatctggcaggggctgaggagagatggagaccattccaggaactagtgaggaggcctagccagagcagatatgggggttccccagaaactagtgaggaggcctagccagggcagataagggggttccctagaactactagcaggaactctcacctttgggaggatcagggaaccttggcctaggcttccatgcctctgtgtgtatctggtttttaaatttttatttatttatttatttatttttgagacggagtctctcctctctgtcacccaggctagagtgcagtgatgtgatctcggctcactgcaacctctgcctcccgagttcaagctattctacctgcctcagcctgcccaatagctgggattacaggcccccgccaccatgcccagctaatttttgtatttttagtagagatgggggtttcaccatgttggccaggctggtctcgaactcctgacctcaggtgatccgcctgcctctgcctcccaaagtgctgggattacaggcgtgagccaccgcacccgccttttttttttttttttttttttttgagatggagtttcactcttcttgtccaggctggagtgcaatggcactatcttggctcactgcaacctccactttctggattcaagtgattctcctgcctcagcctcccaagtagctgggattacaggcatctgccaccatgcccagctaattttcgtatttttagtagagacagggtttcaccatgttggccaggctggtcttgaactcctgacctcaggtgatccacccacctctgcctcccaaagtgctgggattataggcatgagcgactgcgctgggccttgttttttgttgttttttgtttgtttgtttgtttgtttttgtttcttgttttctgtttttttgtatgcgattctgtctggttctctcagcccagctgtcttcagtgtgcagcacctgttgaaggtgttagtcatgagagccttcgagctaggagtcacttgggagacctaggttctggtttctgtttcaatgctgactgttcatgtgaccttgggcaagtcactcaaggtctgtttttcatcttctgaaatggggagaacttgacagaggtcttgtaagcctaaaatggaagacaactgagaagccttgtattctggggaagaaaggtgtgagaactgccacaaggatttgggtggagatgccttctctggctgggcatggtggctcacacctgtaatcccagcactttgggaggctgaggcaggcatatcatttgagatcgggagttcaagaccagcctggccaacatggtgaaaccccatctctactaaaaatacaaaaattagccagatgtggtggcatgcgcctgtaatcccagctactcaggaggctgtggcgggagaattgtttgagcccaggaggtggaggttgcagtgagccaagatcgcgccattgcactccaatccgggcaacagagcaacactccatctcaaaaaaaaaaagatgccttctctgagaaaagaaatgtgaaatgtgagtgccattggctagacttccccagagggaagacttcagggaaggaaatcccaagtattgggaattcaaaggccctgggagcttctgtcttgctctccagagtctcatcgtggttctgcccttgagcccactgatgatgcctctgcccacaggtgaatgaggcctctggggatggggatggagaggatgccgttgtgatcctggagaagacgccatttcaggtggaacaggtggctcagctcctgacgggcagccctgagctccagttgcagttctccaatgatatctacagcacctatcacttgttccctccaagacaactgaatggtgagcaagaggtggccagggtggctgtatggagggagaatgggatggtgggaaattaggtggtatggtgaccagactctctatacccgatttgcatattctagtacaatagggagattacttccctaggggacatttggccatcggtgaagacatttttgattgtcagaatcgggggtggtggtggggtgttgcttctggcatctagtgggtggagatcaagaatgctgctaaacaccttacaatgtacaggacaggctcccacagcaaagtaatgtcaatagtgctgaaactcagaaacctggccaggcatggtggcccacacctgtaatcccagcactttgggaggccacggcgggcagatcacctgaggtcaggagttcaagaccagactctcggccaacatggtgaaacctcatctctactaaaaatacaaaatttagctgggcatggtggcgttcacctgtaatcctggctacttgggaggctgaggtgggagactcgcttgaacccaggaggcagaggttacaatgagctgagattgtgccactgtactccagcctgggtgatggaacaaaaccctatctcaaaaaaaaaaaaaaaaaagagaaaccttgttgtagtgtagtatgttttagggagagagtgtgattcatgggatagaataatatatatatattttttgagatggagtcttgctctgttgcccaggctagagtgcagtggcgcgatctcggctcgctgcaacctccgcctcacaggttcaagcaattctcctgcctcagcctcccgagcagctgggattacaggcgcccaccaccacgcctggctaatttttgtatttttagtagagtcagggtttccatcatggccaggctggtcttgaactcctgacctcgtgatccacccgtcttggcctcccaaagtgctgggattacaggtgtgagccaccgtgcccagccagaataatagattaatctactaattgaatgataaaaattgtcaacaacacttaggaaatccttactattgtatctacatgtattaacacagttaatcctcaaaacagccctcttgtaaggaggactttacgaatgaggaaaccggtttttgaaaggttaaataacttgtccaaaatcacacagccagtaggtggcgggaaagctaaggtttttcagtagactggggtcttgctcaccatactcattctgtgggccggccagtgtgtctggtgctgcaaaaatcagtcacttccctgaaggaacctactttctggtgggagagacaactagtgagatcaagggggatgggagagaagggcaagaactcgtgggttaaaaggcagagatttgtttttcattgcaagcatttcttaatttattaaaaagaatattccatgccaaaagccaggtgtgacatgtgcattttttctcaagatggttagattttgtaggcagctttgttggaaacatgagtgagactggttgaccttaaagattccttccaaccagcaaattctggaatttgttttacagcacatggtgactttgtcatatccttctgtcttcttgtttgccctccagcatttaagagcggtctggctttgcagatatcttgccccacagtcttttgatagatattcttttctgccctccatgaaagggtgctattgttgtcctttggaaatatgtgaacacttcatggtgagacaagcaaacctttcatgacttaatgcaaaacagccttgtcttccattgagcaaaagccagattaattggtgcaagttgatggaaatggacagctgtatttcctttctcaggcagtgacgtttaagcaaatgtattcctcagcacagggcggcagaagaatgacagaaggcaccgtggccaaacacaacttggggtggccccctgcattgcaggctctaggggctattattttactgccacaccctttccctcaccttccgaaatccctctacccaccctccccacccttggccaaaattcagaaggttctgcccgacagatgaaccctgtggaattcacaggctgtcctttttattttcccagtccttctgtggcattgcacacaagtggaggtagtccctgctcgccctttctgtttctattgtttttcccaagataagcactgaaagaggcagtgggttattggcccaccacaagtccttgttcccactcagaaccccaggtgtctccagggccacccccacccacctgggagcctcagatgttagttcatcttttcttttcctgcccctttttttttttttttttgagatggagttttgctcttgtcacccagactggagtgcaatggcacgttcttggctcactgcaacctccgcctcccaggttcaagtggttttcctgcctcagcctcccgagtagctgggatttacaggcacacaccaccacgcccagctaatttttgtatttttaatagagatggggtttcaccatgttggccaggctggtctcgaactcctgatctcaggtgatccaaagtgctgggattacagttacaggcatgagccgctgcccctggccttcctgccttcttggtatataagtcatccctcagtatccactggggattggttccaggactctccttggatactaaaatctgtggatgctcaagtccctgatataaaatggtgtagtatttgcatgtaccctaagcacatctcctgcctgctacaatgtaaatgctatgtaaatagttattataccatgttttttaggtaataatgacaagaaaagtctgtacgtattcaatacagacgcaatgtccttctttttttaagtatttttattcttcatttggttgaatccacagatatggaacccacaatacggagggccgactgtacatgcggtgcctttcgctcctgcttttcctaccaaaactagggatggggatttggaagtcgcagcggtttgcttcagggcccggttgctcccttgtttagctgcatagcttttccctgggtgatatttgaggtcaggattgtcaaactttttctgtcaaaaaccaaagagtcaatattttaggccttgtgaggcacaaatggtctctgtctcctcttcttcttttcctcccatcttccttcccaaccccttcttcttctgccttttctgccttctccttccttcttctttttctcaacccctgtgaaaatgaaaatatcactcttggtttgctgattgtacaaatagaggtccagctggccatagtttgttaacctctgttccagatttttaccactcaaagtgtggtttgtgaaccagcagtattcgcaccacctgggagtctggtaaaacagaatctcctccccatttcagactacagaatcactggagtctgcattttagcacaactccctggtgagccatatgcacgtaaaactttgagaggcactggtctttaaaaaaacaccatctgtatgccggcgacgcccacctttatttctccatccttgacctctccaagaactccgggctcatattgaaataaagccctccttgacatctccatttggaggtctcataggtgcaattcaagaatccgatgcgctaatgtacttaaaagcactgagcacaatactaagtagtagctgctgttattagtctcatgtgccaggccctatgccgcgtaccgtagcttcagagatgagtaagataccatccttgccctcacagtcttgtttggggtcaggggtggggacatagtggtgaaaagaggagagtttggtcactgcctggatataaggggtgaggtcctcgaaggttggagccatgtcgcccatattaggtgctttcaataagtgaagaatgaacccacaaactgacctatgtgtagatttgttttcctgtgggctgggcattccacagccacaaggtggcagcattgccaaaatagtcctgtggcccactccagctgtcccctctgtgggaaggccagctaagtcagagcctgggacctccctctccagtcccagccttggagtcaactcaatgctgcccaccccgagggccctgaatgtgcagttcctgcagcctcagccctctgtccccctgcatggttgtgcctttgagtttttctgctgtctctggctgcttctttagacctccttcctagaatactgtttgcctaggggagcccccacccctcatttctgagctggccacagtagaaatcatgggctcagctgatttttttctggtattcctctggtcactggcaactttcttttcctcttcaagtctggaggttttgcagtctcctcattcgtttatcccctccacgttctcagctgactgcaagaggctgctcgtgtgagccactcatccttccagctgcaatgtccatcccaacgacataatggagagagcatgggctttaggagttagtcatgctggggcactcatgctttctcatggcatgcactggggcagcaacatgctgtttctgagttttagcacagtgccagtgctgagaacaagcctcacgtcaggcagacctgggtgcgaatcctggctttgccatttgctaaccatgaggacctgggacatttctttattcatttaacaaatgtgaagtgtctgctatgtgccagctactctagtagaagcaaggtctgtgttggtgaagataaccgatgtctccctgtctttgcagttctagtggggaaggcagacagcaaacaaggaagcagatgtctgagtggccatgagcaggagagagcctactcagaccagggctctaggagggctctctgcagtggagctgacacccaggctgaggcctgaaagatgggaagaagccagctgtgcaaagaggggagaacactctgggctgaggaatagcacgtgttctggggatggaaagaagaacagaaatgaggctgttatgtcaggagtgatggggtgggatggtggcaggggtgtgtactacagatgaagttggggaagtagcttcagttattttctgttaaattaggttagaaactgaacttacctcagtgggtaggttatgaaacacataaggaagttttcacaactttagccactgcccgcagtgagagatatgtttcacattatggtctattacacatggactaatagacatgaatagaaatgaaactttatttattgagttagttagttagtttgtttttgagacggagttttgctcttgtcatccaggctagagtgcaatggcgcgatattggcttactgcaacccctgcctcccgggttcgagtgattctccagcctcagcctcccgagtagctgggattacaggcatcctccaccatgcctggctaatttttgtgtttttagtagagatggggtttcaccacattggccaggctagtctcggactcctgacctcaggtgatccacctgcctcggcctcccagagtgctgagagtacaggcgtgagccaccgcatctggccagaagtgaaactttaaacaatgcttacccatccgctatggcatactctgtagtatttcctatctagtttcagccttattggtttccttttttattttttaatttttaaaattatttatttatttttggggcagaatctctctctgtcacccaggctggagtgcagtggtgcgatctcggctcactgcaacctccacctcccgggttcaagccattctcctgcctcagcctcctgagtagctgggactacaggcacccgccaccacacccagctaatttttttgtatttttaatagagatgggttttcaccacgttggccaggctggtctcaaactcctgatctcgggtgatccgcccgctttggctgctcagagtgctgggattacaggagtgagccaccacgcccagctggtttccttttttaaaatgctggtcttaatcccctaaattgacttcatggccactgtcctggattaggacccattaagagaaggtgtatagagcacgtggcacagtagctgtcatatggtctgtatccaataagtgtaattatggtgttgcctcttatttttttccacctttcaatttatgtgagctttaaatggaataatatatataacatggaaaagtgactggctctgcccatgggtaggtttcctttcttcttcctgttgctgtgtggcacatgtgaggagctaatggcccgaaggctggcacctgagagcttcctctgaccctccaggctgggcagggcctgcatctcctttctgccatagctgtcaccctgcggcctgtcaatggagccctttattgcggtctgttctcctttacctggggaagaagggggagatagcagggagagaggtgtggctcagaaatccaggctgcctcttcaaaggccaattgtttccccgtgtaaaccaggaggtgaaatctcaagttcagaagaggagacaggcatttgtgagtgaggccagggcggggagcagaggggtgggatcctgggaatcgtttctctggttgcagggaactcccggtactgtagccacaggccagggttttccgccctgtgctatttgcagaggcaaaacccggacctcctgagggaggggtgaggacttgtttggaaggagcattttaaaagacaagtcattctcagaagagtttgcttggtagcattgttaatgatagaacaaactagaaacaatcaaataacagtagagtaggtagataaaccgaggtatagtcctacagtgcctagctacagcagtgaaaatgaactacagctgcctgtatcaatgaaggataaatctcaccatgtagggcaagaaaagcatgacacagaatacacatggtgcgattaaaatggtacaaagttgaaaaacaagcagaactgaacaatatactgcctagggatgcatacatgtgtaataagactatgaggacaaaaaggaaatgattaacccccaaatcagggaggtgattatccttggtcggggtgtggcaggacagagagaatgttaaaatttctggttatattctgtttcttggattgtgtgttctgagcatatgtattctttttattttacttaggtttttaagtggtacatattttatatacatacacacctgtgttttatatgtataatgtatttcccagttgaaaggtaagacaaattggcaggtccttagatggactagaaagatcgtcccatgaatttcaagggctgcatcctcattctgaagtgtggttttcagtcacagttctcaaagtgaaggtatttggtttcagcctcctacttctgggttttaggcatttgtggactttcatttctgcaggcttccccttctttggggtgtggggatggctgggccagccgcttttctccccaatgattgttgttctcttctttgtgtccgtatgtcctcaacgtttagctcccacgtataagtaagaacacacatatttggttttctgttcctgccttagttggcttaggataatggcctccagctccatccatgttgcagcaaacgacatgatctcactctttcttatggctgtatagtattccatggtgtatatgtaccacatttctttattcagtctagatgttggtgtggatgcagtgaaaagggaacacttctacactgttggtgagaatggaaagtagtacaaccattacgggaaacagtgtggaaattccttaaagaactaaaagtagatctaccatttgatccggcaatcccactactaggtatctacccagaggaaaataagtcattatatgaaaaagatatttgcacatacatgtttatagcagcacaacttgcgattgcaaaaatatggaacccacccaaatgtccatcaatcaacaagtggataaagaaaatgtggtatatatcataccatggaatactactcagccataaaaaggaatgaaataatggcatttgcagcaacctggatggaattggagactattattctaagtgaaataactcagtaatggaaaaccaaacattgtatgttctcactcatatgtgggagctaagctatcaggatgaaaaggcataagaatgatacatgggacttagaggaaagggtggggagtggtgagggataaaaggttatacattaggtacaatgtacactgctcaggtgatgtgtgcatcaaaatctcagaaatcaccactaaagaacttattcacgtaagttcctacctgttccccaaaaacctattgaaataaaaaaataaaaaaatttaaaaaaattgctctaccgtaaagacacatgcacacatatgttcattgtagagctattcatgatagcaaagacatggaatcaacctaaatgcccacttgagggtggagggttggaggagtaagaggatcaaaaaactccctatcaggtattatgcttattacctgggtgatgaaatagtctctatgccaaacccctgcgagacaatttacctgtaaacaaagctgtacatgtaccctttaacctaaaataagaattaaaaaaaataaaaagaatatttctgggctgggtgcagtagctcatgcctgtaattccagcactttgggaggccgaggcaggtggatcatttgaggtcaggagttcgagaccagcctggccaacatggtgaaaccctttctctactaaaaatacaaaaattagatgggtgtggtggtatgtgcctgtagttccagctactcaggaggctgaagttggaggattgcttgagctcaggaggtcaaggctgcagtgaactatgattatgccgctgcactccaacctgggtggcagagcaaaaccctgtctcttaaaaaaaaataaaaagagaaaagaaaaccagtaaaaccattaaggagtatttacatgattgaggccatattaatatgcatgctcaaccagagtgctaagtttctagtttttcctccacctgcccagtgtatcatctccatgccactcaaaggagattgctttattttctctttgagacagtctcagtctgttgtccagactggaatacagtggtacctctcagctcattgcaacctccacctcccgggttgaagcgattctcctgcctcagcctcccgagtagctgggattacgggtgcctgccaccacaccaggccaatttttgtatttttagtagagacagggtttcatcatgttggccaggctatctcaaactcctgacctcaagtgatctgcccacctcaccctttcaaagtgctgggattacagatgtgagtcaccacgcctggctggagagtgcttttgatgtccaggtcgagtggattctcttttcttgcattccaacagtccttcaaatcatgctgctttttagtttgtttcatatttgaaccactgttttattagcttttactttttcatggagtttttagttgcctcttttttcattgtggttaaaggaataatgtacctttactctgctcttgaaattatccagtgtgataatccattacatcaagcttgtccaacccgcagcccaggacagctttgaatgcggcccgacacaaatgtataaactttcttaaaacatgagattttttccgtgatttctttttttttttttcagctcatcagttattgttagtgttagtatatttcatgtaaggcccaagacagttcttcttccagtgtgacccagggaagccaaaagattggacacccttgtattacatcatatttccttccttgctggtaacattgtttccagaaagctctttcctgcttctccaatctggacaggtgattctttaagcaagttgttcaggtctcaatctgagacttccttttgcaacttctgtgagttagatgttttctgtattctacgtctgtttctttcttgttttactctcttgattagctgaagtacattttttttttttcatgtttttcttgagatggagtctcgctctgtcgctcaggctgtagtgcggtggcgtcgtgatctcagctgactgcaacctccgcctcccgggttcaagccattctcctgcctcagctcccaagtagctgggattacagacacccgccaccgcgcccagctaattttttgtatttttagtagagacagggtttcaccttgttggccaggctggtcttgaactcctgacctcaggtgatctgcccacctcagcctgccaaagtgctgggattacaggtgtgacccaccatgcccggcctctttttttttttttttttttgagatggagtctcgctctgtcacccaggctggagtgcagtggcgcgatctcagctcactgcaagctccgcctcccaggttcatgccattctcctgcctcagcctcccaagtagctgggactacaggcgcgtgccaccacgcccagttaattttttgtattttttagtagagacggggtttcaccatgttagccaggatggtctcgatctcctgacctcgtgatccaccctcctcggcctcccaaagtgctgggattacaggcgtgagccactgcacccggcctcccggcctctttcttatagtctggtagattgtctgcattttgtcttctagaccttctagtgaaggtgttaatttgacagtcatattttaaattctcctctctctggttctctgattatttcattctcatagcattttgctctttttttttttttattgaggccaaattgtgttgaatctctctggcacactaattagaattatttttaaaattatctcctgaccctcaaattattttatttcctctgggatctggttgtttatcttggtcatccttattcaggctgctggtttctttcaatggctgctgattcacatgagttcactcatatttcacagtgcagcacagtgtggcatgtccagtgacattcattgagacttggtacccgtgcccctttcagagtgaattaaagacatgccttcaggcaggaagttgagagaggccatattttggagtgttcatcctacagcttttattgtggtctggtctgctcaaccccagcatagtttctttctgtgtgtggagaagtgggggggctcgcggctctaaggccaagcctgtcacttcatagctccctgacacattgcacattagctcttgctcttcctgttcacacggagctttgcagagtgccattagccccacagccatcctgaagtcgcgtttcccactctctatccattgtaactgagggcctctcctgccaccccagggctgcatttggagttaccaaatttgcttgtgggccaggagaccctggagttttgccatccggtcctgttgcctccctaccccctctgctttctggacttcagaggactagcgagagggagggaaggagctgagggtttgtacaagaagcctgtcagatccagagtcttgctaaagtcagcgtctgcctctcctctgtctctaatagcagctctgtgctttcctagagacaggtaattagtggttagaggcttgctgtggagtggttgaagtttccagtaggatcctgaccacacccttcagccgtgtttatccttgatgtggaggtctcttcgggcttcacttgagcactttcagtatttctgtaatgtaggacagagaacaccctgccttgcttggcctgggaccagaggatgacttaagatccacggcagccagccttccctccaccctctggcctggtctccccgttaccatgcagccagggctgaggagagtgtcgcctagccaggggacatcccacagaggaggaaagagaaagcagatccaggagagcctcccaccaacctctcgttctttcaggctttctctggcatgccttgcgaagtccggttatctgacccatccctggctggctctgcctggctcttgtggagaggacatggcgggtgggcttcgactcagatcatgcattgctgttgcttcttctcagtgctcctgggcctgcacatctgggttaaataagttaagctggctcctctgagcaaaggggaagcaaaagccacagactgagccatagagatgagctcatcctgtagaagccatcagcaacggctggaaagcagtcttgtttgaacatgtgtatgggaaggagagcagactgtctgtggtttgtgttttcatgtttcatgtgcagcagcattttcctggggatttggctaagctagctttggcagggagcagagaggcagctgctcttaactttcctctagatagccctgcctcccacctctgagagcagttgggcttttgtgtctagacgggggacaaagggtggctttatatattagggaagggcttgcagcagatcctcagggtcttgatggacaagtcagagctgtgttagtccggggcacatcagcctgctcatctgagttgcagagagaaggaacatatgcctagaggggcgcttttcagctggaggcatcactatcatcattctcgccgctagaacatcctgtagatgaagagctgctgccctgaactccaccaggcccctcttctgggacttcccccttcatgcctcccaccccataatctaacactgctatacttggtaggggaggtggtaggggacaggatggtaccacaaatgtaggccaaaacagctattgtttctagttgtgagccagtctggaagcaaggtcctcttccgtccctttgtgctccccccagaacctgctgtcccgcagcatttggccacagtatcccctggtaaggctgtcctcacacggctctccagagctcaggggagtggactctccttccctgagctccccaggaagcatcttggagggcacaagcagagcatgagcagtgtcatctctgcatgtctgaccacaccccctgtctggacctcacttgctctggcacctcattttgccctctggtttcgctgacagctgtttacgtgtctctaggaagaattggaactagtcatgtttctcctatctgatagggctgcttttggaaaacatggccccagcacaggtatcttaggaacggcccgaaagaggttgggcctttgggatacgggagtattgcatagaggaaccagactgcctgggttcagatctcagctctgccactattaatagctgtgtgtccttgggcaaattactcaacatctctggggctcagttttaaggggtagcttccttttaacgtatttgttacacaagtgatatgtaaatatatataactccatcatccaggattgatctctcttaacatctcagagtatgtcctttcagattttttttttttttgagatggaatcttgctctgtcacccaggctggagtgtagtgaggcggtcttgactctccatctttaccatcctggccaggctggtctcaaactcctgacctcaagtgatccacctgcctcagcctctcaaagtgctgggattacaggcatgagctacggtgcctggccgtaatatattctgttctacagactgtactgtgaggtctaatcagtgtcgggtgttatcttaggcactgcacacacagtgtacgaaacagagtccctgctctcgtggacttgatgttccactggagatgatcttaaagaacaagcaagtatgtcacgtggcaacaaacagcaaagattgaaagtaaagcatcataagggagacaggaggacagggacatgggcttctagtgcaaaggggacagtttgaatgcccacctacttcctttatagcctgctctgacaatgatattaaaggaatattcttaaaaaaaaattaacccatcaagactacaagggcggggtgcagtggctcatgcccctaatcccaacacattgggaggccaaggtgggtggattgcttgagcccaagagtttgagaccatcctgggcaacgtggcaaaaccccatatctacaaaaaatacaaaaattagccaggtgtagtggtgtgtgcctatagttccagctacctgggaggttgagacgggaagatcacttcagtccaggacatagaggctgcactccagcctgggagacagagccagaccctgtctccagaaaaaaaaggagaggagacaacaaaatttccaaacctaggatacgtagggaggagcagtaactggatctgagagatgacaccttggccagcagtccctcaagtctgctttcccatttcatatggaacttgctccttccttgccccagcaggagagtagagcagaaatgtctggagagggtgacataccaggtagccagggaaggtggctcactcctgtactcccagcactttgggaggctgaggtgggcagatcccttgagtcaagagttggagattagcctgggcaacatggggaaaccctgtctctacaaaaaatacaaaaattagccaggcatggtggtgcatgcctgtcatcccagctactcagtaggctcaggcaaggggatcacttgagtctgtttggcagaggttgcagtgagccaagatggcgccaccgcactccatcctgggtgatagtgggaccttgtctcaaaaaaaaaaaaaaaaaaaatcacacgaagggtgacacaccaggtctggaagagattcaaggtacagctgagagtggggtcagggcactgaggtgtggagagatgagtggatgtttacaccttgagcatttgcagtgttgccgtgatcccccggcccccatccagctgctgccctttctcatccccagaatactgtcagccaggcttatagctccatatgtgcaattggaagtcatttgtggagaatctgcccagcccgagagaaaacctaaactattgaggttccctaatacaaaagaacagcctgaccaccttaacacgaagctccaggtgaccacagcgacacccacagagctgcccttcaggagggagtggacaggcaagggtgagcagactctaaataaagcctcagctgaaaaagagaagacaagaaaaagaagggaaggaaaagaaacctagaggagacagaaactgtgtggggagaagacatttcaagaactataattaatctcagagaaattatgctgctatattgaatgtataagaatattatcaataaggaattttattaaagctcttggaaattaaagatacagcagaaatggaaaattaaaaaaatagaagagtagaagatgaagttgtgaagaaaacttccttaaaagttgagcacaaagacaaaagagatggaagatggagaaaagataagaaagtcagacgctgaatccaagaagttaaatatccaaatgggtgttgcagaaagaaaaggcagagaaaatgaagaagaaaggtctttaaagaaataattcaagacagtttcccaggtctgaagaacatgatttttaagattgaaagggctcagcaattacctagcacaatggatgaagataaaaccactttgagatccaaccacaccatcagggcattggagacagaagaaaacaggtcacaaagaactgggcatcataatgatctcagactccacaacaacagcattcagatcttcttatttttatttatttttatttttttgagacagagtctcactttgtcgcccaggctggagtgcattggtgccatcttggctcactgcaacctccgtctcctgggttcaagcaattctcctgtctcattctctctagtagctgggattacaggcgcacaccaccacgcccggctcatttttgtatttttagtagagatggggtttcgccatgttggccaagttggtcttgaactcctgacctcaggtgatctgcctgcctgaacctccgaaagggctgggattacaggtgttagccactatgcccagccagcattcagattttctttctatcctaaaattcctttttttttttttttgagacgaagtctcactgcgttgccaggctggagtgcagtggcacaatctcggctcactgcaacctccgcctccgaggttcaagtgattctcctgcctcagcttcctgagtagctgggactacaggcgcgtgccatcacgcccagctaattttttttatttttagtagagacggggtttcaccatgttggccagtctatcctaaaattctttagcaagaagcaaaaaaatttttttgagacaatgtctcactttgttgccaggttggagtccagtggtacagtcatagctcatggcagcctcaaactcccgagttcaagtgattctcccacttcaccttcccgagtagtggcgaccagaggcaggtaccaccacacgtggctaatttattattttttgtagagatggggtcttgccatgtagcgcaggctggtctcgaactcctgggctcaatagatttcccccctgtttcagcctcccaaagtgttgggattacaggcatgagccaccacacccagccaccaaattcctaagtgtgacagtagaataaatatattttcagatgtttcaagtctcaaaatatatcttgcttgcaccatgtctctgggcacaacttgagtttgtgattcacagtttacaaatttgataattctgtactgttaccaatagttacaagagacctttttaatcctcttatctgggaaacaattttcaaaatacaattattgttttaccttgagcggtagaaagttcagctttagaaacattgtgtttatttccattgtaatattatatatgcaagctgatgcatgtatttttcaaagcaggtgtactttaatggttaaaaaaatacacatgatgcagaaagttctttgaacaagtaaggcattcaaacaattctaaatgtattaaagttgcatttctttcttttcttttttttttttgagacagggtcttgctcagtcacccaggctggagcgcagtggcacgatcacagctcactgcagccttgaccttccaggctcaagcgatcctcccaccacctcagccaccagagtagctgggactacaggcatgtgctatcacacccagctaatttttgtattttttgtagagatagggttttgccatgttgcccaggctggtctcgaactcctgggctcaggtgatccaaagtgctaggattataggcatgagccaccaaacctgaccctaaagttgtttttttgtttgttttttgagatggtgtcttgctctgttgcccagactagagtgcagtggcgccatctcggctcaccgcaacctctacctcccaggttcaagcgattcttccgcctcagcctcccgagtatctgggattacagaagcaagccaccatgcctggctaatttttttgtgtttttgtagagatggggtttcaccatattggccaggctggtcttgaacttctgacctcaggtgatccgtccgccttggcctcccaaagtactgggattacaggtgtgagccactgcacccagccctaaagttgtatttctacagttattgtattcacataacagattgcagtagcaaaatttttttttagtataatgtttaaattttatttttaactgacaaataattgtgcataatgatttctgttttatgctctggtggaaatttgaatacctatctgctgatctacttggtaaattatttcagagaattgaaaatattttcacagttttcctaatgaaaattccaagaattggatttataataataataatgccacactaaagtttgagaattacttctgggggtggcaaccggaagttctgggaagacacattgttcatgtgcctgttgagtttttttttttagacagggtctcactctgtcccctaggctggagtgcagtggcgagatctgcgctcatcacaacctccgtttcgcagctcaagggatctcccacttcagccttctgagtagctgggactacaggcatgcaccaccatgcctagctaatttttctgccttttttttttttttttttttttttttggtaaagacgggatctcactatgttgctcaggctagtcacaaatccatggtctcaagcaatctccctgccttggcctcccaaattgctgggactataggcatgagccactgtgcctggcttgcctgatgagtttaacacataagaggagatttatgtaaacagggaagtggatttggggatgaattagtgacatgtttatagaaaattaaacaagtggccagaatttgggtggagatgccttctctggctgggcacggtggctcacacctatatcccagaattttgggaggccgaagcgggtggatcacctgaggtcaggagttcgagaccagcctgactaacatggtgaaaccctatctctactaaaaatacaaaaattagcggggcatggtggtgggcacctgtaatcccagctactcactcgggttgctgaggcacgagaatcgcttgaacccaggaggtggaggttgcagtgagccaagatcgtgccattgcactccagcctgggagacacagtgagactcagtttcgaaaaaagaaaaaaaattaaacagtaaaaatgtaatgacttattccatacaccaaaaattatgctgaagagaagaaaataatcacagtaactatggcagtgaacagcatttacatcatcatcatagcatcagtgttgaatactgatttatcaaaaattgtggtaaagttgtactgtgaggttgagggttaggaagtatctgtgtatatgtgtgtgtttgtgcatgtgtgtgcatttggtgaagggatggtaaaaagagataaattctcatcttccttaatgagaagtcagtaagtaatagtagaagttaaaagtcaagtaggaacaagatataaaagtataatttagaattctggaagtatataaccaaagaggtggccagaagtgttgaaagtggtgcctttgaaggagctggaaattgggagcagggaggagcagaaaagtgtttttgaaaacaagcttcatttgactctttgacatatatgcaagtacaatttgaattaaaaagacaaacacagtgttaaaaagcatgacaggggaactctgtaaggagtgttggaggtgctcttaatatattgtgaagattttccagggatagatttttgagggtttatggttatcccaggctgtgtttggagaatgccagcaggaaggccaggcgcggtggctcacacctgtaatcccagcactttgggaggctgaggtgggcggattacgagatcaggaaatcgaggccatcctggccaacttggtgaaaccctgtctctactaaaaatacaagtattagccaggcgtggtggcgtgggcctgtaatcctagctactggggacgctgaggcaggagaatcgctgaaacccaggaggcggaggttgcagtgagccaagattgcaccactgcactccagcctggtgacagagcaagattccatctcaaaaaatacatataaataaataaataatgagaatcccagcaggagggtgggactggggagttggtcagttctctggctaccaggaagagctctgggcaggggtgttgccaggtatcactcatcctgagcaggcggtgccctcagtccacttgccagacagcgtatggcagggagagcctggcaaggccaccgggcctcttctgctgacctgccgtgggcagatggggctgccagtgtgggtcccggccctgagcaccacacggggctgtgggtccttgggggccactccaggccctgggcctcagtttcctcatatgtaaaatgcaatcataataatacccgttcatgttggtcataaggagtaaatgagttcatttttgcgtgtcaggcttagaatagtgttatagggctgaggttccgaaaggtattgacaccttaaaaaaaattttcctactaaaaaaaattccaatcctgcagaaaagttgtaagaatagtacaaagaactcccttataaaaggacttcacggccgggcgcagtggctcacgcctgtaatcccagcactttgggaggccgaggcatgtggatcacgaagtcaggagatcgagaccatcctggctaacacggtgaaaccctgtctctactaaaaatacaaaaaattagccaggcgtggtggcaggcgcctgtagtcccagctactcaggaggctgaggcaggagaatggcgtgagcccgggaggcggagcttgcagtgagccgagatcacgccactgcactccagcctgggcgacagagcgagactctgtctcaaaaaaaaaaaacaaaaaacaaaataaaaggacttcacctgttaacatttgccacattggctttttctgtctccacatatacgtagaataatgataacgatggatataaaaaagggtaaaattattaatttcaggagatttcccattcgtatgagacttctgtgacatacagtccatagttaagttgtgccagttgcttcagtgcagggcgcccctccccggatcccaaccccggatctaatccaatccctttagtcccgtctctttagtctcccttcatctggagcaattcctcagccttctttgtccttcctaactttgacatttttgtagtgttataaagccactagttttgttgaatgcccctggattttggtttgctgatatttcctcatgactggactcaggttatgcgtttttggccagaattccacatgatcaggaggcacatgatgtcggcgtgcccagcaggggtgacggtgacgcccatggcctggccgaggtggtagccttttgctgctgtaaagcgactcgtgttccctttgtaattaataagtaatctatgggagatatttttgagactgtgcctgtgtatcgtgtttcccaacgtgttttcacctgatggtttgattgtttattgagcattgactcctgaccaaactcctcctgaagttcagctgcaggtcaacatcttgacgggcattgaggtaaacaccagcgttcattgttttttggctgccatcgtaaaccttagcattaggaaatatattgatttgtatcagagaggttttatttcatctgggacaaaaatgctcttcctgggtttaagtcgaaaaggccagattcattgattcatttgttcactaagtatttactgagtgcttactgtatgccaggcactattccaggtgctggggacaaattgttttcttccggaagctgcatagtagttggggagtcagacagtccatccacctgctgctgtgagggagtgagaagtgaagaggaagcaagctggtggaggagacagaggaccccgaggttagggctgctgttttaccagagctgaccgagcctgaggagctggcctcagagcagaggcctggatgaagcgaggagcagcgtggctcgttgggtaggagggtcagctcggccgtgggagcggccagggcacggcctggagaggagcccatggctgacgcgagttagtgggtcagtggggagccggcgcggctggagcagaggccctaagcgggagagaggcagtgcatgaaggtggaaagagggccagggcgaggtgaccaacagcctcgtagtccacggcaggaagcgcgggagctgtggagcaggggacagtttgagggtggcagctcccacctcagtgtggccctgactgaggctttcggtggagacctgagggaagccaggccccttaggagtgagtgctctagggggacgtggggagctctgagagtcctgcagtcaggttcccatccctgcaggtgcacctcaggaaaggcaggaggatggcaggaagtgagcagttggaaaataagcacctgtggatgctcttgctgctgaggggaggcgggaggggctggctgggtgagacgccagtttccctgcaccctgggtggctggggcaggtctcccacaggcctcggcagaccagggcatgctcacaggccgggtggctttctgatctggagcagccaggagccccaggctgggagcccggctgggtgaccctgcccgcagaacccggctgctctccagcgcccgctctgcctctgtgccctgcccatctctcccccactctcagggagctccactgcccaacccaggcaacggaggcaacagcggagagaatccaagctagcctggggggagcgcttttctccatgtgaggcacttcctgaatctttccttctactgactcgtttaattctcccaacagccctggaaggtaggtgctgttattgttaccccagattgtagaagtcaggagactgaagccacagacagtgtcagtcactagcctgaggttacgccactaataagtgcagagccaggacttgcacccaggctgactggctccaaaatctctgttctcatccaccaagctccactgcagatgtatggatttccctcaggtccactgcaagggccaaggtggtgccgttcagtctacttcaagcagtctcccgcctcttgagatcttggtgtgcctgacctctgacctctggcccatgacctatgacgctgagctgttagagaacagagtgagaagcaagaaagagtcttttgctgctcctcagagagttgtgaggaggccttcatgcccctttttcagggtcagatccggggattcccaggattgggtgacatttatttagcaactcgtgatccagctgacacgttttattgaatgtaaacaactctgtgaggcagatttgatgaccaccctttaataggtgaggaagccaaggctctaagacgttaagccccatgcccaagggtacacagccagtatggagagtcatgtggccagcctggggccagtggccatgtcttcccactgtgctgctgtgccacccagagctgagggcctgggatgtttgatgggacagaagccacgtgcctggtatgtcatctctgtgcatccccactgggacttggaagtagaaattggaagtagcctgtggtgttgcaggagcactggctttagggtgagatggcctcagttccaggttcgcctctgccacgtttcacggtgtgatactggatgactcttttgagtcccagcccaccctcttcactgacgtatgaaagcggggttaaaaccacctatgacctcagaccaaatatgaaagtataggttgatagttcttagccgggttttgcggtgtgtgagtgagtatgaggacttcgtggtggtgaaatgtgcccgctgggttttcagctctctcgggtttccctgggagagcctatccgaacccagattaagaaagtcagagggaaccatgggtcttttgagaaagatccaagctgatttggaaatacccctaagatctatgttaaaacacaatgtatacatgttagagtaatgatgacaattgtaccagatgtttttaaaaataaaggaaaggacttaaccaaaaccaggtggttttggaccaggaagctagcctagagtctgtttaggaaaactgcaagacatccttctagtttaaaactgtgcttctcacctggggacactttttcctttcaggggacacattggcaatgtctggagacattttgggttgtcacaacttggggagggtgctactaacatcccaacagaggccacagggatgcagctgaacatccttcaatgcacaggacagcccctgcaacagaattatccaggccaaaatgtcagtggtgctgagattgagaaaccctggattaaacatcacagcacttatgtggtgtttactgtgtgccagacattgttttaagaacttcacaggtaattgacttgtttaatcctcccagccttatgacacaggagcttttactatcctcatttggcagatgaagaagtaggggcaccaagaggttaaacagctgaaccgtgctcccgggtggggccaaggtcccattcagaataaggagcaggcagagccaggacttgaactcagtctggctgcagagtctgtgcctggaaccactgcgctctgctgcactgcccatcattaaggggactactgggctttaaaccatatatatatatatatatatatatatatatattttttttttttttttttttttttttttttttttgagatagagtttcactcttgttgcccaggcaggagtgcaatggtgcaatctgggctcactgcaacctctgcctcccaggttcaagtggttctcccgcctcagcctcctgagtagctgggattacaggcatgcgccaccacgcccggttaattttgtatctttagtagagatggggtttctccacgttggtcaggctggtctcgaactcctgacctcaggtgatccgcctgcctcggcctcccaaagtgctgggattacaggcgtcagccactgcgcccggcctttaagccatattttcagctttgggtccagaaagccacatacctagaaatttggtatgtgagaagagttagagacctctcattcctgtgcctggaagatggagcaggaagggctggggtttgcctgatgaggggcccagtgacccacaggtaagaaccttgtgttttccagattctgagtgtggctcagctcgtgaatgcagtggcacaaggcactctgtgggagtggatcttgggtgcatgatcctcttggattttggcttccctcagggaatcaaagccagggtgggagttctctcctcaccgtggtgcctgtggcatagagagtgggcattgcttccctgtcacgggctgtgctgtatcattgcagatgtaaagacgaccgtggtttaccctgccacagagaaacacctgcagaagtacctgcgccaggacctccgcctgatccgagagacgggagatgactacaggaatattactttaccccacctggagtcccagagcctcagcatccaggtgactggctgcatgtctcagacgcagagcactgctcccgtggctggtgcctcctcttacgagtgtctattggggtcatattaggggccaggcgctgtgctgggcgaggggatgggggtacagtagagagcatggcggacagaatccccacctcgtgcagcttacatcccatgcacagtcacacggtgtgtgaccatacacagatatctcaggatctatgtgctctgtgagataatgagggctgcagagagaaatagacaggataagtgggaccagaaggcctggggcgggcaattgccattttatatcgcatggcgagagaaggctttgggggtgggggaactgatgctggtcttggtcccacctgatgtgcttgggcatgccatggaggctctctggggacctcaaagcaatccagtcctttggaagaatgtgtgtctgctctgcagtagccttgatccagcctcgggatgactgtgccattgctttgggtccatgaatgggtaaaaggctgatgttgagtgagtcccaccctgtccagactcttattcctggtttcacctgcggcaaaccggcctgcaggatctcagtctcagaggaaaaactcttccctcaccgactcccccttgcattcgtccaaaagaaggcaggaccccattggccccggggatttggtgcagggactccattcacaagctggcagtcgtctggccaggccagatgcaaggccatttagctccaagatcctgactcctccctgggcctaggcccagcgccaactggagcctctgcctggaactggccccatgtgagtactcagagttaaatatgactgatgcttattgatgagtcagtttcttgcccactcactgactctgacactgtgccttgtctttatcactcacccttgttctcttcgagcatttctcacttttctccccaagattcaggtcactgtggtggagggtgttgtgatgtgaggaactcacagccactcctccctggcccagaagaagggagggtacgctgtgtgtgtgggcactgcaaggtgaattgtacttgacaggagtaaggaaagggaggctgacagggcctgcaggaatgaagtttccttgggagacctgtgtgccgccagcccccttccccagcctggttcagccctggtctccctgggcagcagtttgcgtggggtgcatctggctcaagctgacttgtttgttgttgttgttgttgtttgtttgtttgtttttaaagtcccagcacttgttctgttttccaagtgaaaaggaactatatctccaccttcttagagtttctgctgttcagggtcctagggaatctcctggaacagttgttctgttgtgctggttgtgcagacctgagattcaagtaaggaagccctgatgtggttggtgtgagtagctgggattacaggtgcttgccaccatgcctggctacttttttgtatttttagtagagatggggttttgccatgttgctcaggctggcctcgaactcctgagctcaggcagtccgcctgtcttggcctcccaaagtgctaggattacaggtgtgagccactgtgcctggccatgtatattccttattatataccattatgcagttccattcggagaagagcacaatgaaaactccactactcttccaactcctgactgacgggagccgttcatgtattccttcttggctatttctagtttacaagcactcagcttaactggcaacactcattatgtttactgagtacctactatggacctggtcctatgccaggctttggagagtcaccaagatgatgaaacctagacaggatcttcacagtgtaacagggaagatagacttgtaaacgggcaattgtgacaatgggataagcactctgatgcctagacgaactaccgtggtgatgcagagggacagtgaccagcgcagacagttgggacttcacagggagaggatcctccccttgggtcttacaggacaaatagaagtttaccaggtgcacaaggggagggaggagcaagtccagaggcacacagagctggaatcatccgatgctttgggggagctgcaaggagtttggtgtgactggggcttgggctgctggagggtcagaggagacagcactgagatggtaggcaggggccaggcggaggcacgtggactttgtccagggggccaggagttcctgaaccttgcttaccatcaggattgcctgggggttttcataaataccgagcacagagcactattccatatctgctgaatctcacgcttcagggagtggagctgggaattctctctctctctctctctctctctctgatatttctgacaaccatcagatgtgagaacagttgccataggcagtgagggtgccctaaacggttttaagcatgtggatgatatggcccgatttgcagaattaattggtggagtgggggtgagcatagaacaggaagactgggaaaaaccagtatgggtctgaaccaaggtagggacagtggggaaggattctggagcaatttaagaggtaggtcttcacagggctggatggggcttagcaactgattgacgtgcagaggggagggaagaggttgggtgatgagtggatagaaggataattcatgacccagtataggggacagaaacagaagagtgggtttgcatggaagacagtgagttcagtttggaattcattgagcacttactatgtatagtccaagaactgctctaagcatttatgcgcatcacacctcatttatttatttatttattatttatttatttttgagatggagtttcactcttgttgcccaagctggagtgcaatggtgtgatctcggctcactgcaaccttctcctgccaggttcaagtgattctcctgtctcaccctcccaagtagctgggattacaggcgcccgccactatgctgggctaatttttgtatttttagtagagacggagtttcaccatgttggccaggctggtctcaaactcctgacctcaagtgacctgcccaccttggcctcccaaagtgctgggattacaggtgtgagccaccgcacccagcctcacacctcatttattcttcacagcagcccttttggagacaggtctcaaagccaggcagtctggtcccagtatctgtgccctaagccagagatactatttggctccttagatgtgaggtacttataacttcccagtaaaaactgcagtgggatgtctggatctggagcctttgagatcatctagttacaaatgtctgtttgtgagtcatccagctagacttcaacctcagcctggtgtttggattctcagtctgtcatctaagagcagcgtgacattgtccttaatttcggagccctggtttccttgtctgaaaaatgtaactaatggctcctccctcctgggtgttgtggaaattgagagaggtgccatatatcatgtgcctgctattgtttccagcacagaatgatgccaggatggcagccaccatcccctactctaggtaactgttcagagggacaggcacagcaatgggcagagctaagacacctgggagacgtggccaggccacacatggctggaggggaagtgcaaggcagcaggcagaagcagagagcaggaggtgatgaggaaggagcaagatgtctcacgggaggtcaaggcgggagagagggtaccgagggagctgccaatgtcacctactgcaaagaagtccagccaggtgagttgcagaaagctgatggcatcaccctctgcccagtttatcagcagggctggccaagttcttgggcatggtttcagatggtggcactccccattacatagctctctgtgtttgtgtgaattttgttctttcattctcctttttttttatctgggcccctggcctggaggcttcccgtggatgcagctccctgccactgtcccagaggcctctcccaggagacaggatgtaccttggcccagggtgcaggctcaggagccagatactcatggttggaattggctgacccagcgtgaacttccttgcacttgcattcttcttaactgtaaaatggggacaatgtccaggcgcggtggcttatgcctgtaatcccagcactttgggccaaggtgggcagttcacttgaggtcaggagtttgagaccagcctggccaacatgacgcaacccatctctactaaaaatacaaaaattagctgggtgtggtggcacacgcctgtaatcccagcttcttgggaggctgaggcaggagaatcacttgaacctgggaggtggaggttgcagtgagctgagatcacgccattgcattccagccaagtgtgaaactccgtctcagaaaaaacaaaaaacaaaaaccaacaaaaaaacctgtctctactaaaaatataaaaattagtcgggtgtggtggtgggcacctataatcccagctactgaggcaagagaatcgcttgaacctgggaggcggaggttgcagtgagccgaaatcacgccactgcactctagtctgggcgaaagagcaagactccatctcaaaaaaaaaaaaaaaaaaatggcgacaatgatagcagccacctctcagggttgctgtgacgctgagagcagtgccaggcagagtgcagctgctctcacagtcatcactccttcctgcagtcactcgtcctccagccccgctcttatttcctctctcaccacctcctttgctctcaccgcctttccctcttttcctgtccccagtcagttttgtagcctctggcataccatcccaccacctttgccactcgtgggggtctcccttatactggctgtgctaggtgctttcatgtgcgtgttctctgaaaaccttcaccacccttatgtagatatcatcagccccattttacaaaggaggcatcagtcgctcacccagtgacagctgggagatgaaaccaggtctccttggctcagaacctgttcactctcactcttatactagtcacaggcagatgccccttttctgtgaatcagggactggccgtggggaggcctgcttatggggtgcgttggggctgtctgtagggaatgccgtctccctccctcccttgtatttccgctggcttcctctggcatcacattcccaggagatttcaggtcagagaggaaatgcctctgtggatgtactggccatgcattgctctggccccggcactgcatgaggaagtggctgccaggtgtcctccagacccctcccaggaaggggcctcattcggtttcttgggaactgcctgtcttttgttgtgaatggaccacattgtgaccggcctgtgggtcttgtcaggggtttggggccctctgagctgaaatgcttcctgtgggtagagagttgcaggagacctcgaggcccagctgccctctcccccggtccatcccagctgagaggcgaggatgcaatgcagtgtgttcagccctccaggctcaaggtgtgaggttgtgtggaccataaggcagtccccgtgcctctagccttcggtgatgctacctgtccagcacttctgggagtggaaggaggaccatggatggctgcctggtagtgtcggttccctggcctccccatcccacctcgtgtccatggctccttctcctacatcagtgagctcggagaccattctgactgtgaggaggaaggggcagtagtatgtcctcagccactcccctctctggtttcctagcaggtctctcccccagatgtagggcagagttcactgtcctgcatgagttcatgtttgcaaagggccctgagagccgggggaagtagaggagagctgggggtactggggtttgaggcctgtgagctcaggggccttctcagcccaacctcctgcagcctcctaacctcagacaggcctccaggaccatctctgtaaagtaatgtccttgggtcaacacaggcctgggaaaggtcctctgcagactgttgacagcagctgatccaagggtgacacaagggctgggagccctgggtagccctgaaaggtcttggtgaggtcactgtctctgtgtctctacatagctttcgtttctgctttgccatgcggggtctgtgtcagcagagactgctgataaaccggcatctgcagcggctccaggcgggcagaggtgctgagcccactgctgatgagaatcccagtgcggcgggaaacgtgcacacatgagctgctagaggcaaaggctctcactgctctggtgggtagctggcccctccacagaaggaaaccgtggtgccctcagcctcctacctctctttgccccatagtcctgaatagagtgaaataggatccatggaggcagctcttcccctgagtcctgtgagcggtggagggggtcactgctatagagggcagacacagcctgggtttggaggcctccgcagagcatgtgcactatgctgaccaggaagagcctggccccttccaagctgcagagacccttgtgatgacgcatggctgagtgccagctggagtgggaagggggaagtcccttctggacccctaagaacagatgcttggggacagggcagcccggatgtagatcctctgagcgtggcggccttttatggcttggttctgtctcctggagaggccagggaatgccctgagctcagtttggggtatctctcaaggggtgatgagtggatttgtgaaccatctctctccccctcctttcagtgggtgtataacattctcgacaagaaggctgaagcggaccggattgttttcgagaacccagatccctctgatggttttgtcctcatccctgacctcaagtggaaccaacagcaggtaaaggtttctggctggaatgtcctgatctctggccaccctgctgtaagtgctggtccttctgactgccctctttctcacgctggcctgtctctaagcagattataattaaccaacaagggttggcctgagctctctgtggggactgggtggatacctgtcatacataagtgcttttgctttaatgggtcagcttaaagccctttctggctgtcctcccacccaagaggtaaaatggggtgatgtttgtgcccatgactacataggccattccttaccagccaagtggtctgggcagccacctgtgcttccacccgcatctggagccctcgggtggggtgtttccattttctccattccccttgacaccagcagatccaggcaggcccgtgttctgaagcactggcaggcaggaaccatggtgaccaacccaaggcatctcctcctcagcccgagctgtggagtagcttagcccagacttctactcaggccccttggccccgtgccctgcctccaagcacctctgcttctcctactttcctaaggagcaggtttgggaggagccgtcctccctcacaggtatccctttccagttccctatggtcttctgtctctcccagaccagcccaccaccagagttatcacttaccaccacctcttttatacctgagagtatcagaagcttttataccctgacagggtcagaaacaggcagagccactgtgttgcagagagtgctgttcttaacacagactggaacctggctgtgctcagcctgcaacagaagaagggcctggataaggccgaggtaggcaggcaggcatgggtgctgggagcagacagacatattctctcctgcactttcacctgtggagtaatccaggctcagatgtgccgttctgctttcggtgggcccgtctagtttctgcacccgtcaaaggctggagagactcttgtagagaaggtgccttggagtgagcctcgtctgcccctccgcgggctcgctccctgtgctttcccagttgtggctgcctatgacaccttcagttttgacgtggggtaaaggggtgggattgtggctcagggttacacaggcaagtgagcataattcgtctcttgacaagaggcttgtgggaattcccaaatgtgacccaaggggtgggaaagaatttgaagggattttccgaagttgcagcattgatcgatgattccctagagccaagtaagttcaaagaagagggctctccttgtgtggggcgctgcagtgagaggctaaggggacgcctgcatccactctgcccttccctgcagcttctctctgcctgtgccaccttcaggccttgaaggagggagccaggactggctctgtaggcatttgaagaggtaggacctgatggtcccttgtctcaaactgagtggtggctctgcaaacccccatctgtcttgtggggctgccctgcacctagagatccggggtcagagcctgggtcacaggaggcggggcccaccgttaatgagaatcccagcagggccatagaggtgtggggtaggaggaggaccttctgccgcaccagactcttgaagactgaagagcttgccaggggatcgcagtcttaaggtcatggagggacaacaatagacttgtccgtctgtattccagaagccctgaatgcatttgagcccacggcagagaagagaaatctgccgtccttctgaccccagtgcctccaggctctgcttcagctgccagtggaacctccctttttctgtcccctttaagacaggaaagactttaggagctgcactctggctgccagccacagggctggaattacttgtcctcaagggtcatgaaagggccagcttaaacgtcacactttgcttcatagcgatgcaggtgtggtccttcttaacatttgcttaattctttttttttttttgagacagagtctcactctgttgcccaggctggagtgtagtggtgtgatctcagctcactgcaacctccacctcctggattcaagcaattctcgtgcctcagcaacccaagtagctgggactacaggcgtgagccaccgcgcccgaccttaattcttacttgacttttgatgatgctgtattttagcgtctcaaatctttgacttgtgacagcactgaattggtagctctctttgaattaggcaatgtatccagcaggaagataggccatgcctgggcttctatcctttgtctttgggacagggaagggctggggatagggaggcaccctggtgtttgctttgaggagctttcctagccaccttgaatctcctcctgccactggtcctggaagttactgtctccaaactgatgcccctgaattaaagagataatccattttttcatccattcaacatgtatttatcaggtgcctgtttgctagagactgtgcctccttagaggttataacatcccttcttctgttctcttaaaggatcacctgtgtgttctttttttttatttgtttattttcttgtaggtttagttcatgcatgtggcaaaaatgcacacagtacagaggatattcagtgaaagtatgcttcctcaccccacagcccttcctttcccttccccaaaacaactattgttgctatttctttgtctctggtaacctttctatattgggtatataaacatatatgtacatgtatatatggatacacatgcattttcagttcacatgatttaaattctttggtctaaagttctcagaccaggcaactcttcctttgagtcaccccagaggttaagagatggctctccaacgctccagcaattctctttcttcctgccaggaaactattactttgattttactgtcttgacttgtaaaaagagactgacgatgtctatctgtcttcccagagtgactgatgggccaccttctggggcgccagcctgaggccctttcctgcccctgggctagcttttttcagatgacttctctgagcgaggaggcctttggctgccagcaggaaattttgggtcatgtctaatatcaaagaatggattattttccctcccttacccagcctgtgaactgacacccaacaccatgggctgacacccagcaccaggctccatgccctattctgtgccagtggagcagagagttgcgagttagcgtcgtgtttgtgatttgtcagcagacatcatctaaacaaatgttactattatttgggagtttggtgacagtgacgcatagaacagccgaaaacatacaccttcaccaccacgtgcacacgtgcgcacgcacacaaattcaagttcaagcaattttgtttctgggcttctctttggactcctaagtccaaagtgagagaatacatttcttggccacaggccatgagagagtacacaggggacttggggcaaactgaggcctggtgcatgtagctcagctacacgtggagcttcctgtgggctcatctgcagaaggtctaaggcagagaacacagattcttagaactctggcaggaaagaatgttcatggcatgtaaagaccatggcatagttggatatcagccagtcatatagaaaagcccatcctgaattttcaatttgaggccccaggaaatgtggttgggtgagtcatggtcctcaaattatcttcacaaggaatctggtagctcagactgcagggcagggcactgctgggttctccccgtgcctggcccctcagagccttgatgtctggggccttccaggcgcatggatggaattaccaggcaaggccagggtttaggtgagcagggtgggttttctcagcaagaggaagagttcatttgctctctggcacaagatcttgactttgattctttgtactgttgtgacctccaggttttcagccaggttgtgctcaggaaggacagcaggaaggtatcctgtgcgataggggaagagagaaacaagctaactgccctggtgttgtgtgtgctgctgagctggcccttggctcccttctcagccttcagaccccactccaccccttcatgggccttgactccaaacaaatcaagttgcttcctctccccttccgtatacattctatgccctatacattcttgcctccgagtctttgctctgtttcctctacctgaataccctttctccaaattctaccttttttctagacctgatcctctgccttctcttccaggaggccttcctgggttcatccaggtagctagagtctttccttcctcctgcactgggattattttgtgtcttacagtagagctacttgcatacatgcgataagactgtaaactctcggagggagagagttgcccttgctctttcttgaacctcctggctccctgccccgacagctctggggagtgagcatatagaactctctgctgggcgcggtggctcacgcctgtaatcccagcactttgggaggccgaggcaggcggatcatgaagtcaggagtttgagaccagcctggccaatatggtgaaaccccatctctactaaaaatataaagagcatggtggcacgcacctgtagtcccagctacttgggaggctgaggcagaagaatcgcttgaacccaggaggcggaggttgcagtgagccaagattgcgccactgcactccagcctgggcgacagagcgagactctgtcaaaaaaaaaaaaaaaaaaaaggactctcacatggtattctctagcaagaagcgtacacagtaggcctgctccttaagaccatcccacacgcccggggtatgcagatgccctgcggggtttctcctggtgctgtaggcctcaggggtgggtgcttcctggcttacgtgagaactccagggttggcagcctccccaggtctgttccctgctgagcctggtctccccttgctctctacgcagctcgatgacttgtacttgatcgccatctgccatcgccggggcatcagatccctacgcgaccttactccggagcacttgccgctgctcaggaacatcctccaccaggggcaggtgagtggcttcaccaaaccacgtggaagctcagagaaattagactcagattccagtgtgttcctgggcccctttcctcacctttcccagagtccatcttggagagacttctctctggatgccagtcttggggaccccattaggctcttgaggttgaagagcagggctctttgtccctggtcctgccacctttcctcaccctcacacgccttcctcggcctttctccatctgggatgcacttccacccctcaccccatagactctggtccttaagtcctggcccctcctactccaggatcacctgtctctctcatgacaaccatgacaaccacatcatgccagagtttcttgggagtatgggcacatgacttcgatatgtgtgtacacgtgtgtctccttgtctagattgaagacaggctgaattctgtagcacctggtgttctgggatactttctctctgggatatttgttgaattgaatgaaattatcggggctctaaacagagcccaggagcacggggagatgggggaagagtgtctagaatcttgggtgtggtcctggcctgacatttggaccctaaccagctgagtggcctggggcaggtcacttcacctccctaaaccacattatctagatggatcccttctaaatccaccatcctaaggggctgggtctgagtcttttttccactctgaaatgtgatgctctgcctaacacgccagagctagcagtcacaacgatgcccagccaggagagaggtttgcccctttttgaccagtgatgcttcgaggtgttaatgcagacctggaggcaaggctctgcccatacccagcttcccctgctgctgggccccgatctatcttccctcctgctcacccacggcaccaccccttggctgcctttatctttgtggggtgacttgttcagatcctgaagcagtctctggatattacaaatggcaaagaatggtgtctttctcttggggagatgccaggccaacactttgacctgccctagcagctcagacagctccaccctggcagacagacctcacttactccaggaagcccctcgggtgccttggccctggtctcgccccgctgcagggattcctggggtgagctccaaatgcagaacacagttctggggtatatactgagcccactgaggccctagtacttttctcttcacctctgaccacctcagggatttgcccacaatggagatgagagtctccgcttaattctatgcctcacagcctcctgaaggtggaggttggtagaaaaagacccacccctgagcaaggtggaggtgggcaaagggagccagggccaaagtcaatgctttcctcttctgcaaggagcccgctgagacttcgccaggtctgtgtgggagcagcccctcccataccccttccacagtccctgctctttcaccaagttctcagcatagccccatccccaacttcattgtttccaagctccaccctgtgctatgctaaaagagagaatgaggcttcctcccatccacttcatgactgatgaaatgcttctaaatcatgaaagtccccatagtcttgggaatctggggcctgtctgtagacactgggccttccaagattcccagcagcaactgtttgaggaagccagtgttttttccacgttggggtggggaatgctgattgaggccgctccccacttcttttgggagagtctcagctttgctgctgtcacctgcacttgtggatttcctagactagaagacagaggaagctgaagcagacagcaggtagagagctgtttggagggtttttgtgagctgtcccaggccaatccaggattcagatgggaggagggtctaggtggggacatggcgccgggcctcaggcagcacggtgactcctgacctgcctgcccctgtctcatcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctca

SEQ ID NO: 2104 - DNA, 10091 bp, Homo sapiens
cgcgctgctcttccccgcggagcccgcgcagtccgcgcagccctcatcgcaactgggcccgcgcgcaggtgagcccggggcggggtcgcgggggaccgggaggcgcggcggggctccgtggggtgggcgacggagcgcggccggcctgggccccagagtcccggccccaccgagagccgcaggggtgcgcgccgcctctggtccggccttgccctgctggcggcacatccgcttcccttcttcacctttctggcacccgcaacacgcaagcggcatgaaagggccctccgaggagaatgtcaccttttctgtcgcaaagaagctcgcgcggggcggctcccctttcgcttgcctcgctggaagagcctggcgctcagtgcgttgtggatatcgtttctcctcacgttcttctctgctccggtcacagcctcttcctctgctcttcgggttgtcattgtggcagtgattcagcaagtgcataacattagttagggtcagggacctatcgaggcattacaccacagtcatgggcagctacacacgggctgggcagccactgtgccaacgactagggtgaccgcggtggaccagacagatccagtcttctggtccccaggggacagacaggtacgctagaatcacagcataccctagaagtgcaacagagagggggaagtgtggagaactcccgttgaaacaccaaacctaggggacaccaggatcaggaatgactcagagggaaccacatctagttagtttttagatttaaaagagttgatacgtaggcacacaaatcctaagtgtacagctcaaccattttccacaacacgcacatttcctgattcagagcaatcaataaaacatgactacatccctggcttctaacgccataaaataggtttgcctgttttggattttccatccatggaatcatatatcatgtacttcttttttttttttttttttttgagatggagtttcgcctttgtcctctgggctggagtgcagtggcgcaatctcggttcactgcagcctccgccttgtgggttcaagcgattctcctgcctcctcccgagtagctgggattacaggcgcctgccaccacgcccggctaattgttgcattttcagtagcgacggggtttcgccatattggccagggtggtctcgaactcctgaactcaggtgatccgcctgcctcagccttccagagtgctgggattacaggcgtgaaccactgcgcccagcccttcatgtactcttacgtgtgtgacgtctgacattcagtatgttttgtgatattcacccatgtttagttagcagtttattcttgttggtatataatattccattgtatggctagaccacaatttatttatccattctactggacacgggttgatggacagtcgtttccactgtggggttattttgtatcttgctgctacagacattcttgtgaatgtcttttggtaaacatctgtaagcaggcggggaacagtggctcacacctgtaatcccagcactttgggaggctgaggcaggcagattacgaggtcaggagttcgagaccagcctagtcaatatggtgaaaccccgtctctactaaaaatacaaaaatcagccaggcgtgatggcgggtgtcggtagtcccagctatttgggaggttgaggcaggagaatcgcttgaacgtgggaggcagaggttgcagggagccgagattatgccactgcactccagcccgggcgacagagggagactccgtctcaaaaaaaaaaaaaaaaatatgtaagcactgctgtttgagtatattcgtaggactgaaattgctgatgtgtgtatgctcatcttagtctatggccaaacacttctccaccggcagtgttcgagttcccatccctgcacactcttaccactacttgatagtctttttctctgtagccatttggctgagtgcccagcagtgatgcattgaggttttagtttgcatttctctgatgactaatgaactgttttgatgtctattgctcatttgaatattccttttgtgaagtgcctgctcaattcttctgctcatttttctgtcgtcttactagttccattgagtccttgaaatatttgtgatataagacatttattggatatatgtgtgtgtgtgtatatatatatatatataatatatattttatttgatttttgagacggagtctctgtcacccaggctgcagtgcaatggcgcagtctcagctcactgcaacctccgtctcccaggttcaagcgattctcctgctttagcctcccgagtagctgggattacaggcacctgccaccacacccagctaatttttgtatttttagtagagatggggtttcaccatgttggccaggctgatcttgaactcctgacctagttatccgcccgcctcggcctcccaaagtgccgggattacaggtgtgagccactgtgcccagccctggatatatatttttaaacattttaaccctcgggagattgccttttcactctcctatttatgtcttttgatgaacagaagttcttcattctaatgttttttattttatcattttttccccttatagttgtattatttgagtctggtttttaaaaaatcttccctagcaagaagactcagataaaagtaaaattaaagctgggcatggtggctcatgcctgtaatcccagcactttgggaggctgaggtgggcggatcacttgaggccacgagttaggagaccagcttggccaacaaagcaagatcctgtctgtaccaagaaaaattaaaaaatgaaaaaaataaattaggtaggtgtggtggctcacgtctttaattccagctactctagaggttgagatggaagactgcttgagccttggaggttgaggctgcagtgagctgtaatcacaacactgcactccagcctgggtgacagagcaagaccctctctggaaaaaaaaaaaaaaaaaaaaaaaaggtcgggtgtggtggctcatgcctgtatgtaatcccagcactttgggaggttgaggtgggccaatcacttgaggtcatgagttccagaccagcctggtcaacatggtaaaacctcgtgtctactaaaaatacaaaaattagctggatgtggtggcgagcacctgtagtcccagctactcaggaggctgaggcacaagaatcacttgaacccaggaggcagaggttgcagtgagctgagattgtgccactgcactccagcctgggtaatggaatgagtctgtctgaaaaaaaaagaaagtcatgggtccttctcacagtcccaggtgtgaacacagggggccaccctaggtctgcaccatagtctacaaacctctttgagaacactgtgttgtgtctatcaagctataaatgaattatattcaggactttaagtgacattgtcctgcaaaccataattaatcctacccaaacgttttagcaagtgtttgagaacaaaacagcctttgaaaccaaaattcttttaaatgtaaagtcaaagtcaggtgaagtatagatggtaatttatttatttaaagatgtaaaaactgtttcaaacaatttgaacctttaaacagaccaggttttagcactcaactgaaatccaatactttctccattcattggcctgatctaatcagacacagtgtagtagtttcctattgctgctgtaacaaattgccacaaacttagtggcctcaaacaacacacattgattatcctgccgttctaagatgggtcagcaaggccgtgctccttctgaaggctccaggaaagaacccatggacttgccttttccagcttctagaggccacctgcatcccactgccgcctgcttcccttggcacagctctttcgtctgcctcagaccttcctgcctccctcttgaaaggatctttgtggttacattaaactcacctgggtaatccaggaatccctccccatcacaaggttcttaatcacagctgccgaatccccttttgccacggaaggtaacatattctcagttccggggattaggatgtgggcctctttgtgggccactattctgtctaccccagatagtgattcctgcttaacagaaatcgaatatgaactctaagagatacatattctaattatatgccttcacaggctccagtacattccctatataatagaaattggagaccagtttgatattggatactaaatacactttggatttttttttttttatttttgagacttgagtcttgctctgttgcccaggctggagtgcagtggcatgatctcggctcactgcaacctccacctcccgggttcaagtgattctcctgcctcagcctcctgagcagctgggattacaggcacgcaccaccacgcttagctaatttttgtatttttagtagagacagggtttcaccatgttggccaggctgatctcaaattcctgacctcatgatccgcccacctcggcctcccaaagtgctgggattacaggcatgagccactgtgcccagcccactttggattttatacagcaaaactccataatgtttcctttacatcagtttctgcacataatattggaaaagcattctagaaagcactaaaggtattgtgctacttcttttctgaagaaattctttactaattttcttttctttatttttttgagatcgagtctcgctctgtcacccaggctggagcacagtggtgcaatctcggctcactgcaacctctgcctcccaggttcaagggattatccagcctcagccacccaagtagctaggattacaggtgtgcgacaccatgcctggctaatttttgtatttttagtagagacagggtttcgacctgtcggccaggctggtcttgaactcctgagctcacatgatctgcccacctcggcctcccaaagtgctgggattacaggggagcaccagcacacccggctaaattttgtatttttagtagagaaggggttttgacaggctggtctggaactcctgagctcacatgatctgcccacctcggcctcccaaagtgctgggattacaggcatgagccactgagcccgttccctttactaattttctatcaagtcatagttcttacaaagtgggtatttttggtatgattctactttatgaattttttcaaagcacaaagaaagcgactgcgtattagaccacacagcaaatcagagaataggcagagctagtgagtagagcttccagttggagatttgggttcattaccttacctacttgtcaaccacatctcaagatatgatgacagttaccaggtcttggaaagattaacacgtgtttgaatatgtgacagttccacagctccagctacaaaagaactgaaaaggaacagggaaggtgcatggcgtcttggattccaggaagtaggcagtgtgtatggttactggaatttacctgccatcttgctcaattatcctgtcaaaggtgctgttatttttctctttaaaacgtttccatgtttctcatgagggcttataccaccgcacttctggtggcatatactgctggacaactggatttcttcttaaccaagcaatggaaaagcaatttcccccaattagcatgcgttgccaaaagggcaagtcatttcataaaatgagaaactgaaactttaaaatctacatatattaagtagattaacatattatgttaatttttaacctttagaatatttacaaatcaaatgatgctctagtttacaagtgcaccaaggccaaataattaatattaaaattaaaacagaattgaaaaaatatttaaaaaatgcaaaaaccaagtgacatcatgtttactactgggggcaaaaaggcatcctgaacggccctagctgcagcctaccacttaggctgtctgaaatcccaagcatattaggaaagaaaagaaactcatatacatactcatagtcaacgtccagtgccgttttggtggcttcacatttagctgtgttgctttttcagatgtcttctctggttcctgtacccattccaaccctttgctctgcctcctttgctgctatggtttaagttctacttcttttttgaactttgatatatgatcacaaatcctcagcatcccttgtcttctacgcatcagtgaacaaagcattaatgtgcagcatagaatgacattctttaattttttttattgagatggagtttcgctcttgttgcccaggctggagtgcagtggtataatctcagctcactgcaacctccgcctccaggttcaagagattcttctgcctcagcctcccaagtagctgggattataggcgcctgccaccatgcccagctaatttttgtattttcagtagagacaggggttttaccatgttggccaggctaggcttgaactcctgacttcaggtgatccgccgccttggcctcccaaaatgctaggattacaggcgtgagccattgtgcctggccacattctttaaattttgaaaccttttattttagtgtgtctaataatacttgcttccatgagttctcaggtttgttttgatctcacagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggcaggttgcctttctaagggattcttgggcctttgtatttccatataaatttagaagcagtctgacaacctccccaccaaaaaacctaaaaaacaaaaatcttctagactttggaacagcactgaattaatgatcagtttgggaaacgttaacattacaagtttaataaaccatgaacataatatacccctccaatatctagattattttatatacatagtagcccacattttctaagcatttattacatgccaggcaccattaggactttacataaatgatttcatttaatcttcacaataatgctgagaaggaggctctagtacttccatttcacggatggagaaacgagtttagcaaggtggccaaaggtcacggttaaccagagatgagaatcaggcactctacctgcagtctgcagtctgtaccactttttgacatgaccttcctgagctgacggctgcaggggcgatgggtctatggatggagttattcagggggaggcagacttggaggaaaagtctcccaagatttcctgcatgtgctctctctctactgttcagcttctgtctatctggatacataattatttgtccaaatagcaactgtccttcttctgccatttcaggccttacataggaagtccttctaaagagctgcctgccagctgcccttccccagatcccgaatatcctcctggccaggtggagcagagaacagttcctcagctggtcatgctgagctcataccctgtaagtctgaccacactacacagctttggctttatctagaatccagctccaatcacagtcgtgtctggccctaatctcatgaggaatgaaagacccatttagagaagaagcctctgtcaggcattaggagagaaacagaacttcgcagagctcatccatggggaatgagagcagggtaagtgcagcctttgtgattctctctctctaccctctgtaggatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctggtgagtggaaccggactcgcgactctgctgtgttcctgagtgtagtgctcagcctccatagggcgcggtgggaggcctgcctggtccaaactcagagagacgcaggaaggctgacgtggggaactcctgacctgaattcagggcctggatgctttgtggagagtgaggaggggaggcctgcgtcagctcagccagatctttatccttttggctcaaaggttttccaggcctgctcagctagctttcctagcctggaaaccactgtgctgagtgcttaacactgtctcttgtcgtccaaatctttgttccagaaccatttagaggagaagccaagcagagagagaaaatgaatcaatccccaccacaactatctgtccttatcaaaggctggggaagctgttttcatctccttatggagtcccatactccaaacacagacctgagcagtgtttctcccccacagactggttcaggcagaccctgctgaagaagcccaagaagaggcccggctccctgacatacctgacactgcattatctcagttaactttcagcaactaagacaggtccacaagtccacagtcaaagccgtgtccctgactccagagtgtgggttctgaatcacgaagctctctgctcctcagcaactctgagcagtagcctcttccccatttagcgacaatctaggatttcttggggccaaacagatgccagtcctccgtaccccttccttcctgtatacgtagcccttcctaatctaagtccacctcccctcagtgctgaaagtgggctttgggactgatggatccttgctagcataacgtagctctgcctgcagactcccggtggttgactagtcagctctagtgggaagttctgcttaaggtgggctgggctgggggtaccagatatcaaagggcctggagtagtgcaaggccatttctcttaaccaggctggtggaacactctcacataaggattccagagttctgacacgtccaaaacctttacctttagagggcacttttaggcaagtcccaaaagataaacaaaaatagcagagtgctgggcacagtggctcacgcctgtaatcccagcactttgggaggctgaggcgggcagatcatgaggtcagaagttcaagaccagcctgaccaacatggtgaaaccccgtctctactaaaaatacaaaaattagccaggtgtggtggtgcatgcctgtaatcccagctactcaggaggctgaggcaggagaatcgcttgaacctgggaggcagaagttgcagtgagccaagatcgcaccactgtactccagcctgggtgagagtgagactctgcctcaaaaaaaaaaaaaaaaaatagtggagcaacaggtctctgagaataagatgtttcccagtgcagggaggtgggctgcagtctgtctgtcctccctgtgaggtggggctcctccctgtgtgggcagtgagagggcacctggtaacacacaggcctgagcagtgtttctcccccacagactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttgtaagctactacaggagggagaaggggaacgggattcagctacagtatctgatctactttgacttttaggagacagccctgtagcctagtagttcaaagcgcagcttctggaaaaggctgt

SEQ ID NO: 2105 - DNA, 9094 bp, Homo sapiens
gagaggtcacggggagacggccacctagagcattgggcggggcagagccctgagggccgctggccaattggcgcgctcgtctgaatggcgtttggcgcggagcagtgacggctgcgataatagcgaggcagcagtgcagctttcagagggtccgggctcagaggggttatgattcggagggttctgccgcacggcatgggccggggcctcttgacccggaggccaggcacgcgcagaggaggcttttctctgggtaaagttgaggacgacagagggtattgtggttctgggttgtccccaacctccgactgtgtgtccttcaggacccgaaaccatggcccacactggcaggacagtgggtcggcttggggaagggggttagcttacctaccagagcttgtaggggctgtgcaggtgtatggctcccaaggcggcccttttcaggtggcaggtctcacatcattctccatttaagcttacagtcagactgattgataatcggtggcacagatgtgcattaagtcctgcccgtgttcaggatgctgtacttagtgctgttgcggtaaaggagtgaagagaagacgggattcagtgaatgttctggaaaatggctagagtgtacctagagagggaaaatttcaatagacagtaggccagttcaagactggatagaggccgggcgcggggcctgtaatcctagcactttgggaggtcgaggcgggtggatcacctgagctcaagagttcgagagcaacctgaccaacatggtgaaacaccgtctctactaaaaatacaaaaattagctaggtgtggtggtgggctcctgtaatcccaggtactcgggaggctgaggcaggagaatcgcttgaacccggaaggcgaaggttgcaatgagccgagatcatgccattgcactccagcctgggcgacttagcgaaactccgtctcaaaaaaaaaaaaaaaaaaaaaaagattagctagaactcaacttaatgctttgcactgctagctagtataacggtagaagtacatggagcaggtgggaactgagatcagccttggaggatgtttactggcttaagaaaggtgtgtgttccagtctctaaataactgagtgcagactaggagaaaaatattgttcttatgcaaggaactggcaaaagccatctagatagacggtgtgagtagtagcatgaaatgtagtgtggacaggtaagctaaggccagaccaaagaaagattccagtgctgctgagaagagtttgagtgaggtatgaaatggcaaaaggattcatttatttaagatacttactgagcacttagaatatgccgggtgttgcgataggctggagattcagtggtgaaggtaaacacagcctcccccctcatggattttagagtatgtaacaatacaaactgcagttgtgtccaagagatcatgtagagtttgacctggtctgggggtcaggaaaggctttcccaagcaaggaattaactaggcaaggaagtggacacagtttaaaagcagagagcatatgtaggttccctgtggtgggaggaaataaggtgccatcaaggaactaaagggcctggagtgtaggggaggataagatgaacagaagccagattgtgcagtatcttacaggctgtgtttaagtctttggactttggttcttagagtaatggaaaactcattggagggttttaagcaagagggtttgtgattaaatttgtgttttgaaaagatatttctagctatattgtaaacatgttcacagcagggggtaggatggaagcggggaatcagtgggaacagttaggatgcttttgcatttgtccagttgagagatgatagtggcttggcctaggatgatggtggcagaggaagaaaggggacagattgaggagttacttggaagccggagcccgcagaacttgattatggataggatataaatgtaggtttggtggtggtgatggatatccaggataagcatggcaccgcttagcggtgacatgcttcagagggtgccgtgacttggggtgtgccagggcctcttggtccaaggcctggaagacccaagtggggatgacagtgcagttgaatatgtgagttgggatcaggagaggtctatgcaggaggtaatgtagaaaattaattttaggaaattgaatcttgcagtgcttggcacaatgcatgaagagactgatggcatgtggactattcagaaaactgtggcaacactgttgggtgcaaggtgaccttatgagatgggctgacagtggggactgccaactcatgtgtctgtttagctcaccttttcctgtgcccatcctccaaccccccaaccatgtgggaaggaaatgtttggccctctgaccctaactacatcccacagactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacggtgaggtctggggtagggcagagtcatgagtggggcaagaaagatgactcattttattaaggactctagcgacaagggaaggagaggaggggaagacctcaatctcggagggtccaacggacagagattgtgctttggactttgttgagaaattttcctaggatcttcctcagtcgaaccaggaagcttggcaataaggtttgttcttttgaaagcagatatcaccatattggatttttcgagatctcatagctctggtcatgagagcctgcattcaagctataattaagtgtctcaattttctctttttttttttttttttgagacagagtcttgctctgtcacccaggctggagtgcaatggcacaatctcagctcactgcaacctccacctcccaggttcaagtgattatcccacctccgccccctgagtagctgagattacagggacacaccctgatgcccagctattttttgtatttttagtagagatgaggtttcaccatgttgcctaggctggtcttgaactccgaacctcaagtgatctgcccgccttggcttctcaaagtgctgggattacaggcatgagccaccattcccagccctcaacttgcttcttttgggtcccgttacttctgaggttttttgcattttattgtatttatttatttcgagacagggtctcgctctgttgcccaggctggagtacggtataacctccacctcccaggctcaagtggtcctcccaccttagcctccagagtagctgggaccacaggcatgcaccaccacacctggctaatttctgtattttttgtagaaatggggttttgccacgttgcccagctggtctcagattcctgaactcaagcaatcagcccgcctcggcctcccaaagtgctgggattacaggcatgagccacccacccggctggtttttacactttaggtgttcctgtttgcattgccagctagccacgagtcttgctactttacttcaatcataacctttcatttcccaaatggtaggtcaaacgttaatcgcctgcccttggacttccaggccattaccattttgtaccactgtgtcagctctttccagatgactgaccctctctgctctgcacatccactactaatgattttaaacaccattgccttcaagttgacttacacatgggtcttagattatagacttgcaaataggactccccttcaactttaggtgtatagctcgaagctttcattgcagtattctagtcacatgtgatagggtactggtctacctcaacttttcttgtctttccacagtattcacaggcctccactgggctctcagtaggtgggatttgtcagcagttctcattgcctgagaacatccagctctccctcttttcagccagctttctacggaacatcaatgtaggtgcaatgatatccgggatgttggggtggttacccctcctttagcccagagtggggagcagcccagctagcaaggtagccagagagcaagaatgggtcagccaactaggagaggggggccctggccttcttcctagtggtggtgccgcaggtctggggcactgagcctggggagctgtgggggaagaaggcaggaaaactctttctggcatccttaagtcagtttctttcaggagcttctgtctgcacacaggagtacctggccgtagtcgatgctcctcccctggacctccggttcaacccctcgggctacctcttgctggcttcagaaaaggatgctgcagccatggagagcaacgtgaaagtgcagaggtgggtgcctggcacagcctcttagctgcttggcagccaaaggtgttgggtgactcctgcaccaggttaggaagcgagaaagtggagttgataagacagatccctgcggtctaggacctcagtgtgtcaggaagaaaatacacagacctgcaatgccctgggagtgctgtaccacagatatggacaaaacactgcgaggtgcttcctaatttgtcagatcatgaaaaccacctggaacacatcccagacctaataaaccagaatctctagggaaggagcccacaaatctgggtttttaacaagaaccttaagtcaggagttagcaaactttttctgtaaagggccagatagtatatattttaggttttgctggccatacagtctctattccaaccactttgctatcacagcatgaaagcagccatagacaaaagtgcaaatgaaggagtgtggctcatttatgaaaacaggcagcaggtcggatttggcaacccctgctctaagtgattctcatggtcaggtgagggtgggcatgtttgtgatgcaatatggccagaggctttatttgtatgtttatttaacaaacacccaagtctcagagtgacatcaattaatatcctaaatgctgtacagatattaactcatttaatcatcagaacatccccattttacatatgaggaaactgaggcataaggcgctagtaagtggtggcggtaggatcttatttgaagccagcagtctggcttgtgagtgttctgttggtgtgtccgctatgctgcctttgagggacagtgtcccagaggagatacctgtgctcaggaacaggattgtacaaggagtggagaggaggtggatccaggcaggagtggagggaacaaggttaccaccttgttgtgaaagttcatggaataggctgggtgcagtgtctcatgcctgtaatcccagcattttgggaggccacggcagatggaacacctgaggtcaggagttcgagaccagcctggccaactggtgaaacctcatctctactaaaaatacaaaaattagctgggtgtggtggcgtgtgcctgtagtcccagctactccagaggctgaagcaggagaatcgcttgaacccgggaggaggaggttgcagtgagccaagatcgcgccactgcactccagcctgggtgacagagccagactcattgaaaaaaaaaaaaagaagtcatggaatagactgggatagcagggagctctgtgtgctgaagggagacaagggagtagggaaggaaaggcagtcaaggctgaagagcctgactaggaggcttggtcttcagccgctcagcaatgaggaaaaataggggcatttggggcagagaagtgacatgactgagctggactccccacttgtggagttggggtccatacatcatccccctgcacactcccctctctgacacacatacaccgacccacacgtttatctcaggcaggagggagccaaagtttctctgatgtctcctgatcagcttcggaacaagtttccctggataaacacagagggagtggctttggcgtcttatggtgaggcttgcttgcagaggggacagcttttttcctgaagatggagactaaggggtgctacacgttgggagtctcggtactccacagccaagctgaaggaggaacacttccctcctgtgtcacgggaactgccctgggccgtggtagttctctgtccttcatcaggctttgtctctgtggttcagttggttaagatgaccttccccggcttacaagccctagagaggggttggggggcacaggaaatacaatccaagagcagaagtcctcatccctctttgtgagttctctttttcttatcacagggatggaggacgaaggttggtttgacccctggtgtctgctccaggggcttcggcgaaaggtccagtccttgggagtccttttctgccagggagaggtgacacgtgagtctgagcttgtttcctctagcaaccggggcataggcctagactaggtcttatcttctcactcacaagctaagcaagggctggagggggaaaggggtctccctgagagcaggtcctaggcatcttgacctgggctcctcactgatctgcgttgtgacttgtgatctgcttgatgattgcacctgagcactgtcctgtcagagtgtggccaagctcatgccagctccctcatctctgtttgcttcagtgtctgtgggaaagctcccatccttccagctttctttccttaagaaaccagtgaaatccccatttcattcctcttcagcacctctacggcctatttttcattttcttctctgcaggttttgtctcttcatctcaacgcatgttgaccacagatgacaaagcggtggtcttgaaaaggatccatgaagtccatgtaagtttctagtctgtgatgtcctttaccaaaatggagggacagggaaggtagtgactctccttgttttggttttctttgacccactttccagtatgggtaaactaaggctcaggaagcagtgcatctctcagggtgcctggtgtgtggtccgggccttcccactcctcaccctctggtgtctgcaggtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtaactgccctccggacagctgaggaggttggtgagaaagaaagaaatgacatcgaagttggatagcgtgtgtgtgtgtgtgtgtgtgtgtgtgtggggtgtggggtggacagggttggggagggttgccggccatgctgtttctgcagttcgtaaccgcactggttgtggcaggtatgtgtatgtgtggcactgcccccagggaccaggcctagagactccgcttgttgcagacaccagtggagcctattttcgccgggaaggattaggtagcaactacctaggtggtcgtagccccactgaggtaagctgagtggggtgggacatgctggcaaggagacatagaataattgtcacgaaacaatcaggcttttggccaggcacagtagctcatgcctgtaatcttggcattttgggaggccaaggcaggtggatcacctgaggttaggagtttgagaccagcctgaccaacatggcaaaaccccgtctctactaaaaatacaaaacttagctgggcgtggtgctgggcgcctgtaatcccagctacttgggaggctgaggcaggagaatcactggaacccgggaggctgaggttgcagtgagccaagattgcgccattgcactccagcctgggcaacaagagcaaaactccatctcaaaaaaaaaaaaaagaaaaagaatcagccttttttggggggctgtgtgctgtgttaattgatattagagccccctccagatttgaactgggaccatttctccccatcccctacctgcacagggattgttaaacaagtctgggcctgtccttgtgtcccaggcaatgtaagcgttgtccccacctctcactccagcaggaagaaccggacccggcgaacctggaagtggaccatgatttcttccaggacaaggtgtggccccatttggccctgagggtcccagcttttgagactctgaaggtaactggcaagggctggttttcctttttatttttggacattggatgggacagatgacagtggagcacattggtcccctcggacccgtgactgccgtagtccctccatgtcacaactgctaaggaatttcttggacacatcccatcccatagacccctcagcagcaggtagagggtactctgtgctgagccctgaggggagtgaggatggagtgtggctacagccttcccgagaaccccagtgttttgtgcacccgcaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 2106 - DNA, 8989 bp, Homo sapiens
tgacggctgcgataatagcgaggcagcagtgcagctttcagagggtccgggctcagaggggttatgattcggagggttctgccgcacggcatgggccggggcctcttgacccggaggccaggcacgcgcagaggaggcttttctctgggtaaagttgaggacgacagagggtattgtggttctgggttgtccccaacctccgactgtgtgtccttcaggacccgaaaccatggcccacactggcaggacagtgggtcggcttggggaagggggttagcttacctaccagagcttgtaggggctgtgcaggtgtatggctcccaaggcggcccttttcaggtggcaggtctcacatcattctccatttaagcttacagtcagactgattgataatcggtggcacagatgtgcattaagtcctgcccgtgttcaggatgctgtacttagtgctgttgcggtaaaggagtgaagagaagacgggattcagtgaatgttctggaaaatggctagagtgtacctagagagggaaaatttcaatagacagtaggccagttcaagactggatagaggccgggcgcggggcctgtaatcctagcactttgggaggtcgaggcgggtggatcacctgagctcaagagttcgagagcaacctgaccaacatggtgaaacaccgtctctactaaaaatacaaaaattagctaggtgtggtggtgggctcctgtaatcccaggtactcgggaggctgaggcaggagaatcgcttgaacccggaaggcgaaggttgcaatgagccgagatcatgccattgcactccagcctgggcgacttagcgaaactccgtctcaaaaaaaaaaaaaaaaaaaaaaagattagctagaactcaacttaatgctttgcactgctagctagtataacggtagaagtacatggagcaggtgggaactgagatcagccttggaggatgtttactggcttaagaaaggtgtgtgttccagtctctaaataactgagtgcagactaggagaaaaatattgttcttatgcaaggaactggcaaaagccatctagatagacggtgtgagtagtagcatgaaatgtagtgtggacaggtaagctaaggccagaccaaagaaagattccagtgctgctgagaagagtttgagtgaggtatgaaatggcaaaaggattcatttatttaagatacttactgagcacttagaatatgccgggtgttgcgataggctggagattcagtggtgaaggtaaacacagcctcccccctcatggattttagagtatgtaacaatacaaactgcagttgtgtccaagagatcatgtagagtttgacctggtctgggggtcaggaaaggctttcccaagcaaggaattaactaggcaaggaagtggacacagtttaaaagcagagagcatatgtaggttccctgtggtgggaggaaataaggtgccatcaaggaactaaagggcctggagtgtaggggaggataagatgaacagaagccagattgtgcagtatcttacaggctgtgtttaagtctttggactttggttcttagagtaatggaaaactcattggagggttttaagcaagagggtttgtgattaaatttgtgttttgaaaagatatttctagctatattgtaaacatgttcacagcagggggtaggatggaagcggggaatcagtgggaacagttaggatgcttttgcatttgtccagttgagagatgatagtggcttggcctaggatgatggtggcagaggaagaaaggggacagattgaggagttacttggaagccggagcccgcagaacttgattatggataggatataaatgtaggtttggtggtggtgatggatatccaggataagcatggcaccgcttagcggtgacatgcttcagagggtgccgtgacttggggtgtgccagggcctcttggtccaaggcctggaagacccaagtggggatgacagtgcagttgaatatgtgagttgggatcaggagaggtctatgcaggaggtaatgtagaaaattaattttaggaaattgaatcttgcagtgcttggcacaatgcatgaagagactgatggcatgtggactattcagaaaactgtggcaacactgttgggtgcaaggtgaccttatgagatgggctgacagtggggactgccaactcatgtgtctgtttagctcaccttttcctgtgcccatcctccaaccccccaaccatgtgggaaggaaatgtttggccctctgaccctaactacatcccacagactgggatggaaaggtgtctgagattaagaagaagatcaagtcgatcctgcctggaaggtcctgtgatctactgcaagacaccagccacctgcctcccgagcactcggatgtggtgatcgtgggaggtggggtgcttggcttgtctgtggcctattggctgaagaagctggagagcagacgaggtgctattcgagtgctagtggtggaacgggaccacacggtgaggtctggggtagggcagagtcatgagtggggcaagaaagatgactcattttattaaggactctagcgacaagggaaggagaggaggggaagacctcaatctcggagggtccaacggacagagattgtgctttggactttgttgagaaattttcctaggatcttcctcagtcgaaccaggaagcttggcaataaggtttgttcttttgaaagcagatatcaccatattggatttttcgagatctcatagctctggtcatgagagcctgcattcaagctataattaagtgtctcaattttctctttttttttttttttttgagacagagtcttgctctgtcacccaggctggagtgcaatggcacaatctcagctcactgcaacctccacctcccaggttcaagtgattatcccacctccgccccctgagtagctgagattacagggacacaccctgatgcccagctattttttgtatttttagtagagatgaggtttcaccatgttgcctaggctggtcttgaactccgaacctcaagtgatctgcccgccttggcttctcaaagtgctgggattacaggcatgagccaccattcccagccctcaacttgcttcttttgggtcccgttacttctgaggttttttgcattttattgtatttatttatttcgagacagggtctcgctctgttgcccaggctggagtacggtataacctccacctcccaggctcaagtggtcctcccaccttagcctccagagtagctgggaccacaggcatgcaccaccacacctggctaatttctgtattttttgtagaaatggggttttgccacgttgcccagctggtctcagattcctgaactcaagcaatcagcccgcctcggcctcccaaagtgctgggattacaggcatgagccacccacccggctggtttttacactttaggtgttcctgtttgcattgccagctagccacgagtcttgctactttacttcaatcataacctttcatttcccaaatggtaggtcaaacgttaatcgcctgcccttggacttccaggccattaccattttgtaccactgtgtcagctctttccagatgactgaccctctctgctctgcacatccactactaatgattttaaacaccattgccttcaagttgacttacacatgggtcttagattatagacttgcaaataggactccccttcaactttaggtgtatagctcgaagctttcattgcagtattctagtcacatgtgatagggtactggtctacctcaacttttcttgtctttccacagtattcacaggcctccactgggctctcagtaggtgggatttgtcagcagttctcattgcctgagaacatccagctctccctcttttcagccagctttctacggaacatcaatgtaggtgcaatgatatccgggatgttggggtggttacccctcctttagcccagagtggggagcagcccagctagcaaggtagccagagagcaagaatgggtcagccaactaggagaggggggccctggccttcttcctagtggtggtgccgcaggtctggggcactgagcctggggagctgtgggggaagaaggcaggaaaactctttctggcatccttaagtcagtttctttcaggagcttctgtctgcacacaggagtacctggccgtagtcgatgctcctcccctggacctccggttcaacccctcgggctacctcttgctggcttcagaaaaggatgctgcagccatggagagcaacgtgaaagtgcagaggtgggtgcctggcacagcctcttagctgcttggcagccaaaggtgttgggtgactcctgcaccaggttaggaagcgagaaagtggagttgataagacagatccctgcggtctaggacctcagtgtgtcaggaagaaaatacacagacctgcaatgccctgggagtgctgtaccacagatatggacaaaacactgcgaggtgcttcctaatttgtcagatcatgaaaaccacctggaacacatcccagacctaataaaccagaatctctagggaaggagcccacaaatctgggtttttaacaagaaccttaagtcaggagttagcaaactttttctgtaaagggccagatagtatatattttaggttttgctggccatacagtctctattccaaccactttgctatcacagcatgaaagcagccatagacaaaagtgcaaatgaaggagtgtggctcatttatgaaaacaggcagcaggtcggatttggcaacccctgctctaagtgattctcatggtcaggtgagggtgggcatgtttgtgatgcaatatggccagaggctttatttgtatgtttatttaacaaacacccaagtctcagagtgacatcaattaatatcctaaatgctgtacagatattaactcatttaatcatcagaacatccccattttacatatgaggaaactgaggcataaggcgctagtaagtggtggcggtaggatcttatttgaagccagcagtctggcttgtgagtgttctgttggtgtgtccgctatgctgcctttgagggacagtgtcccagaggagatacctgtgctcaggaacaggattgtacaaggagtggagaggaggtggatccaggcaggagtggagggaacaaggttaccaccttgttgtgaaagttcatggaataggctgggtgcagtgtctcatgcctgtaatcccagcattttgggaggccacggcagatggaacacctgaggtcaggagttcgagaccagcctggccaactggtgaaacctcatctctactaaaaatacaaaaattagctgggtgtggtggcgtgtgcctgtagtcccagctactccagaggctgaagcaggagaatcgcttgaacccgggaggaggaggttgcagtgagccaagatcgcgccactgcactccagcctgggtgacagagccagactcattgaaaaaaaaaaaaagaagtcatggaatagactgggatagcagggagctctgtgtgctgaagggagacaagggagtagggaaggaaaggcagtcaaggctgaagagcctgactaggaggcttggtcttcagccgctcagcaatgaggaaaaataggggcatttggggcagagaagtgacatgactgagctggactccccacttgtggagttggggtccatacatcatccccctgcacactcccctctctgacacacatacaccgacccacacgtttatctcaggcaggagggagccaaagtttctctgatgtctcctgatcagcttcggaacaagtttccctggataaacacagagggagtggctttggcgtcttatggtgaggcttgcttgcagaggggacagcttttttcctgaagatggagactaaggggtgctacacgttgggagtctcggtactccacagccaagctgaaggaggaacacttccctcctgtgtcacgggaactgccctgggccgtggtagttctctgtccttcatcaggctttgtctctgtggttcagttggttaagatgaccttccccggcttacaagccctagagaggggttggggggcacaggaaatacaatccaagagcagaagtcctcatccctctttgtgagttctctttttcttatcacagggatggaggacgaaggttggtttgacccctggtgtctgctccaggggcttcggcgaaaggtccagtccttgggagtccttttctgccagggagaggtgacacgtgagtctgagcttgtttcctctagcaaccggggcataggcctagactaggtcttatcttctcactcacaagctaagcaagggctggagggggaaaggggtctccctgagagcaggtcctaggcatcttgacctgggctcctcactgatctgcgttgtgacttgtgatctgcttgatgattgcacctgagcactgtcctgtcagagtgtggccaagctcatgccagctccctcatctctgtttgcttcagtgtctgtgggaaagctcccatccttccagctttctttccttaagaaaccagtgaaatccccatttcattcctcttcagcacctctacggcctatttttcattttcttctctgcaggttttgtctcttcatctcaacgcatgttgaccacagatgacaaagcggtggtcttgaaaaggatccatgaagtccatgtaagtttctagtctgtgatgtcctttaccaaaatggagggacagggaaggtagtgactctccttgttttggttttctttgacccactttccagtatgggtaaactaaggctcaggaagcagtgcatctctcagggtgcctggtgtgtggtccgggccttcccactcctcaccctctggtgtctgcaggtgaagatggaccgcagcctggagtaccagcctgtggaatgcgccattgtgatcaacgcagccggagcctggtctgcgcaaatcgcagcactggctggtgttggagaggggccgcctggcaccctgcagggcaccaagctacctgtggagccgaggaaaaggtaactgccctccggacagctgaggaggttggtgagaaagaaagaaatgacatcgaagttggatagcgtgtgtgtgtgtgtgtgtgtgtgtgtgtggggtgtggggtggacagggttggggagggttgccggccatgctgtttctgcagttcgtaaccgcactggttgtggcaggtatgtgtatgtgtggcactgcccccagggaccaggcctagagactccgcttgttgcagacaccagtggagcctattttcgccgggaaggattaggtagcaactacctaggtggtcgtagccccactgaggtaagctgagtggggtgggacatgctggcaaggagacatagaataattgtcacgaaacaatcaggcttttggccaggcacagtagctcatgcctgtaatcttggcattttgggaggccaaggcaggtggatcacctgaggttaggagtttgagaccagcctgaccaacatggcaaaaccccgtctctactaaaaatacaaaacttagctgggcgtggtgctgggcgcctgtaatcccagctacttgggaggctgaggcaggagaatcactggaacccgggaggctgaggttgcagtgagccaagattgcgccattgcactccagcctgggcaacaagagcaaaactccatctcaaaaaaaaaaaaaagaaaaagaatcagccttttttggggggctgtgtgctgtgttaattgatattagagccccctccagatttgaactgggaccatttctccccatcccctacctgcacagggattgttaaacaagtctgggcctgtccttgtgtcccaggcaatgtaagcgttgtccccacctctcactccagcaggaagaaccggacccggcgaacctggaagtggaccatgatttcttccaggacaaggtgtggccccatttggccctgagggtcccagcttttgagactctgaaggtaactggcaagggctggttttcctttttatttttggacattggatgggacagatgacagtggagcacattggtcccctcggacccgtgactgccgtagtccctccatgtcacaactgctaaggaatttcttggacacatcccatcccatagacccctcagcagcaggtagagggtactctgtgctgagccctgaggggagtgaggatggagtgtggctacagccttcccgagaaccccagtgttttgtgcacccgcaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctcca

SEQ ID NO: 2107 - DNA, 9094 bp, Homo sapiens; identical to SEQ ID NO: 2105

SEQ ID NO: 2108 - DNA, 51262 bp, Homo sapiens
cgtggtgcggggtggggcctgggcgagtcacgtggggacggtgcgcgctcagtgcggctgcgccggccggtagctgcagctggagcagtggcgtttggaggagactcggtgagtgtgtagggaagccgggctggggctgggaaatgccggtgcctcaacggtttaacgttttctgcgtccccgggatttccgttcaagaagagcactggtctgagaaacgtttctccttttggtacacgatcccactcaaaaactcctccccgcccccgcgcccccttaggagcgatgtcccataaacgctcgccccagagccctcctaggcaccgacgccgtccctcttagccactgaatctccggtgatccgccagtcccctgcgggacgcgtcggggaccctcttgatcggatgcccggatctctgtagtctctccacccttcatcttccaactcccagcctctttgtttcgcgttgtaacctgtacccttctcctaaggatgacggccccttcccttatccagggcccccagcacctatttcctacttaggaagcactgtgagtgttttttctgcccttcctcaagaattcatttcttgggggtctcctccctaccttccctactcctcctaaagaaaaagctgaaagaacggagcacagaccttcacttttcctgtttcctttatttttcctctccatagtttgcaaccacaccatacctcctctcacgagatgcgatgttgggattcccttgcccgaactgcaggcgactccctctgatttcactcaggggtggctgggaagataaacatctgtttgggatggtagtgttaaaaataacttgggatatacctgccatttgttaagaggaaagcttatgctgagttcagaaagaatgtcctgaaaactaatggatctgtgacgatagaaggaacaattttttaagactgcttggaatgaaggctgcctgaggagttattagagaataggtagttgaattagatttgggttctacacctcctaaagggtttggcagaagggagccgtaccaacaagaaacaaagttgatcaggtggagctactcatagaagactcaagttgaagagtttgaactagaggtgatacgtagtgaggagtctttgaagcttttcgagtagggcagagagactccttgaaagtggaattctggaaatgaatctggcagttgaatgcaggacagatggggaaggaaagggtttgatagtggggaaggaaagggtttgatagtaggaaaactagttacaatctaggtggtcagtgatgaggtctggtcttttccccctacactgtaactcctttgagtttgaattaattgagttatgcaggtcaaggcgtactcttggcagctgctgttgatctgtgagtccctggaagaatttttttttttaatccactcacctggcacatagtaaactcgatatctgttagatggctgaagtgcatcataaatgtatgctaggtgtgtctgaacattttgaattgtcttatttctgtcaatgtttggcctgaagaatgaaggtagaggaagatgtatttgtaaagtgggaaagaagcaaggcttgtgtacgtttctcttataaggcaggtgtaaatgcagatccagatacaaatgcaaagatttccaagggagattgggaaacatctgtttctcctgttccccacccaccccctgcaaatttaccagtaagacagaggtctataaaagttgagaaattccaccctaaaagaattattaccttccatgctccagacctaggttctaatttcacttgaacatcacatattacttagatacttgaagctcaattttccaaggaccctgaagttttgacatcgggacttaaattcatatcattacattaattaaaaacttgttttgggtacaggacttttatggttttgtgtcggggatgggagaggctgtttctaccctaaccttatggcattcaagaaactacacctgttcttgcagagttggccttctgtggcgggaaacaaaatgaagaaccaactcaaatgtcattgctagtgacacagagcttatgctctagggtttcaggttaactcaaagcacacacttagtgacttaagaataaaaatattggtcccttttttctggagaaggaacttttaggtttgtcttgttgaaactttgtagagaaatttaaagaattcaaagtttttgtttggtatgacagtgcagctttagccagtatgggtacataagttatgacatccttaatgtttctccggtgagtctaggcacttggtgatttaaagtagagttgttctcagtataaagaatttatgtggccgggcgcggtggcccacgcctgtaatcccagcactttgggaggctgaggcgggcagatcacgaggtcaggagatcgagaccatcctggctaacatggtgaaacccccgtctctactaaaaatacaaaaaaaaaattagccaggcgcggtggcaggcgcctgtaatcccagctactcgggaggctgaggcgggagaatggcgtgaacccgggaggcggagcttgcagtgagccgagatcgcatcactgcactccagtctgggcaacacagcaagactccatctcaaaaaaaaaaaaaagaatttatgcaaatgtcatgtcttttttttttttttttttccaattttcaaagagcaataatcacccctcagataaacctcattggctgcaatactgccactgcaaaaaactcttttgtttctgttttttttttttgttttttttttgtttttttttttttacctctatattgcctcctccctgttcctcattcagctggtccttttttaggcagttcacttttccacttctgcgccaatgtcacagtccatttgttgggaactcctcttgtctaaatgttttcttagaacaaggaaggaaattctattagtgatttcttcattcttgcagactacggctctgttcaaacatgacttatttacattgattttgatatatcataatatgtgcccctaaagtaaccatataaagaagaacttgatagtttctttttaaagatatttcctagtctattcaggaacaaaaaggctgcattagtatttcgcaaatataaacaaacaaggactaactaataaaggaacttgcgtttatcacaaatttaaggttaattagtggtataaagttaagttacgcctcctcaaactgtgatttgctagttgcagattaaccagcgattccatttccttgaagagcaggaagtacttggacattgttttatggttttagagagattaaaggaggcaattagcaggaactcttgggaggtgccctggaaagtacagtcattgggagccaggagatgtgggactagttccagttcagccgctgcgtacttgaacaaataatttgggcttcagttttttgtcatttgaaagatttttgcaactctgtttctagtctatgaagattttccactgatactgaaatacttctctttcagcccgaattagtgggatttatttcagatttatcttgaatacatttagcattgatactaagaaactggattctgctcttgtccccagaatttaactttttgccactgagctaatgtttatgtttggaggttacttcattgagtggtgttggaatatacttttaagatttctggccaggcgcggtggcttacgcctgtaaccctagcactttgggaggccgaggtgggcggatcacgagatcaggagatggagagcatcctggctaacacggtgaaaccctgtctctactaaaaatacaaaaattagctgggcgtggtggcaggcacctgtagtcccagctactcgggaggctgaggcaggagagtggcgtgaacccaggaggcagagcttgcagtgagccaagatcgcgccactgcattccagcctgggtgaaagtatgagactccgtctcaaaaaaaaaaaaaaaaaaaatgtcctaaatgggggtggggtgcatggctcacaccttaatcccagcactttgggaggcctagcggggaggatcttttgagcctaggagtttgagatcgcctgggcaacatagcaagacctcgtctctacagaaaatcacaaaattagctgggcatggtgacgcacctatggtcctaactaacccttgaggctgaggtgggaggatcatttgagcccgggaattcaaggctgcagctgcagtgaaccatgattgcagtactgcactccagcctgggtgacagagacagacccatctcaaaaaagaaaaagtaatttgtgtaatacagtttaaaagtcaaatagtaataaaagatttggaattaaaaaacagtttctcaggccaggtccagtggctcatacctgtaatcccagcactttgggaggctgaggcaggtggattgcctgaggtcaggagttcaagaccagcctggccaacatggtgaaacccaatctctactaaaaatactaaaattagctgagcatggtggtgtgtgcctgtaatcccagctacttgggaggctgaggtaggagaatcgctggaactggagagatggaggttgcggtgagtcgaggtcgcaccattgcactccagcctaggtgacagagcgagactctgtcaccaaaaaaaaacccaacaaaacaaaaaccgtttctctgccctccctacctcaaagtcccattctttagaggcaaccactcagttgttttcctcttttcctctgtctttacagtaagtggtcaacaccatcagtattcttgaaacatgatataacaaaaccagttttaccatatggtttctatggcgtttttctggtcacaaaaacatacccaatttctaaataaagacccaaacatttctaatatgaaacactgaaacaagtaagattttcacccactttttggtgagtcagtgagttactgcagtcatagtggtggtgggttaaatcaaggaataaatgtgtgcaaagtgaaaattgtcagaagcatttcctaccaccatactcatttccaaagcaatcaatcaccaatagggcaggctcactgagagctattgtaccacatcatttattgttgtgcatttggatgattaccatagactttgcagatttttatttgctggtaatttgtattcattcatttattttccagcttaggctcacaggtggctggagcctatgctggcagctcagggcacaaggcaggcgccagccctggacaggacgctgtctatgccatagggtgtgcatgcacacacacacaaacacagggaccatctagacacaccagctaacctagcaggcacatctttgagacgtgggaggaaagcagaatacctggagaaaacccacacagacatggggagcatgccaactccacacaaacgggtagcctcagccaggaatcacttattctctcatcaatgttatgaaaaaacgatgttgaacaaaaagactttttttgagagtctgctgtatcttcttgttgctaaatagttggtttgttattctttcttggttttcccctcatgtttggcctgttgatttcttgttgtgatagatttgtatttagctcttgcatcccaccactttcctatttttccatgccctctatcccctaatatagttctattgtaattttttgctaaaacaggtagcttttatgtacttacacctctgtcaaatactgttcactgttgagctggatgatctattacagtgtgttcctcctggtgtgtaggttggccttcacctgtgtttttcatgtacctactgttaatttttttcccacatgctccaatgtatttgtcacattcttatcagtaacattttctgtgagctcaaatgtatcacctgtttattggagccctgccccctcctcctgcctttactgttgctctcaagaactgctgcctggggtcctcctggacctgccctttcctgtgcaggaaccgtatcttcctctttctgggcttatgtctttattttttaaaagcatatacttcagttatttctaagaagtatttgaatgacctggttttgcccacacacttgtttgatagtttggcagttatataattctagattggaaataaggttctctcagaatgttgaaggcatctgtaattgctctagagatgtggtgatttaaatccttcttacgtgaccgtattttgtttgttttctccccttctggaagctttgaggatattctctatctctggtgttctgcagttttatgatgtgtattaacaccagggtatgggtcttttactcagctgttgtgctggcttctcacagacggttttgattctggaaattcacgtcctctagttccgggatgttttcttgtactatttctgtgattttttgctcaatctttaatttttctttgatacctttttgtaatatccattcttgttatgtggatatggtgggctcagagggcccgctggagtatttgagttttcttcctctctgcacaggctccacttccttcaggtgatgtgggcctttgcacctgtgcctctgtctggatgtgtcttccctcagatatccagcgacttgctcccacacctcactttggatgaatccacaagtctttccttaaatgtcacctcagtgaagagagcactggattgagaagtgcagacccccatctcacttccctgctttgtttctctccagaagcatttcccaccatctagcatcccacatatttatttacttgtttccctcaccactaaaataaacattctatgagggcagggattttgggtttttttttgtttacctctataattccagcctctgaaacagtgcctggcgatgaatagatgcttaataacttaaggaataaatgaattattttattgtgggatttctttgaatgtctcatgattctgactgttcatttctgttttgttttttgttattttaagttcccagcgtgggtcttgttgggtggtggccattactatagggtggctggtatatatggattttgtgtgtatgtttgtacaaatgtatatgtttgctaatatttctttagctgacagtgcattggttgctgggacaaggatggaggcttggagaaccttttagtatgcatcttttgacataatctgtattttcagttcttcattgctcctgctgatgtattttactccagacccatttcagatttcggttcatttttctttaaacctctggatttgggggtggagaaaatagatgaaaataggaggtgaggaagagaatttgcgcattagttaaatagactttatgccaatccgtattttcagatctgcatttaaagcttgctttccatctccaaaaattcattgaaaaattgaatgcttatctcctgcacctcacattcttggttttataccttgaaaaaagaaaaactcctctgttgccattttaatagcgtactttgaaaaagattaagaagtaaacacgtaaggacagaagttatcatgttttatattcttagtgtcatggaatgcagcacaggaatatcacataaggaaaagcacagatttcttgttttcctcgtttattttggaagcttatccttcagctcttgtttatcttttttttttttttttttttttttttttttttttttttttgagagtctctctctgttgcccagactggagtgggcatgatcatgactcactgcagcctcgacctcctgggttcaagcaatcctcccacctcagcctcccaagtagctgggaccataggcatatgccaccacatctggctaagttttttatttttgtagagacagggtctccctattgtttatatgccttaagagtcaaattaacagagtacataagaaacactctctttttagctctcttgctaaggagcaggtttgagatctgttgccagaacttagtacttcgcagttttatggattcctcaggagtctcgtccatggggctggggcgtggctaccctctgctgactcttcctaggttcctgctcttccccagcacctccctacccccagccactagaaatagactgcttctttctttcttctactgcagaaaacatgcactactgtacttattaaaattaacttaaaaaaaaaaaaaaagcagctcgagctgcttgagttttttttttaagttaattttaataagacattgaaggaagaattttttttaaagggggggcttatatgtatggagatttatggtgtgaaagcaggggcaaactctaatgaatgaagtttttagaattgatatgaacatgaacccaagatactcagacttattccgagagttcctcttaaaaactgcttttctccacataaatccgaatgtcagcagtggttagctccacgttggaggaaggggggcttcattttgctctttctgcatatttcctgcagtgatctgttactttcaaatctgggggaaaggtgctctctttttctgaatgaagtctccacctgcctcccttgggcccaggctgcccagctttctggctgctccctgagagtcctccttggtcttccactgacctccttcacttccttatgaaagtatgtttttagtctccctaacctgctttctgttttctctctctctcttttttttttaataccctcaattgttttcactggccactttttttttaagactgatgcttggctgggcttggtggcccatgcctgtaatcccaacactttgggaggccagggcaagaggattgcttgacaaggccaggagttcaagatcagcctggtcaacatagcaagagcccatctctacaacaaaatttaaaaattagccaggtgtggtggtgcgcacctgtagtcccagctgcttaggaggctgagataggaggatcccttgagccccagagtttgatgctgcagtgaaccatgatcttgccgtcctggggaacagagcaagactgtctcaaacaaaaaagactgatgctacctgcttggcaaaaccatgtttttagagctatttctcctaagaaacctggtctttgtagttgttctgatggcttctgtgacaaataatgcctttttttttttaagagctttcagattcttatttcagatctaaacagtgcttttcagctctcagttcatcttcagatcaaagagaatagtaggccgggcgcagtggctcatgcctgtaatcccaccactttgagaggccaaggcatgtggatcgcttgaggccaggagtttgaaaccagcctggccaacatagtgaaaccctgtctttactaaaaatacaaaaattagccaaacatggtggcgtgggcctgtaatcccagctacttgggagcctgaggcaggagaatagcttgaacccgggaggcagaggctgcagtgagctgagatcaagccactgcactccagcctgggtgacagagtaagactccatctcaaagaaaaacaatattaatttttggctaatttttattaggaaaaagagaatatcctgaaaagaatatcatgctagtttaaggttacagatttactttcttccctgggttccctttggttcatattctcttgtttagaaatgatccaaatacattattctgaagtatatgacagtttttccaaaatcagtaaatacatatgttggtgcttaaaacagaaagaaagaaataatggcctataaatattatcacatagcttatttctactattcagagatctgtataacttaggataaggagcaggttgttgaacggttttttggtttttaagtttgaagtacagtctgaaagtacctttcaatattgaagggctgcctgactgaaacttacatggctatctcctgggcctgaagcaccaccgagatctgaactgaaggtagcgttttgggagtccttagcgtttagttggtattttaatatctaggggtgaatggggtgggaagggaagggagtatgtaaagggaatagactggagagccctgcggatcctcagcatttaggaaacagggaagacctcccactagaggggagggaggaaaaccaggaaaaggcaagatggacttcagtgttgggtgtttcaggaggcagaggaggataaacaccaacaatttcattgaattttgccataagggtatttatctcccataaagctttccttgattttcctcaagcagaagtgctcatctccttggtacctcatccaggcatgtgaaacttggcacaaacatgttgtaaaggtttgtttatagttctgtttctccaaaggtgtagacttgttaagagtgtggcccacggcttgttcgtttttgtgagatggtattgttttgtgtcttaacaacatgaacactgactccatgtctaatgtgtaatagtcgtgtgacctttaacaagctgcttaacatctgtgtgcttctgtttcattgtctataccatttatgatatgagatgataatagcatctacctcacagaagagcagatatttgtgaagtgtggaaaacagtgcctggcttactgtcaatgctatgtagtgtttggtggaggagaactggatgcagcaatactaatattcttagcacagtgctggatgtttaacagatatttgaacgtgaagatgtagtaacctgtgatgaattcagttcctagcattttaaaattctacaagcatatacagaatataatcatggccaggccataggagaactacaaatggaagtggactgagaggaaagtgcatgtagctttgttttatgaaacaaatctatagactttcaacaaaagtactatgtgattctaatttcttgttgttaggaaggaaaaacaacctccaaagcaggtgagaatctttatgtttagggatgaacagctttaaacaggtgagtggtggatatcagcacggaaggtatttgtttggatgagagaaaatactacaaccttcccaaattcatcctaatttttgcagctcagaaaattagaaatatcaattgatcccttagactttaattaatggtagatacacactcattccatcagcgaatgtttgaacttcttctgcaccgtatacacactttataacaggaactatgctatgggatggggataggatgataaataaattagacactgtactcgccctagaagggcttttattcttgtgggagaggccaataattgcaagtactgtgagatacaaactaggagatgaagtataaatgaagaacttggggtaaagggagtggaaaaccaggctacagatggtaacatttaaattgagatgccaaggaggagggtgtggggaggcccttgcagaatatcactctgaggaaaggctgcagctgggaacttgaggtggggcgggggaggggggggtgttcaagcaactgaaagaggcctgtgcgcctcaagagcccagcgagtgagggagggggctggatggatgttgtgtggatgccggacactggatcatgccaggtcttgtagccacgatgaggagtatgttattaaacacagtgagaagccatggaatgattcaaacatgacttaacccaatttgtgttttgaaatctcttttgctggggccgggtgtggtggctcacacctgtaatcccagcactttgggagctgaggcgggcagatcacgagtcaggagatcaaaaccatcctggctaacacggtgaaaccccatctctactaaaaatacaaaaaattagccgggtgtggtggcgggcgcctgtagtcccagctactcgggaggctgaggcaggagaatggcgtcagcccgggaggcagagcttgcagtgagccgagatcgccactgcactccagcctgggcgaaagagcgaaaaaaaaaaaaaaaaatcttttgctgctacataagcttttcttttttctctaattgtattttagatagatttaatatgtaaaataagagaaactgatttcttagctcaaaatactgatgcccttgaatcatttgccagaaatagttcttcccctaagaatcaacccttaaaaaccagtttacagagtagacatcagagacttgagttataaagtgatttatatataaaatgttttggtgccagacaatggtcttggaaccttaagttgaagttttcttctgcctgctagaatcagactacattcactgttaggacgattggcatatccaaaaaatgatagtctgaatattgatttatttgtgtacacagttttcccatttgttccatttaaaaactaacatggttttttatggtccttattaaaagcagttacagggtgttctttcgtttgagttagtttgtgaaataaatatctgaatgcctactgtgtggcaggcactgttctgcacttttagactatatccataaactaaacaggcaaaggacccctgtctttgggggacttacattctagtggaggaggcagataacaataaatataattagggccaggtccagtgactctcgcctttaatcccagcactttgggagagtgaggcaggcggattgcttgagtccaggtgtttgagaccagcctgagcaacgtgacaaaaccctgtctctacaaaatacaaagaaattagccgggtatggtggcatgcacctgtagcacctgtagcactaggaggctaagatgggaagattgcttgagccccgtggaggtcaaggctacagtgagccatgatcatgccaccatgttccagcctgggtgacagagcgagaccctgtctcaaaaaaaaaaaaaaaaaaaaaaaaaaaaattagtagagtcatagtactaataattggtatgttagagggtgctgtgtgctgtgaaataaaaagtagaacagctaacatggtggagggtataattttaaatagaatgggtagagtagcatcattgagaaggtacaatctgaataaaggcatggaaacctgtacagatacatagagaaagaacattccaggcagaaggaatgatctatgcaaaggaaaaccccaaggtcggggtgtaccaggcctgtttgaggaacagtgaagaggccagcgtagctggagggagggtatgtgagaatatcttggcttcctaggaatgcgtttctcctcagtcaatttcaaaaagttcataagccaaaacagatgaataattaggcagagatctcccatcccatgaatgctctgcagatggtaacctataaacacccagactcatgtcttaactcaaattaggtaattccaaaataatgcaaatgttccttaaattcagttcatagggcagctgagcaaacaagatctcttttatgtgaataagaaactgaagacttttgccattccaatttctagatctccagattagaagccaaaaggctctactttgcagcagaggatggcaaagatgccaagtgcacttggcatcttaagagaggcagcgattgtgggcttagggagaactgccttttaagagcagcttttctcaggtcccttgtttctttcgagctcagtaccaccaaatccttttcaattttttatttggcaatccacattttctgttctttgacgcagtgaaattttccatttgttccctaagtttccaatcttaaatttggcacactactttcaaaaggtcataatcaatacccactatagtagaatattgcccaagttgtgtgtacatcacgtgtattctgtgggtgtagagcatcagcattgtcttggtttcacatgcacaataatttttataaagagccacacccagtttctccagtgagatcgctagagctgttccagtcatacttgcccacagctaatcctttcccatgttgtttctgaattttattttttgtaagtagagtgtccttttgtagtttcttaagcttcagattgattcccagtttgtcatggttggtcagtttgaatcctcttctctgagttgctgttcattgtttccagcttagttttccatgaggttggagtgaagtaagattactaaagacctgtaatcccagcactttgggaggccaaggcaggcagatcatttgaggtcaggagttcgagaccagcctggccaacatggtggaaccctgtctttactaaaaatacaaaaattagctgggcgtggtggtgggcgcttataatcctagctatttgggaggctgaagcaggagaactgcttgaacccaaggagatggaggttgcagtgagctgagattgcaccactgccctccagcctgggtgacagagtgagactctgtctcaagaaaaagaagaagattactaaataaaatgttgagaagcatggaaggcaaaaaatagtctacattcttctcacagccaaaaaggaacatggcgcaagttcctatcactgtgagttagaaaggccagaaaggaacgtggcgcaagttcctatcactgtgagttaggcaggccagaaaggaacgtggcgcaagttcctatcactgtgagttaggcaggccagaaaggaacgtggcgcaagttcctatcactgtgagttaggcaggccagaaaggaacgtggcgcaagttcctatcactgtgagttaggcaggccagaaaggaacgtggcgcaagttcctatcactgtgagttaggcaggccagaaaggaacgtggcgcaagttcctatcactgtgagttaggcaggccagaaaggaacgtggcgcaagttcctatcactgtgagttaggcaggccagaaaggaacgtggcgcaagttcctatcactgtgagttaggcaggccagaaaggaacgtggcgcaagttcctatcactgtgagttagaaaggcccttcagcaatttaacaggccttttctctccttccccccggcagggctgcatatagatcacccccaaatctactagtctactctctttctctttaaaaggaaatgcaactacctcttttggcctccagttctgttgccattttaaataggaaggtcaagaacccagcattggccaggtgcagtggctcacacctgtaactgaagcactttgggagggctgaggcaggcggatcacttgagcctgggcgttcaagaccaacctggacaacatggtgaaaccccgtgtctacaaaaaattagccaggcatggtgatatgcgcctgtagtcccagctacccgagaggctgagggaggatcaccaagcctgatggtggaggctgcaatgagctatgatcatgcctgggcaacagtgagaccccgtccaaaaaaaaaaaaaaacacctagctagcattttgtagacttaaatttattaactattgaatgataaattgaaagagagaaattgaatgctctcaaacaatacaagcttcttttttttttttttttttttttgagactgagtctggttctgtcacccaggctggagggcagtggcatgatcttgtctcactgcaacctccgcctcccgggttcaagcgattgtcctgcctcagcctctcgaatagctgggactacaggcacccaccaccatgcccagctgatttttgtagtgttagtagagatggggttttgccatgttggccaggctggtcttgaactcctgacctcagatgatccacctgcttggcctcccaaagtgctgggattacaggcgtgagccaccgtgcccagccacaagcttattcataaatccttctttagttcctactctgataactggattttatttataactaaacctatgatgggtttttattcagttatttttaatccattatatctgtctaaaatgttgtacacctgaatgtgaactcgaaagtaattgtgtaatgatgaatgaatgaagtgaacttgagtgacttttttgtacctcttcatgttgtaaaacatttattttccttttaattctaagaataactgtaacacgaatctacttcatatctttcttatccttctgttcttggttttgctatcaatggttttggattccatgctcacaatgtggggacctccaggatatttcacctggtgcagccaagtgaattcacttaatcactacagacagttacacttgagggtttttaatggtaaaattttttaattttcaaaatttgttatttatttatttttgagatgggttctcactctatcaccaggctggagtgcagtggcatgatcatggttcactgcagccttgatttcccaggctccagtgatcctcccaactcagcctcccgagtagctggaactataggcatgcactaccacacctggctaatttttgtatttttggtacagatggggtttcgccatgttgctcagggtggtcttgaactcctcagctcaagcattctaccttcctgagcctcccaaaatgctgggattaggtgtgagccactgcgcccagccaaaaaacttgtttttaattttcagctctatttaagttggaaatcctcaaggaagtgaaaaggggtgaaaatgaagtggaatgtatttactaaacatttttttttttggttttgttttttgagacagggtctcgctttgtcacccaggctggagtgcagtggcataatctcagatcactgcaaccttagcctcctgggttcaagcagttctgcctcagcctccctcctgagtagctgggattacaggtgtgtgccaccacacctggctaacctttgtatttttggtagagatggggttttgccatgttggccaggctggtctcaaactcctgagctcaagtgatcctcctgcctcggcctcccaaagtgctgggattacaggagtgagccactgggcctagcccattttaatttttatggcaggaaagtcttcccttcattaagacttgtcaatttttcgtttgtttgtttgtttttgttttgagatagagtctcattctgttgcccaggctggagtgcagtggcatgatcttggctcactgcaacctctgcctcccaggttcaagaacttctctgcctcagcctcccgagtagctggaattacaggtgcccaccaccacacccagctaattttttgtatttttagtagagatggggtttcaccatcttggccaggctggccttgaactcctgacctcttgatccacccgccttggccccccaaagtgctgggattacaggcttgagccacccgcgcctggcctcaaattttaactcatagagaatatcctttataatgatggcatcttctggaatgccccagacttggaagaatctgcatttgtacgcagtatgttgtgtttactctgttgacataaaagtaagctactgagggttatttctcataggtaacccacactatttttgtagtagaaattcaattgttaaggactcactagagtccttaaagagttatcttgcccttaaagagttattcaatttcatttttaatgaataacctatgccatttatgatggaattgtttgtgtgatcatactacttgatctatgggaaatatctgatattttaaaagtctccttacttagcaacatgtgtcattattttcaggatataccttctcagaagctgcacaggaggaaagcagtgacaaagaaagaagttgtcattctttgcacggtaaaatcatcacctccagtcaccaacttctaattcaaattaggttttaatttgttcattatttcttcttggaacacttttgttccctatacatatgcgttactttggctttataatagaaaataacaagcaacatctgagctcttttgtttgtttttttgttttttgagacagagtctcactctgtcacccaagctgcagtgcagtggcgccatctcggctacctgcaacctctgcctcccaggttcaagcgactctactgcctcagcctcccgagtagctgggattacaggcgcccaccaccgcacccggctaaattttgtatttttagtagagacggggtttcaccatcttggccaggctggtttcaaactcctgacctcacgatccacccacctcggtctcccataatgctgggattgcaggcgtgagccaccgtgtccagccacatctgagctcttgagcctggaataccagtatgatttattttgggggcttaagttaaagggcattctagaatttggggtttttcttctcaatccttaatgtctttcagaaaccttacctctagtgaggtctttctccttaccttgttcagatggggtcattgtttgctagtaaaatggcaagaacaagtggcatcagtctggcatttcctcagtgactctgttaaagcacatgttcaggaaatgagtgtgatacagatcttatctgacagaaggtagagggtctcaggcatgctaagggataaaattaggagccaatcgagttcaccatagatgaaatatttcaagactgggatccacagaggaatcagatcttggcacagctagacatgattcctgtctccctgtgtgctgagatagaggaaaccgtgagtttgctttatccactgatgggaaaggctgcagtctacatatggaactgaattcatcaactacccaagcaaagtctttaggattttatttaatttgttcactactgacaagcttgttgggaactctttagtagtacttcactttgggtatctttcccttcctcccaaatccgatagttgctaaaaacccagatgtgttggaattagtccaagagccacagttagaaaggtttggtttcttctcaagtcagaggatgactcttttcccttaagaaatgaagttaacccttttctatatttatgctagagaaataaaccattctttattccagtcacttttattttttaaaagggggtggaggaagcttgctgatccttttacagcaagaaacgtaccactttctcaagctggtaattgtagatcttttatttccaggcaaaaatactttttaaaacattagaatttttctctccatttgatttatttcgtctgctaatatacccaggtgtatcactctgagctccttctggcatgtcacttgtttgagctgaggagtatgcactggacttacaggagaaacatagctcagaatgaagaaggcgggctgggagacctcactctgattctcaagtgaagggaagcccagagcttgctatctttttagcaccaagatgctatcaaaacaagagctgctgggattctttgatgttttcaagtccacaagtcctctgctgtgtgcaaacttaatttcatttggataaccagttccttttctcttgtccctttaccatatttcttctggattttttctagaacactcgccctttttcctttttcatccaccagagatagaagcattacatttcctgccaagctgacaggtttcaaagtacaagtgttctgtctcatatgaagacttcagccttaacatttctgttaatgaggttgctgttactttgctcatcttttaccaagtatctgacttttattttgctgtactctattggccttgaaggatttctcagtggcttagcagtaattgaggtaatgaagacactgccacaggtaattgactttgttttcttgtggcagaaaaacattttccatttttgctatacatagcaagtcccacaaaaatgaaaactcaaacgtgatcacataaaaaaaattaaagtgtgaactagctttgaagctctttagcaataactgcattttgtttagggtacatgctaaaattgatttttttttcctgaaaacagtactctagaaggaataaaatatggtttgtgcttatatgccactggggtatacatgtgagattgtatcatgtgaggcatcctttagggtaaagaaaatatgtttctctgttagaaaacaggatgagtatatgattggatataatgtaggcatgctgagctacgtctcattcagtacctaaataagaagaccctaaacattctcagtcagaagcgattggctatatttaattttttaaagtaatagtagttggaatggaccttcagaaaagttgactgtgtaaagaaataagtcagaaagcttagtattcaggtctagacatcatgaattaaccatctggcagaaatagaatccagcaaaaacgatcttacgtaatttccaggacaaaatggtaggacagatctaggctctggtggataagtggtagtgagaagtatataacaaatagtgcttgtcactggagaaagtagttttcccagcttctgaatgtagttgactgccaagattgcatcaatggagtacctagttaacaagcagctgttaaggattacttggcattacttcaagtaaatctcctttctagaatgcaggcacttcctttgttgatagttttggactttaagtttttttttgtttgttttggctgaaaagttaatacaggtttattattcctcatctaaaatgcttgtgagcagaaagaagtgttttggatttctaggggatttttttgttttgttttgtttttaatatttgcattatacttaacggttgagcatccctagtccaaaaaatctgaaatctgaaatgttccattgagcatttcctgtttagcaatagtgtagttaagaacttggacttgagaggcacagttgccatggtttgaatactggtactaccaagtacccgatctttctgtgcctcagttttctcatctgtaaaataaggtaagaacaatgcctcgtaaggttatgcggattaatgagttaatgtttataaatagtccatggcatgtagttaagagcttgtaaactggcttagtagctgaattgagcattgaattctgaagatgtccatcttcaaaacttaataagcatgaacttccctctacattttactttcatctctctcaatatagtgtttttacttgcatgtcatctgtttagatgatgggtttatagaaccatatttaagaaaagaacttaagcacctaagttttttccttaaaaacaacttaaaaaatatatttttttaagttttttaaagtttttttaaaacttaaaaaatatttttttttaaaaaaatatattttttccttaaaaaaacttaaaaaaatatatatccccaaactaatggattgtcctgtgtgtggaagaagtaaacacattctacccctagttcaccattctagagcgttgacttttagaatcggaagtgagtcacataagttaaaacttcataaaaatattttaaggacacttaaaacctggctattgttataagcaaactgggaagtcgttagactgtaataagttattacacttaagggaagatggcttaatggtatacttcatgtgcatcctatatttaacaaaattgttgcattgtagaaaaattaagtttgcatcttatttaggtgtttcctatttgaaggaagattctggagaatctgattctgtaattttggagtagagcctagaaacaaacttttttaatttaatgaattaactttattttcaagaatatatatacttttaacaaacatcccagctgggtgcggtggctcacacctgtaatcccaacactttgggaggctgaggcgggcggatcacctgaggtcaggagttcgagaccagcctgatcaacatgaagaaattctgtctctactaaaaatacaaaattagctgggcatagtggcgcatgcctgtaatcccagctactcaggaggctgaggcaggaggattgcttgaagggagcaactgccaggaggcggaggttgcagtgagccgagattgcgccagtgcactccaggctgggcaacaagagcaaaactctgtctcaaaaacaaaacaaaacaaaaaacccagaaaaacctacatggttgtgttaaggcaggatttactgagataagtgactcatctgtcttctcctgagccccagctttctcaccaacagaatcaaagatttgactggaaacatgatctacttcctaactcactactgtgactgtattatttctatttaccttatgattatgatataaagaagaattacactgcgtgtgatggactatggggtgaggatgtgagccttctgtttaccacaaaaaattaattcagaaacttagtgttttaataaagaaaaaggcttttttgggctgggtgcagtggctcatgcctgtaatcccaacattttgggaggccaaggctggaagattacttgagctcaggagttagagaccagctgggcaacatggcaaaaccccctctctacaaacagtacaaaattccaccagatgtggtagcatgtgcctgtagtcccaggtgatggagaggctgaggtgggttgatcgcttgagcccaggaggccgagactgcagtgagccaagatggcgccactgtactctagcctggacaacagagcaagacccagtctcaaaaaaagaaaagaaaagggctttctaataaaacagtaaacttgcagtaattattagtaattcagttctatatgttgccagtggaatgtactaaaacaccccaaacggtggtagtatgtattgtcttctatattgtgtgtgtgtttaaaatactattactatttttaaattcacagtctttagatttaacaagtttgccaaagtttgagcacttagaactttatagtattcattctaatccatggtaattatttacttttgccagttattccagcacccgaacataattggccatttttcatacatctttgcttgatgatacatttaccagtcatcacagtggcttgatttgaagtccacttcatgtttagttagagagacatgccccactggctacaaggtcaccatcgtccaacaacagagaatgtcattcagcaaattagtattgattgttctgttcttgactcagtaatttcttcagctgagagtaaatgggtaattgggggctattaatacacttatctatgggtggtttttatcccctgagtcttccgcaaacccatcttgtgggagaataactggtttttcttaagttctacaaagtgatggccagtaattgacatgagttgacactgtttttggtgggaacttgggggcaggccttcagaaacagaagcaagatggtagtatggagcaccaaagtcctataatttccagattacttcttttagactaatttaatttagctccttgtttagaatgttcattaattaacaaatttctgttaagtagggggcacctccaaaacacctttaagggtatacagcttttttaaactgtttaatatatgtgctattttgaatagtatactttacagatctaattgtggttcatggtgtttaatctattttagaaactggatggcttctacagggagccaggcctctgatatagacgagatttttggattcttcaacgatggcgaacctcccaccaaaaagcccaggtaaacaagagaagggaatcagcagagtaaattaccattagtgggagagaaagaaaaatagccaacttataccttctatatcagttgttttcactaattagtattgaccttcatactcaaaattaaattgtttttattttgggtttaatttttattttttatcaaggcagtacaggtacatagtttttaaaatcagtatttcaaagtccgcccttcctcagagataatcactttcaactttacctgtttcttctaatgttgacatccatgtttgaaaatactatatatattgctgctttttagttttttggttttattgatttctgagtatggaatataaggactgctttgctctcatgactcctccctctgtattgccactccacacactctccccatgttcttgtatgtttgtgtcacagtgtttggttcaatccacttttttttttgagacagagtcttgctgtgtcgcccaagctggagttcagtggcacgatcttggctcactgcaacctccacctcccgggttcaagaaattctcctgcctcagcctcctgagtagctgagatcacaggtgcctgccaccatgcccagctaatttttttgtatttttagtagagatggggtttgaccatgttggtcaggctggtctcgaacccctgacctcgtgatccacccgcctcggcctcccaaagtgctgggattataggcgtgagccactgtgcccggcctggttcaatccacttttaatatttacattattacgactgtataagtagtattcatagctgagcctaatgcgtaacgattatgtttcctttcttgcccattttttttgcttatgtcattaaagactgtcttttttgtttgtttgtttgctttcaatgtattctcacatgctctgacagaagaataaatctcctagctatactgaaacacaccgataacttgctggtttgtgtcatggattcttccttctggatgctagtccactctggacacttgttctccagtcctgttgcgttcctgatatttgctatttcccattcccatcatcctgataatttcctttacatctctcctgtatcgattctctgtttgctggatctcatgtcctcttttttggtgcacgcctttgttttcctgaagcatgtccttgcatagcctcctaagtaaggacccataggagaaaattatttggacatatttgaaaaggtctttatcatacacttacattcatttgatggtttgactgagtatagaatttttagtatctctcattcatactctgctaacatctaagtattcctgccaaaatagccactctgttctgattcccaatcctttgtattgtatgacctctttccctgttttttgttttgttttgtttcatttttgttgttgttgttgttcattagaagcttataaggatcattattttattctcagtaacctgaaatttcacagtgatgtatcttgtcatatgaatctagacaccgggcagctctttaaagctggcaactagtaccttcactttggagaagttgacttatattacttttttgatactttccattacaatgttttttctattccacatttttttaaaactcttgttattcagatgttggacttcttgtattaagtctctaattttttatgtgttgctttatttttttcccccccatttcgttttcttaaatttagctttctcgggggttctctgttttatcttgtggatttaaaaatttctgttgcgttatttttgatttatgaagtctttttgtttgttcattttttcatagcactctgtttatgtttcacagatgcttttttttttttttttttttagacagagtctcactgtctcccaggctggagtgcagtgacactatctcggctcattgcaagctctgcctcccgggttcacaccattctcctgcctcagcctcccgagtagctgggactacaggcgcccgccaccatgcccggctaattttttgtatttttagtagagacgggatttcactgtgttagccaggatggccttaatctcctgacctcatgatccacctgcctcagcctcctaaagtgcagggattacagacgtgagccaccgcgcctggcctttttttttttttttttttttttgagatggagtctcgctctgttgcccaggctggagtgcaatggtgcaatctcagctcactgcaacctctgcctcccgggttcaagcaattctcctgcctcagcctcctgagtagctgggattacaaacgtgctctaccacacctggctaatttttattttatttatttatttattttttaaataaagacaggttttcaccatgttgaccaggctgatctcaaactcctgacctcaagtgatccacctgccttggcctcccaaagtgctgggatgacaggcgtgagccaccccacctggccaattttaaaaaaatctaggccaggctcggtggctcacgcctgtcatcccagcactttgggaggctgaggtgggcagatcgtgaggtcaggagatcgagaccatcctgggtacctgggtaacatagtgaaaccctgtctctactaaaaaaaaaaaaaaaaaaaaaaaaaaattagcggggcgtggtggcgcgtgcctgtaatcccagctactcgggaggctgaggcaggagaatcacttgaacctgggaggcggaggttgcagtgagctgagattgtgtcactgcactccagcctggcaacaaagctagactccgtctccaaaaaaaaaaaaaaaaagaaaagaaaaaatatatgtgaggatatcattgttttcttttaatttttttttctccttcccatactatctcttatttccttcagatttctctctacctgctagtttgtttggtataactgttatgttgggggctttcctcagatgtgaggtgacccttgtttgtctgcccatttttaacagaaaacaccaaaaagccaatggaagaggccgggtgcggtggctcacgcctgtaatcccagcactttgggaggccaaggcaggcggatcacttgaggtcaggagtttgagaccagcctggccaacctggtgaaaccccgtctctactaaaaatacaaaaattggctgggtgtggtggcacgtgcctgtaatcccagctactcgggaggctgaagcaagagaatcacttgaacccaggaggcagaggttgcagtgagccaagattacgagattccatctcaaaaaaaaaagccagttggagaatctgtgtgtacataaggggcttggtcccagactctatgtagagttaaggaattcccacctgtcagaatctgcaggtttttcatctcatactggccattttcctgaaagaggaatcgtcctcatttcctaactggatgggggataggggtgcaggtacagagttgattcctagagtctgaaaagcttcctctggggaaagagagttgggggaaatcttgtattttatatacagacttttacttaatccccaccctcagctgtgtgcagtgttctcagatatagtcctctggtcaacctctgcagaagggaaacctctagcctgctgaaagttgtaactgttaaaggcttgtaactgattctcctattttagccccaccagcccctctacctttagatgtacatgaacattcccaaaattctaccaagggaatcggcctttgcattacaattggtaaaatgttgttgccctttgacctctgttgtctgctgtcatctttacctagcctactttttaggtatatatacccgctaaaaaaaaaaagtaactattatttggtggtttacaaagaaccagtaataaaacacaattgttaaatgttttatttttaagtggaagtctttttttttttttttttcgagacaaggtcttgttctgtcacccaggctggagtgcagtggcacaaacacagctcactgcaacctcagcctcctgggctcacgtgatcctcccgtgaacttagcctcccaggtagctgggactacagacgtgcctaattttctttttcgttctttctttgtttggcagagatggggtctcactaagttgcctaggcttgtctcaaactcctgggctcaagctcagcctcctaaagtgctgagattacaggcatgaaccactgcacttagccaaattggaagtcttaattaggaagaattatagttcaaatctgtatgttatataaaaaaatacagtacaacagtataaaatgaaaagtaaaaagtccttattctctgctatccccatttaaccactatttatacatcttgtgaatcctagaaattttctatgtgtgtgtatatttgtttatgtggatttgtgtatgcttcactatcttgattgctctgaactgaaactcatttttcatcatttgcttctaacatctattattaatgtcttttctagtagactgatctttcaagatcagggactccattttgttcatggatacatgactcccgtagtgtctggtacatacaggttttcctttcctgcctcagcctccctagtagctgggactacaggtgtgcgccaccagacccagctaatttttgtatttttagtagacacagagtttcaccatgttggccaggctggtcttgaactcctgacctcaagtaatcagcccaccttggccccccaaagtgctgggattacaggcgtgagccactgctcctggcctcggtttttcatatttgttgaatgactgaatgcagaagctcgggttagggaaagcagttttagaggctgtgtccccaaaaccaggtttcccaaggcttgaaagtgctattcctttcttgagttatgccaaaatgctgatcctctccattttattatttagacaaaaaggttggggagaagccattttcaggggaggggaacatgccatcagcaaaaattaatgtgaaggaacatatttcaagcagggatagtctccagaatgaaagagaggggaacaaaaacaaaaattagcacccatgctgtctcacatatgggcctcagaacagagaagtctgtctctgcttatcatggtaagaaaggaatgtttttcactttttgtcatgtcctttgattagttaatgtctttatttaggtatgtagggcccctgtgttttcagaattctattggccactttttttttcttttttttttttgcctgaggttaatgtttacaaaattcagaattaaattttgtattgcctttcccctagtgttttacatttctcaataataggaacttaatttgtcctggggttcttttctctttttctagagtacaaatcaaacgtcttcttttgaaatttaatactggtttaaaatataatttagttggcagaagtcagctgagctatagtctatttggatcttttcctaatattagtggaatttcttaggttgagaggactaggaagggaaaactgattttaagattggttttgggattcctgaaataggtttatgacttgtttttcagcaagcactgacacaatattctggttgttttctttaaactgctttggaaaggtgtcaaaaactgctgttcatcttctttgcaactataaaagttagctaaaaactgtaacctgagtcagacagtctttctgtgtgcctcatatctattggatattccaatcctctcatttgttttgcttttataggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctgtgagtaccctagtatgtgccacagtatttggaatttcctaaaatttaactatcacaactagcatgatttggctgtcaaaactagcatgccaaatgtaacagggatattcatttacagcttgtaggtttccataacatttgactcttctgcgcaatgtctgtttatggaccctactcaggacagttgtcttaaccccatttcactgtgtgtctatgagagagaaatgatgttgaggactttatatgtacaaattaccactgtgttttgaatttatttttttcctgcatcactactataaaagctgtgttctgtggcatccatgccttgtatggaatcccacaaagattggagataattttatcattttatacatgaaacaaaaccagtttttagtgttctttttagaggtaataagtcaaaatatttagaaggaattgcaccttattttaccaaactgagttggataaaaggactccctgtcttgctttgtctgaaaatttatttatttatttatttattttttgatggaatcttcttcttgtcacccaggctgaagttcagtggttcgatctcgcctcatggcagcctccgcctcctgggttcaagcgattctcctgtctcagcctcctgagtaggtgggattacaggcatgtgccaccatgcccagctaatttttgtatttttagtagagacagggttttgccatgttggtcaagctggtctcgaacttctgacctcaagtgatctgcccacctcagcctcacaaagtgctgggattataggcatgagccactgcacccagcctgttttaaaatcttaaaaatcaggcttctagggccaggcgtggtgggcacctgtaatcccagctgctcaggaggctgaggcaggagaatggcttgaacccgggaggtggaggttgcactgagttgcggtcgcgccactgcactccagcctgggcgacagaggaagactccgtctcaaaaaaaaaaaaaaaaaaaggaattaatggggttttaaagagttcatggaatctccatacactttataaaaattaaaaatggatcaaagacctaaatatgatacctaaaactgtaaaactcttagaagaaaatacagatttaaaatttcatgactggatctggcagtggttttttagacatgacaccaaaaatgcaaaaaactaaagtaaaaaaaaatatagataaactggacttctccaaagttaaaaactgttaggctgaaaggacactgtcaagaaagtgagccggggatggtggctcatgcctataatcccagaactttgggaggccaaggcaggagaactgcttgagggcatgagttcaagaccagcctggacaacatagtgagaccctgtctctaccaaaagaaaaaaaaaagtgaaaagacagcttccagaatgagaaaatgttagcaaatcacatatctcataggcgtataatatccagaatctataaagaactactgtaacttaataaaggctaataattcaattttaaaataacgatgtagttgaatagacatttctccaaagaagatacacaaacggccaataagtgcatacgaaaagatgttcagcgtcattagtcattaggaaaatacaaatcaaaaccacaacaaggtgccatttcacacccgctggcatgactagaatcaagaagacaataataagtgttattaaggatgtggagaaattggaacctttgtgggaatgtaaagtgatgcagttgctttggaaaacagattggcagttcctcaaaaagttgaacagtgattctatgaaccagcaactgcactcataagtatatacctaagcgaatggaaagcatattcatgcagcaactgtacactcatgttcatagcaacgttattcataatagccaaaatagtggaaacaactcaaatgtctagttcatgaatggagaaacaaaatgtctgtccatgcaatgttaattggccattaaaaggaatgaagtgctcgtcccatacaacaacatggatgaaccttgaaaacattaagtaaaagaagccagacacaaaaggacatatattgtatgattccattcatataaaatgtccagaacaggcaaatccatagaacagaaagtagattattgcttgacagggctagaggaaattcttcccaaactatgctaaaaaatagagtaggagggagtacttccaactcattgtatgaggcccatattatcctgataacaaaaccaaacaaaagacatcagaagaaatgaaaatgactaaacacagtggttcaggcctgtaagcccaacgctttggaaggatgaggcacaagcatcacttgggccctggagttcaagactccactgagctgtgatcgtgctactgcactgcagtctcggtgacagagcaagaccctgtctgcctctaaaaaaaaaaaaggaaaactacaaaccagccaggatctcttaggaacatggacacaaaaatcctcaacaaagtacaaccagactgaatgcagtacccatgaggaagtcagagtcttctggggaatgaaaggttggtttaacatctgcatatcaggccaggtgcggtggctcacacctgtaatcctagcactttgggaagccaaggtgggcagatcacttgaggtcaggagttcgagatcagccggaccaacatggcaaaaccctgtctctactaaaaatacaaaaattagctgggcatggtagtgcatgcctgtaatcccagctacccaggaggctgaggcaggagaattgctggaacccgggaggcaggggctgcagtgagccaagatcgcaccactgcactacagcctggacgacagagcaagactccgtctcaaaaaaaaaaaaaaaagtctgcatatcaatataatgcatcatatcaataggataaaagacaaaaccacatgattttctcagtaggtgcagaaaaaacatgttagcaaaatgcaacactctttcatgattttttttaaaaaagccacactctacaaatgaaggaataatagcaaacaatagaaggtaactacctcaacacgataaagaccgtatatgaaaaactcacagttaacatatttaatggtgaaagactggattttttccactaagatcagcagcaagacaaggctgttttcccactccactcctgtccaacatggtgctggatgttctagaccgggcagttaagcaagaaaactaaaggaatccatattggaaaggaagaagtaaactgcctctgtttgcagatgtgatgatctagtctatagaagatcctaggttatcctctattagaactaacaagcttagcaaggttggagaatccgggatcaatatataaaaatagtatttttatacacttgcagtgaacaatactaaaatgaaatattaaaaattcttccacttggcatcaaaaatagtaaaatagctaggaataaatttaacgaaagaagtacagaaggctaggcgtggtggcccatgcctgttgtctcagcgctttgggaggccgaggtgggcggatcacctgaggtcgggaggtagagaccagcctggccaacatggtgaaaccccgtctctactaaaaatacaaaaattagctgagcatgatggcgggtgcctataatcccagctactcgggaggtggaggcaggagaatcacttgaacctgggagcagaggttgcagcgagccaggatccctccactgcactccagcctgggcaacaagagcgaaactccatctcaaaaaataaataaataagtggagaacttatgctttgaaaactacaaaacactgaaagaaatgaaagaagatctaaataaatggaaagacatgccatgttcctgaatcagaagacttaatattattaagatggaatactctgcaaattggtctacagattaagcatggtccctattaggatccagctgctgattttgtagaaattgacaaactgatttaaaattcatatggggccaggcaccatggcatgcacctgtagtcccatctacttgggaggctgaggcaggaggattgctggagggcttgagcccaggagttctgggctcccaggagcaggggaccaccaggttgcctaaagaggggtgaacaaacacagattggaaatggagcaggtcaaaactctcatgctgatcagtagtgggattgcgtctgaatagccactgcactctagcctgggcaacatagtgagaccctgtctctaaaaaaaaaaattaaaacttcatatgaaattacaagggacctagggtagccaagaccgtcttgaaaaagaacaaagtagggagactcaaatttttttttctttcaaagcttactacagagccacagtaactaaggcagcatggcaaaggattctcagatcagacactgaaggcaccagcaacagaagaaaactagataaattggacatgatgagactttgaaacggaagtgctgtaatggttgtcatcaagaaagtgaaaacagagccaggcacagtggcttgtacctgtaatcccaactacttgggaggctgaggtaggaggatcatttgatcccaggagttcgaggctgcaatcagctatgatcatgtcattgtacctcagcctgggcaacatagtgagaccctcggctctaaaaaagaaaaaaaaatgaggccgagcgcagtggctaactcctgtaatcccagcaatttgggtggccaaggcaggcggatcacctgaggtcggaagttcgagaccagcctggccaacatggtgaaaccccatctctaataaaaatacataattagctgggcgtggtggcgcatgcctgtagtcacagctactggggaggctgaggcaggagaattgcttgaacccgggaggcggaggttgcagtgagccgagatagcgccattgcactccagcctgggcaacaggtacgagactccgtcccaaaaaaaaaaaaaagaaagaaagaaagaaaagagaacccacagaatggaggaaattatttgtagatcatatttgacaaaaatctagtatccagaatatataaagaactattacaacttaataataaaaatgatatatttaggggaaatttaaacactaatattaagacattaatattttttaggtgagatagaagtattgcgattatgtttttgttttgtatgtacttttctgacttttgtgtgtgtttggaaatgtccatattagaaaagaatcaaatctaacagtatcaactcagcagtactatggcagggttaacaggcctatctaccgagccagtttaatgtatactggggaagtgacattacagattcactgcaaagagcttaggttttggaatcagactctgccacttaaatgcactggaaccctgcacaaatcccttaacttgtcaacatctgtttttgcacctgtgaaactgggatattacttccttgtgtcgctttgtgaagaataggtgagataatgtgtataaaatgtctggcacatagttgatgcactagaaatgttaataaccctggggcgggaggcggtgggggaacaggttttttttctttctttttttaaatagaaatggggtctccctgtgttgcccaggctggtgttgaactcctgggctcaagtgatcttcctgtttcagcttcccaaaaactgagattacaggcttgagctaccatgccaattttttgtttcttgtttttactaagtttcagggtagaaggaaatgaaggtcactgttttagatgaatgggaaaaggcccttagaagttgtgtgggagtttggcatttccttctgactactgagcctccctgtttatgttttcattcctttgtctttgcttataaaggccactggtggcaaatttagttctagggtcatctgctttaagagaaaaaaactttccagcctgggaaacaaagcgggaccccctatctctacacaaattttaaaattagcctagtgtggtggtacacgcctgtggtcccacctacacaggaggctgaggcaagaggatcacttgaggccagaagtttgagaacagcttgggcaacatagtgagaccctgtctgtacgaaaaatttaaaaagtagtcggcgtggtggtgtgcgcctgtagtcctagccacttgggagactgaggcaggaagattgcttgagcccagcaggtcaaggctgcaatgagccacgttcatgccactgtactccagcttggtgacagagccagactttctctcaaaaaaagagacaaacttccattttgaatcttgaggaaatcaatgcagttgcagaatcatatttccttcctatgttgatatgtaggatttagtagcttaaataggtctaaaagatacttaattaaaataagtgacctggatttttttccccccaggttttaaccttttctattctttttcttagaagcaagaaaatatgttccacacccatgattatgtgattgtatacccaggcctttttatcggtgtgtgtaataataaaactggtgttaaaatgtagtacgtatttgccagcgcggtggctcacgcctgcaatcccaacactttgggaggccgaggcgggcagatcacaaggtcagaagttcaagaccagcctagccaacatggtgaaacccatctctactaaaaacacaaaaaattagcctggcgtggtggcaggcacctgtaatcccagctactcgggaggctgaggcaggggaattgcttgaacccaggaggcggaggttgcagtgagctgagaccacgccactgcactccagcctgggtgacagatcgagactccatctcaaaaaaaaaatatatatatatatctatatatatatatagatatacgtatatctatatagatacgtatatctatatatatatttttgtactctgactcacagacacacactatcaatacattatatatattgtatatatatatacaaggcgtggtggcacgcacctgtagtcccagctactcgggaggatgaatcaggagaatcacctgaaccagagaggcagaggttgcagtgagccaaaatcacgccattgcactccaggctgggcaacagagcaagactctgtctcaagaaaaataaaaataaataaaaaataaaataaaataatgatgcagtgataacctcatatgtgtcatttcatttgtttgaaattgtatttgtaggatacatgtgactgctagatcatagggcaaatggatttgtgatttgggtagacaagaaaagagcaccatattttttataacaaatctaaaaaagtatctgaccttcaatagtagttgactttttttttttttttttttttttttttttgagatggagtttcgctcttgttgcccaggctggagtgcaatggtgcgatcttggctcactacaacctctgcctcccggattcaagcgattctcctgcctcagcctcccgagtagctggcactacaggcaccaccaccacgcccagctaatttttttatttttagtagagagatggggtttcaccatgttggccaggatggtctcgatctcttgacctcgtgatccacccgccttggcctcccaaagtgctgggattacaggcgtgagccagcacgcccggcccagactcgcttttataactgacacacttaggataacaaatctactcctgcaataatgacattaatcaattcatggaggcacggccctcgtgacttaatcacgtcttactaggtctcgcctcccaacacagttccgttggggttaagtttccaacacatgaacgttaggggaccagtccaaaccctagcaaatggcatttcacagacaggctagggatcagatattacatcacattacatagttactttcccatttcaaattcccttcgtcccaagagccactttgtcttttcagttgtaaagccagtttcccacctgaagttggtattatagttcctcattagtactcagggatatttacatgtattcaaaatgaatctgaaaagcagttatttaagtaagccgtatgttaagaagtaggaggtctggaaaagtggctgatacccataatcccaacactttgggaggctgaggtgggaggatcacttgagatcccaggaattcaagacctacctggacaacatagccagacctcacatctgcaaaacaagacattgggattctgtttagaactgattggtgtttgatgttttcaacagttgcaaaatgcaaatttttaatttaaaaaacgtattaaattgtttacgttaaccttttgtatactggatattcttcagaataaacctatgaactgctgaattatggcatgtagaagttaagcagtttttcctaaattcataaacagctgtacaaacacctaggattagaaaaggagatgctgaggctgggtgtggtagctcacacctgtaatcccagcactttgggaggctgaggtgagtggatcacaaggtcaggagttcaagaccagcctggccaagatggtgaaaccccgtctctactaaaaatacaaaaattagctgagcacagtggcaggcgcctgtaatcccagctacttgggaagctgaggcaggagaattgcttgaacctggcggggcggaggttgcagtgagccgagatcacgccactgcactccagcctgggtgacagaatgagactccgtctcaaaaaaaaaaaaaaaaaaaaaaagaaaaagaaaaggagatgccaaaccacaattagggctgtgtctcagtggcgtttccctacataaggcaagatgaacggaaagtgttgccttcttacctggcacctcatgagagggtagttgtcgctctgctttgtaccccagcttccctttaataccgacagtaaattcatatcccttggccaggtttattttcttcattctataaaaatgcctattttaggaagcttacgtatagtagcacttgctatctgctaagcattgtgctaagcacttggcatgtatcatctcatcttccttattacgttcgtatgagatagataatattttatccccgggatttttttttttttttttgagatggagtctcgctccgtcgcccaggctggagtgcagtgacgcgatctcggctcactgcaagctccgcctcctgggttcacaccattctcctgcctcagcctcccaagtagctgggactacaggcgcctgtcaccacgccctgctaattttttttatttttagtagagacggggtttcaccgtgttagccaggatggtctcgatctcctgacctcgtgatccgcccgcctcggtctcccaaagtgctgggattacaggcgtgagccactgcgcctggcctttatctctgttttgaattcaaaatattcttccaaaatttgttactgctgtaactaaaacaactgacctaccaaagcactttggactaattttcttttttcaaatccctcctcagcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtaaaaagtaaagcattggtcccttcttcaggctagtggattttatcttcctcagaaaagctcttttctagttggtatattggtatttatgtagagctagaaaggaaaaattttttccctggttggagtttttgtttttcttttttctttctttttaaagatcaaatcaatatacagtaaaatgcatagaacttaaaagtgttcagttctatgactcttgacaatttcatccagttttaaagcaagattagaggaagtcacttgaactgtaagatctctttagcacttgacagtattcagtggtgtaatattgataatgctggttctattttaggatacctttttttatggcatctattggaaatgtatgaaaactactttatactgattggaagaacaacttccaggccaagcgatggctgaattgaggttaatgtttagtggaaacctcagcagactttgttttagcatagtctatactgtacctaccataattattgaattatagatgttgatctgtgtcagctaatgagatgagttcttaaagtctcattggtcctactctgtgatttttgtaatgttttttcctacactttgttttcctcaggaatctgcctttatgtccaatttagagcccaactaagtagagttgaatagacaagtgatttgcctgctggcattcagtactacagtattgcccctgccagagtggtagctgaaataccactcttgtggttttgctgaccttgatggcaggatttaaagggaattgaatttagagaaaagctgccccatgaagactagttttctctggtccaagtgtcttccgcctacgccctcatattctgtatggtcagctccttcttcatttataactctcaacctagggatcccctcctgagagaccttctctgaccatcctatttaaattggatacttattttttttatccagtctcttgtccgtttcctttgtagcacttagtattaacttgcagctttttttttttttttttgagagacagtttcgctcttgttgccctgggttcaagtgattctcctgcctcaccctcctgagtagctgggattacaggcatgtgccacaacgcccggctaattttgtatttttggtagagacggggtttctccatgttggtcaggctagtctcaaactcctgacctcaggtgatctgctaacctcagcctcccaaagtactgggattacaggcatgtgcctggccgttttgttttgttttgttttgttttgttttgagatggagttttgctcttgtcgcccaggctgaagtgcaatggcatgatctcagctcactgcaacctcctcctcctgggttcaagcgattctcctgcctcagcgtcccgaatagctgggattacaggcacccgccatcacgtctggctaatttttgtattttcagtagagacagggtttcaccatgttggccaggctggtctcgaactcctgacctcaggtgatctgcccaccttagcctcccaaagtgctgggattacaggcatgagccaccacacccagcacagtttttatcttggctgtttatctgttttctgactgtttaccccataggaatagtaacttcacttggataggtatcatgttagtctttcttaccctcataactcaaatacaaccctcatgtctcaaatatgacagttaggtgcttggtaaatatttttttgattaataaatgattgggctgggcacagcagctcaggcctgtaaccccagcactttgggaagctgaggcgggaggatcacttgagcctagttcaagaccaacctgggcatcatagcaagaccccatctctacaaaaagtttaaaaattagccgggcatggtggtgtttgcctgtggtcccagctacttgggaggctgaagcaggacgatcgattgagctgaggcagtcgaggctacagtgagttgtgatcacactgttgcactccagcctgggtgacagcataagatcatgtctctaaataaataggctgggcacagtggttcacgtctgtaatcccagcattttgggtggccgaggtgggtggatcacttgaggtcaggattttgagaccagcctgtccaacatggtgaaaccccgtctttactaagaatacaaaaactagctgggagtggtggtgcacgcctgtaatcccagttacttgggaggctgaggcaggagaatcatttgaacccaggaggcagaggtttcagtgagccaagattgcgccactgtgctccaatctgggcaacagaccaagactctgtctaaaaacaaacaaacaaatgattgaaattttaaaactagcagcttctatgctatttgtgataaaatttccaaagattatgaccaagtgtgttcatggatatcagaagcataaggaccttttaaaagctgaggatatctatcacatttgatgttttccttctcatttcatccttgggcctcaagatttgcattgtattttcagcccacattaggggcagtgttgcagtctaatggttaaagacattgactggtagtcagaatggggcctagtaacattcaaattctaaatctcggtgcctcttgactactttcctgattcatagcctatttctccaaaatgtgataagaataaatgtatgctgtctccagtccttgggaaaatggagccatggaatcaggtggctattgcattcgctgttgtctaaatgattgttcttcgctggcagccttttaggttcctcagaggtgactgaagtgatttttctatcacttatctattgctgtacaagtaatggccgtgaaactttgtggcttgtaacaacaaatatcttatctgcccatgataaagtatattaacaatttgaactgggctcagtgactcagccaggcattttttctgctgatttttgcaccctcttcacatacctgcagacatctgatggccgcaccagggctgagtgatataaggggaccatacttccctgcaagcaattggccaggccatatatgtcccagcaggctagcccaggcttcttcactttcttcgcatggcagctggattccaaaagtaacacaagagaagtaagacttcttgtgccaacacttttcaagcttctgcttgtgtgtgtttgctagtatcccattggctaaaagcaagccatgtggttagcctggagtcactccgaagaggggccacacaagggcctggatacagaggcttgatttcttggggcgatcactgaagcagttgtccatagctctcatgcatgccaccagtgcaaagggtccctgttgtttctgcaaattatgacaaattgtgatttttgatgcttactttcaaagagaaatcaccaaatttgttgccatcattcttgacagtcattcctgaagtggaaacttagaccacatcaggttttgcattcttgtcctatatcatgaagctagagagtttatgtcagaagtctagtcctcaaaacagcctcttgcccattgtgacctttaaacaggtgctcagccctgccaagctggttgggctatatgtgtgttgtgcaggtcctcgagtgggctcaggagaagcgtaagctgagcgtgttgcatattcacggagtctacaccaaccctagtggcattgtccttcatccggctggatatcagaacgtgctcaggaacactgaagtcatggtgagtggggctgatcttgctggtctcaggaactccttcctgggaaatctctctaaatatgccatagatcttaaaggggaacatcttcttttcattaagtgaaaacggaaggtcaggggctaggagcagtggctcatgcctataatcccaacactttgggaggccaaggggagaggatcacctgaggccaggagttcgagaccagcctgggcaacatagcgagactcttgtctttacaaaaataaaattagctaggcatcatggtgcatgctgtcccagctacttgggaggctgaggcaggaagattagttgagactaggaatataaggctgtagtgagctgtgtctagagccactgcactccagcttgggtgacagagcaaggccctatctctaaaaaaagaaagaaactggaaagtcagacgttcttcctgtgcttcttaacttatgggtgtgcatgctgtctaggaaatgtagaatttctcttaaggtgtcaaaccctatgatctttgtttgtacttaattgacaaccagcagatggcatgtcatcattggcatcatcttcacatacaaaggatacattagtaccctttatcatcatttggtttattaatagccctctctgtgtcagaaataattgaggcagcttcttaacaaaccaaccactactagagaatacattctaaagagactttgtataaatggcaatgggcttatattgaattaaccacatttattcacacttactctttgtgaaaagcttattgatcttttgggatgcacattttcgacttgttcagataaacatgttcaaaccagaagtattcgctgcccccagctctaagaatcttgtttgctgttttcaggactgggtcatatagattatagcatcttttaataatgaggcaaaagaccgagaaaatgtattgtctaaagcacaagggacttttttttctttttacccattctttcccaacatctgccataactgcatccatctctgacattgagtgatcccttaggcagtcatttctgtgtttttgtgtgtgtatatgtatacacacacacacacatactgatgttctaagtatcaaacgcctttccttgagcaaatccgatgatggaattatcttctctggtgattcacagttcagtttgtgagacaaaggcaaatatggtccagaaatggaaggattaagatatatgaagacctactctttgcacaatgacctctgggcacataaatctaaaaaagtacgcctgtaatcccaacactttgggaggctgaggcaggcagatcacatgaggtcaggagttccagaccagcctggccaacatggtgaaaccctgtctctactaaaaataggaaaattagctgggcgtgctggcaggtgcctgtaatgccagctacttgggagtctgaggcaggagaatcgcttgaacctgggaggcagaggaggttgcagtgagccaagaccatgccactgcactccagcctaggtggcagagcaagactctgtctcaaaaataaaataaaaataaaaaagtaaactactggccaagtgcagtggctcacgcctgtaatcccagcactttgggaggccaaggtgggtggatcactcgaggtcgggagtaccagaccagcctggccaacatggcaaaaccccgtctctactaaacattcaaaaattagctgggtgtggtggtgcacacttgtaatatactcgggaggctgaggcatgagagtcacttgaaccagggtggtggaggttgcagtaagccgaggtcacaccactacactctagcccaggtgaaagagtgagactccgtctcaaaaaatatataaagcataaaaaataaagaagtaaactactgcaccagtacactgacaccagctctatgaaacgctgattagagagcctacagaagaatggcaggtaaagataaaattttagaccaatcatcaagttacagcaataagcaagagatcacactccttgatgggacataccaacccacttaagtcttgcttaattggtcatcacagtctgctcaacgtagcatgaccttcttgtttcagacttgccttgagtgtgtcttcacaatgtcaatatgttgtatcttttccttccagagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcaggtaagatgcattttgaagctgaggggaatcagagaacaacagctcttcagccttttgtgtatttgtgatgtgatgggcaaaatagttgccaagatgaggaatgtaatgactgaccaaattgtaaaggaggccacagtcttcaggttagactaaagtgccacttggattatgggaagacagacaaaaaggaatacttgagcagttcaatatagacataggaagaatgaagaaaacagatgttcagcctcactagttatcaatgaaatgcagtttgaatttagattacaaaatagcgaagaaagatcacccaattttggctaaggctgtgagaaaataaatttattcatggagtatttgtggaaaggtaaagttagtacaacttttatgaccataaattagaagatgtaacaaaaattttcaaatctttgacctagaaatcccatcaaaacaatttatcctagaagtttctcataaggagataattggatgattgcacaatcacacaattgtacaaagatgcatgcgtgggaatgtaatttccattgaatgtagtggcaaaaaattggaaggatcctaaaattggtggagattctacagatatgccaatatttatttaattgatgaaatacaatgaaaccatagaagggaaagtgttttcattgccataaaaaaaaaagttagagacatatgagtaaaggaagaaaaagcaggttgtaaataccatggtcagctatattcatatagaattgtacattttttttttttttttggtgcgtgtagaaatgtatctggaatgtttactaaattaagtggctatctttagtaggatttaaagtgttgattttttggtttctgtattggcattttctatgatgattatgtattatatttacaaacagaaaacttacttttagaaatgctatttggaaacggataatggtgatattcaagtcagaggataggggtatcatacacttgatattttacctccacattctaacaataaagagcaaaatggtgattaaagattcagctgattagtggctgcaggcaaattcccagtaaccgcacaaaacacaaacatttttggtatcagctaaactgaagaatgctttttcaaaacctcacattgccaggctccagagtatggctagtgtgactcatccatctaattccaaaaaaacttggctgttgtgcacagaatatttcctgaaaacttatgtaagtattttcattgtcaacctgaatgcatcttaggagggcaaaagtacaggtaatttgtcctgtaatcccaacactgtgggaggcccaggtgggaggatcacttgaggccaggagttcaagatgagtgtgagcaacatagtgagaacctgtctctgcaaaaaattagccaggtgtggtggcacacacctgtagtccagctgcttgggaggttgaggcaggaggatcacttgagcccaggagttggagtctgcagtgagctatgattgcatcactgccctacagtctgagcaataaagcaagacgctgtttctaaaataaataacatacaggtaatttaataaacataaagcagttttcctaaatcaaatcatccccagatttcttaactgaatcagatggcttcaagtagaattctcctgtaatgaaaaattacacagcttcttccatggctatgctttgatggaaccagacttttaaaagccatcaccacatgaacaagtctcatttgtgaaaactatttactattctttgttggaaatgagtttttctggtgtcctgcagtgttctagactctcctgctgttgtttgcccacacttgagactttgagaaggcttttctgttgcacatgttgttttcattaacaagacatacatatccaagttctacatatttcttttgatctatatgctgaggaaagatgctaaagtttaaaacagcaaaatccgtctgcataactgtttctgttgcactaaatcttagcaaaaaataaatatgtctttagactgttgcattacataacaaagaagcagtaaggttccttagtgcactaagattgctctaaggaaccttaactgctattgtggaatggcacaaattcttttattagctgtgtaggcttcctaccagagtagctttccccgaagttacccatcattaaggtgttctgtatctttaaacaaaatcaaggattttcagtatggccagagtgctttatgggaatggtcagctgagtttgtcatgtgaaatgtagtagagcagtttcaggttaaaacatcatttcattttgaaacgagtcaaccttatctttcacccttgcataatgttttgagtctctgtagatatagactaatgagaggttacaggtcttttgctgttattttgttttttaacactgaacctttgctatgtgcctggcattgtgctgtatactcacttttgcatagtggaaattaattgtcttcaaaggattctatagtatgtagttacacatattttggaaaaatcaagcagtgggaaaaagaaaaataattcttataatccattaccatacaagcagtcgttgtggtactttttttttttttttttttgagatggagtctcgctctgacgccaggctggagtgcagtggcacaatctcggctcactgcaacccccgcctcctgggttcaagtgattctcctgcctcagcctcctgagtggctggaactataggcgcccaccaccatgcccggctaattttttgtatttttagtagagatggggtttcaccatgttggccaggatggtctcggtctcctgacctcatgatccacccgccctggcctcccaaagtgctgggattacaggcgtgagccaccatgcccgggcctatttattgatttgagatggagtttctctctgtcacccaggctagagtgcagtggcgcaatctcagctcactgcaagctctgcctcctgggttcacgccattctcctgcctcagtctcccgagtagctgggactaaaggcgcccgccaccacacccggctaattttttgtatttttagtagatacagcgtttcactgtgttagccaggatggtctcgatctcctgacctcgtgatccacccacctcagcctcccaaagtgctgggattacaggcgtgagccactgtgccagctttatttttattttattattattactatttttgatacagggtcttgctttttcacccaggctgcagtacaatggcacagtcatggctcaccacagccttgacctccccgggctcaggcgatcctcccacctcagcctcccgagtagctgagactaaaggcacataccacaatgcccagctaatttttgtattttttgtagagatggggtttcgccatgttgcccaggctgttctcagtctcctaagtgcaagcaatcctcccacctcagcttcccaaagttctgggattataggtgtgagccacagcacctggccttggcacatttctgatgaagttttccctgtgctttttttcatagttgtaaacaaaatatagtgatttttttttttttttggtcctttgaaaattcagtagtggattgtacattttcccacatccctatcttcataaccactattttaattgacttttatattccagtaggggtgttacagtttacctaattattcctgttaggcaacgtctgatattttttttgccagttttttgtaagtcatgttgtgaaaataacatctgtatctcttcagtttttccagtaatttccttgatgagttctcactgtaatcaggtcaaagatcaggaacatttcagtaatttataaatactgctaaattgttttctacgagggtaatatcaatttgtatatttgagtaccatgcctgtttatactgtaattgaccatatttctaatgactattttcttccatgtgttcagctttttactttttctgaactattatctatgccaagtgttatccagtagaatttcctgcagtcataaaaatactgtataatcttcactgtctagtatcatagttaggagccacatgtggctggtgcaccgttgaaatgtggccagtgtgactgaggaatggaatttttaatttgaaaccaagtagctgcatatggctagtgctaccgtattttattttgtgggagtattctgctgcttttcactcttctatttgaagttgctcactcacatgccatttgcccatccctggtgagattgaatttttaccgaaacttggccctctagactgtttagggacagcagacacatgttgcctgtatgtgaaatgtaaaatgtaaaatgtaaaatgttttgtctacaagcaatcgtagtgcactgtggaaactcactgcttccctgttaggtaatgcaagtctaaagactactccagtttatcctctctgcctccttatcttctcaatgattgtttcatttctaaatgcccattccttttcagtcgtaccatatgtcctcatctccctttagttttctttttgctattaatagttttagcttttcagtctaatgtctgatgctgatgtcctctatttagcagggatggtgagagaaggtcagctaaatggctcatctgcagcacacagtgaaataagaggtatactgtttcctattctactatttatcactctgtagcagaaagtctttctaggtccttggttaagaatatagagaatgttactttggacctcacattgccaaattttaaaaaacactgtagagaatgattttcctctcctacccattaaggattctatcttttcctatcaagtctattacaatctagtgcagtgatcagttaattttttgaaaaaagtactgctgggtgtggtggctcaggcctgtaatcccagcactttgggaggctgaggcaggaggattgcttgagcccaggagtttgagaccagcctgagcaacatagcaagatgctgtttctacaaaaaaaatttttttaaattgctaggtctggtgctgtgtgcctatagtcccggctactggctgaggtaggaggattgcttgagcccagtgagctgattgtgccactgcatttgagcctgggtgacaaagaccttgtctctaaaaagtaaataaaattttaaataaattacaagattcctagaatctcctgtcttgccttctgaagggttaggattgacttaagtatctgcagcttccaatgtataaacctgttttgtgaaacttcattttgttctcttttctttctccctacaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttacttgccaggaccctggctctacttttagagtcattgtaagaaactctaacttgcatcaaggtactaataagcttaattttaataacccaaagtttaaaggttccgatctttctccttggggtggagtgatctcattctcaggacaaccgtttacttacctgattcctcggagcattatcaacttctgctctgttgtcctgaccatacatatgtcctagaactacagttaagtgtgttgtggaattttagttttgaatcctgtataaaagaactccaagacctaaaaggcaatttatttatgaaatttattttcttatataaattacttatttctctgg

SEQ ID NO: 2109 - DNA, 11848 bp, Homo sapiens
cgcgctgctcttccccgcggagcccgcgcagtccgcgcagccctcatcgcaactgggcccgcgcgcaggtgagcccggggcggggtcgcgggggaccgggaggcgcggcggggctccgtggggtgggcgacggagcgcggccggcctgggccccagagtcccggccccaccgagagccgcaggggtgcgcgccgcctctggtccggccttgccctgctggcggcacatccgcttcccttcttcacctttctggcacccgcaacacgcaagcggcatgaaagggccctccgaggagaatgtcaccttttctgtcgcaaagaagctcgcgcggggcggctcccctttcgcttgcctcgctggaagagcctggcgctcagtgcgttgtggatatcgtttctcctcacgttcttctctgctccggtcacagcctcttcctctgctcttcgggttgtcattgtggcagtgattcagcaagtgcataacattagttagggtcagggacctatcgaggcattacaccacagtcatgggcagctacacacgggctgggcagccactgtgccaacgactagggtgaccgcggtggaccagacagatccagtcttctggtccccaggggacagacaggtacgctagaatcacagcataccctagaagtgcaacagagagggggaagtgtggagaactcccgttgaaacaccaaacctaggggacaccaggatcaggaatgactcagagggaaccacatctagttagtttttagatttaaaagagttgatacgtaggcacacaaatcctaagtgtacagctcaaccattttccacaacacgcacatttcctgattcagagcaatcaataaaacatgactacatccctggcttctaacgccataaaataggtttgcctgttttggattttccatccatggaatcatatatcatgtacttcttttttttttttttttttttgagatggagtttcgcctttgtcctctgggctggagtgcagtggcgcaatctcggttcactgcagcctccgccttgtgggttcaagcgattctcctgcctcctcccgagtagctgggattacaggcgcctgccaccacgcccggctaattgttgcattttcagtagcgacggggtttcgccatattggccagggtggtctcgaactcctgaactcaggtgatccgcctgcctcagccttccagagtgctgggattacaggcgtgaaccactgcgcccagcccttcatgtactcttacgtgtgtgacgtctgacattcagtatgttttgtgatattcacccatgtttagttagcagtttattcttgttggtatataatattccattgtatggctagaccacaatttatttatccattctactggacacgggttgatggacagtcgtttccactgtggggttattttgtatcttgctgctacagacattcttgtgaatgtcttttggtaaacatctgtaagcaggcggggaacagtggctcacacctgtaatcccagcactttgggaggctgaggcaggcagattacgaggtcaggagttcgagaccagcctagtcaatatggtgaaaccccgtctctactaaaaatacaaaaatcagccaggcgtgatggcgggtgtcggtagtcccagctatttgggaggttgaggcaggagaatcgcttgaacgtgggaggcagaggttgcagggagccgagattatgccactgcactccagcccgggcgacagagggagactccgtctcaaaaaaaaaaaaaaaaatatgtaagcactgctgtttgagtatattcgtaggactgaaattgctgatgtgtgtatgctcatcttagtctatggccaaacacttctccaccggcagtgttcgagttcccatccctgcacactcttaccactacttgatagtctttttctctgtagccatttggctgagtgcccagcagtgatgcattgaggttttagtttgcatttctctgatgactaatgaactgttttgatgtctattgctcatttgaatattccttttgtgaagtgcctgctcaattcttctgctcatttttctgtcgtcttactagttccattgagtccttgaaatatttgtgatataagacatttattggatatatgtgtgtgtgtgtatatatatatatatataatatatattttatttgatttttgagacggagtctctgtcacccaggctgcagtgcaatggcgcagtctcagctcactgcaacctccgtctcccaggttcaagcgattctcctgctttagcctcccgagtagctgggattacaggcacctgccaccacacccagctaatttttgtatttttagtagagatggggtttcaccatgttggccaggctgatcttgaactcctgacctagttatccgcccgcctcggcctcccaaagtgccgggattacaggtgtgagccactgtgcccagccctggatatatatttttaaacattttaaccctcgggagattgccttttcactctcctatttatgtcttttgatgaacagaagttcttcattctaatgttttttattttatcattttttccccttatagttgtattatttgagtctggtttttaaaaaatcttccctagcaagaagactcagataaaagtaaaattaaagctgggcatggtggctcatgcctgtaatcccagcactttgggaggctgaggtgggcggatcacttgaggccacgagttaggagaccagcttggccaacaaagcaagatcctgtctgtaccaagaaaaattaaaaaatgaaaaaaataaattaggtaggtgtggtggctcacgtctttaattccagctactctagaggttgagatggaagactgcttgagccttggaggttgaggctgcagtgagctgtaatcacaacactgcactccagcctgggtgacagagcaagaccctctctggaaaaaaaaaaaaaaaaaaaaaaaaggtcgggtgtggtggctcatgcctgtatgtaatcccagcactttgggaggttgaggtgggccaatcacttgaggtcatgagttccagaccagcctggtcaacatggtaaaacctcgtgtctactaaaaatacaaaaattagctggatgtggtggcgagcacctgtagtcccagctactcaggaggctgaggcacaagaatcacttgaacccaggaggcagaggttgcagtgagctgagattgtgccactgcactccagcctgggtaatggaatgagtctgtctgaaaaaaaaagaaagtcatgggtccttctcacagtcccaggtgtgaacacagggggccaccctaggtctgcaccatagtctacaaacctctttgagaacactgtgttgtgtctatcaagctataaatgaattatattcaggactttaagtgacattgtcctgcaaaccataattaatcctacccaaacgttttagcaagtgtttgagaacaaaacagcctttgaaaccaaaattcttttaaatgtaaagtcaaagtcaggtgaagtatagatggtaatttatttatttaaagatgtaaaaactgtttcaaacaatttgaacctttaaacagaccaggttttagcactcaactgaaatccaatactttctccattcattggcctgatctaatcagacacagtgtagtagtttcctattgctgctgtaacaaattgccacaaacttagtggcctcaaacaacacacattgattatcctgccgttctaagatgggtcagcaaggccgtgctccttctgaaggctccaggaaagaacccatggacttgccttttccagcttctagaggccacctgcatcccactgccgcctgcttcccttggcacagctctttcgtctgcctcagaccttcctgcctccctcttgaaaggatctttgtggttacattaaactcacctgggtaatccaggaatccctccccatcacaaggttcttaatcacagctgccgaatccccttttgccacggaaggtaacatattctcagttccggggattaggatgtgggcctctttgtgggccactattctgtctaccccagatagtgattcctgcttaacagaaatcgaatatgaactctaagagatacatattctaattatatgccttcacaggctccagtacattccctatataatagaaattggagaccagtttgatattggatactaaatacactttggatttttttttttttatttttgagacttgagtcttgctctgttgcccaggctggagtgcagtggcatgatctcggctcactgcaacctccacctcccgggttcaagtgattctcctgcctcagcctcctgagcagctgggattacaggcacgcaccaccacgcttagctaatttttgtatttttagtagagacagggtttcaccatgttggccaggctgatctcaaattcctgacctcatgatccgcccacctcggcctcccaaagtgctgggattacaggcatgagccactgtgcccagcccactttggattttatacagcaaaactccataatgtttcctttacatcagtttctgcacataatattggaaaagcattctagaaagcactaaaggtattgtgctacttcttttctgaagaaattctttactaattttcttttctttatttttttgagatcgagtctcgctctgtcacccaggctggagcacagtggtgcaatctcggctcactgcaacctctgcctcccaggttcaagggattatccagcctcagccacccaagtagctaggattacaggtgtgcgacaccatgcctggctaatttttgtatttttagtagagacagggtttcgacctgtcggccaggctggtcttgaactcctgagctcacatgatctgcccacctcggcctcccaaagtgctgggattacaggggagcaccagcacacccggctaaattttgtatttttagtagagaaggggttttgacaggctggtctggaactcctgagctcacatgatctgcccacctcggcctcccaaagtgctgggattacaggcatgagccactgagcccgttccctttactaattttctatcaagtcatagttcttacaaagtgggtatttttggtatgattctactttatgaattttttcaaagcacaaagaaagcgactgcgtattagaccacacagcaaatcagagaataggcagagctagtgagtagagcttccagttggagatttgggttcattaccttacctacttgtcaaccacatctcaagatatgatgacagttaccaggtcttggaaagattaacacgtgtttgaatatgtgacagttccacagctccagctacaaaagaactgaaaaggaacagggaaggtgcatggcgtcttggattccaggaagtaggcagtgtgtatggttactggaatttacctgccatcttgctcaattatcctgtcaaaggtgctgttatttttctctttaaaacgtttccatgtttctcatgagggcttataccaccgcacttctggtggcatatactgctggacaactggatttcttcttaaccaagcaatggaaaagcaatttcccccaattagcatgcgttgccaaaagggcaagtcatttcataaaatgagaaactgaaactttaaaatctacatatattaagtagattaacatattatgttaatttttaacctttagaatatttacaaatcaaatgatgctctagtttacaagtgcaccaaggccaaataattaatattaaaattaaaacagaattgaaaaaatatttaaaaaatgcaaaaaccaagtgacatcatgtttactactgggggcaaaaaggcatcctgaacggccctagctgcagcctaccacttaggctgtctgaaatcccaagcatattaggaaagaaaagaaactcatatacatactcatagtcaacgtccagtgccgttttggtggcttcacatttagctgtgttgctttttcagatgtcttctctggttcctgtacccattccaaccctttgctctgcctcctttgctgctatggtttaagttctacttcttttttgaactttgatatatgatcacaaatcctcagcatcccttgtcttctacgcatcagtgaacaaagcattaatgtgcagcatagaatgacattctttaattttttttattgagatggagtttcgctcttgttgcccaggctggagtgcagtggtataatctcagctcactgcaacctccgcctccaggttcaagagattcttctgcctcagcctcccaagtagctgggattataggcgcctgccaccatgcccagctaatttttgtattttcagtagagacaggggttttaccatgttggccaggctaggcttgaactcctgacttcaggtgatccgccgccttggcctcccaaaatgctaggattacaggcgtgagccattgtgcctggccacattctttaaattttgaaaccttttattttagtgtgtctaataatacttgcttccatgagttctcaggtttgttttgatctcacagatccaccaaagagaaagcagccctgtgccagttgctctgccagcctttcacaggagaagtgtcactagaatactacagcccccacaggctctgctccacagaaacttaaggctgaaagagtgtccgccatcagggacatcctctgtcactacggtgggaaaagaacatggcaggttgcctttctaagggattcttgggcctttgtatttccatataaatttagaagcagtctgacaacctccccaccaaaaaacctaaaaaacaaaaatcttctagactttggaacagcactgaattaatgatcagtttgggaaacgttaacattacaagtttaataaaccatgaacataatatacccctccaatatctagattattttatatacatagtagcccacattttctaagcatttattacatgccaggcaccattaggactttacataaatgatttcatttaatcttcacaataatgctgagaaggaggctctagtacttccatttcacggatggagaaacgagtttagcaaggtggccaaaggtcacggttaaccagagatgagaatcaggcactctacctgcagtctgcagtctgtaccactttttgacatgaccttcctgagctgacggctgcaggggcgatgggtctatggatggagttattcagggggaggcagacttggaggaaaagtctcccaagatttcctgcatgtgctctctctctactgttcagcttctgtctatctggatacataattatttgtccaaatagcaactgtccttcttctgccatttcaggccttacataggaagtccttctaaagagctgcctgccagctgcccttccccagatcccgaatatcctcctggccaggtggagcagagaacagttcctcagctggtcatgctgagctcataccctgtaagtctgaccacactacacagctttggctttatctagaatccagctccaatcacagtcgtgtctggccctaatctcatgaggaatgaaagacccatttagagaagaagcctctgtcaggcattaggagagaaacagaacttcgcagagctcatccatggggaatgagagcagggtaagtgcagcctttgtgattctctctctctaccctctgtaggatggctgctccatgaggtcaagactgggtctcctccctcctcccccttcaccaatgcctggtctcacggggctagttttgacccccacgctatggcatcatcgacctccctcccagctcctggctctcggcctaagaagcctctaggcaagatggctggtgagtggaaccggactcgcgactctgctgtgttcctgagtgtagtgctcagcctccatagggcgcggtgggaggcctgcctggtccaaactcagagagacgcaggaaggctgacgtggggaactcctgacctgaattcagggcctggatgctttgtggagagtgaggaggggaggcctgcgtcagctcagccagatctttatccttttggctcaaaggttttccaggcctgctcagctagctttcctagcctggaaaccactgtgctgagtgcttaacactgtctcttgtcgtccaaatctttgttccagaaccatttagaggagaagccaagcagagagagaaaatgaatcaatccccaccacaactatctgtccttatcaaaggctggggaagctgttttcatctccttatggagtcccatactccaaacacagacctgagcagtgtttctcccccacagactggttcaggcagaccctgctgaagaagcccaagaagaggcccggctccctgacatacctgacactgcattatctcagttaactttcagcaactaagacaggtccacaagtccacagtcaaagccgtgtccctgactccagagtgtgggttctgaatcacgaagctctctgctcctcagcaactctgagcagtagcctcttccccatttagcgacaatctaggatttcttggggccaaacagatgccagtcctccgtaccccttccttcctgtatacgtagcccttcctaatctaagtccacctcccctcagtgctgaaagtgggctttgggactgatggatccttgctagcataacgtagctctgcctgcagactcccggtggttgactagtcagctctagtgggaagttctgcttaaggtgggctgggctgggggtaccagatatcaaagggcctggagtagtgcaaggccatttctcttaaccaggctggtggaacactctcacataaggattccagagttctgacacgtccaaaacctttacctttagagggcacttttaggcaagtcccaaaagataaacaaaaatagcagagtgctgggcacagtggctcacgcctgtaatcccagcactttgggaggctgaggcgggcagatcatgaggtcagaagttcaagaccagcctgaccaacatggtgaaaccccgtctctactaaaaatacaaaaattagccaggtgtggtggtgcatgcctgtaatcccagctactcaggaggctgaggcaggagaatcgcttgaacctgggaggcagaagttgcagtgagccaagatcgcaccactgtactccagcctgggtgagagtgagactctgcctcaaaaaaaaaaaaaaaaaatagtggagcaacaggtctctgagaataagatgtttcccagtgcagggaggtgggctgcagtctgtctgtcctccctgtgaggtggggctcctccctgtgtgggcagtgagagggcacctggtaacacacaggcctgagcagtgtttctcccccacagactggttcaggcagaccctgctgaagaagcccaagaagaggcccaactccccagaaagcacctccagcgatgcttcacagcctacctcacaggacagcccactacccccaagcctcagctcagtcacgtctcccagcctgccacccacacatgcgagtgacagtggcagtagtcgctggagcaaagactatgacgtctgcgtgtgccacagtgaggaagacctggtggccgcccaggacctggtctcctacttggaaggcagcactgccagcctgcgctgcttcctgcaactccgggatgcaaccccaggcggcgctatagtgtccgagctgtgccaggcactgagcagtagtcactgccgggtgctgctcatcacgccgggcttccttcaggacccctggtgcaagtaccagatgctgcaggccctgaccgaggctccaggggccgagggctgcaccatccccctgctgtcgggcctcagcagagctgcctacccacctgagctccgattcatgtactacgtcgatggcaggggccctgatggtggctttcgtcaagtcaaagaagctgtcatgcgttgtaagctactacaggagggagaaggggaacgggattcagctacagtatctgatctactttgacttttaggagacagccctgtagcctagtagttcaaagcgcagcttctggaaaaggctgtcggggtttgtatcctggctcctgcacttattaacccataaaaagtaacttggccaagttactcacccgctctgtgccttggtttcctcactgaccaacaggtttccattgctatgaaatgagaacagtatatacacgaagggctcagaacatggcctagcacatgtattcataacaggcagcgcctagcacaaatcaggtcctcaagttaatagctagtagtagtaacagtaatagcattaggtttctctgagatcaggctggagatgtccatcaagagctgggaaggtgccaggagggacattggtttagtaaggcaaaatgatgcaaaataataggaaagaagtgcatataagtgtatctggggagggccatgctattgcagtaggtttggaagtgtaatagataaaaagatagaagaggcaggacctgttggggaaaacagatgctgggtttgggaggtgtgacaacgctgtgattggtctctttcagatctgcagacactcagttgacacttgttatatcatgggaccccggaaattggagtgaagctagaaacagaaaacccatgcagggcctcggattcccacaaatgtgacaagaggtatagggagtgagtcacagcgctttgctcgtgaccctgggatcagagcacccatcaggcttccattactgtgggctccctaagaagaccatggagagcttggggactcccccaggaaggccgtgaagctggggattccccctaggaaagccatgaggaagctggggactccccaagaaggccatgaggaagccagaaattggaggtggtaggaagtggtactgatcaatgatggccagcaggactcatctcctgcctaactggacaggaagcctggcacccacttctgtcttcccctggaactgggcactggcgtacactggtatccctcctaaagaagtgactcacctgactgatcagcaagaagcctagattgcaggcctcaccatggatggtcttcctagttgcctggggaaaccctggaatgggcatcaggagaaagcaacaagaatccagtccttcacactcacactactctgttcctcttcccagagacatcgattcacttcaaagagctgtagggaagatgcagtcagcactgcactgtattttttatttattgcctaggtgccattaaagacacaaacctagaagcctagaggccattctgaatatgggggtggggtggtggagggagcaagtgaagagatgggaatccagggctcagggttcaatgccttcacctgagatcacaagcccatggatgctgtgacatctgggagcttcatcagtggtctggctaaagctgatactttcacagtcaccatcttcacctttggactgggaagaatcaccatttttcttctggcagatgactgtattccttataggacaggcaaggtttcattcatctgttctcagtaagtttgttgttgaactgaaatgaatttcattatttcctccaatgtgtacttttgtgcccccctctcacttctccctatcatgacccctcttttgctgaaaaaaatttttattattttttctatctctagttctagaaagagaaaatttattttttaaattataaactattttgccaggcgccatggctcacacctgtaatctcagcactttgggaggccgaggcaggtggatcacctgaggtcaggagttcaagactagcctggccaatatggtgaaaccctgtctctact

SEQ ID NO: 2110 - DNA, 6065 bp, Homo sapiens
ctccaagacctaaaaggcaatttatttatgaaatttattttcttatataaattacttatttctctgggcagacagccttcaccttattgcactaatagcacatctgtaatatcaagctacaggacaagtcttaacaagaggtttgtgttcttcaatgtagcacttgtctaccaggcactgtagaggggagtgatgaggaaaagccaggactgcttaggaggtgaaggatgggaggggagggggtcatcatacatccttctgacaattggtttcctcccaggaaggggaacatgcagagcttacttctggattctgggagtgggaagagttgggaggccaagaagcccaatgcaacgctgcagctgagctccttttatttctgagggaagcaaggactcatcttttgctcatttgtaacaaatcactccagcctagctgatgctttggggtaaacaatggagtaggagtcatcatcagaattagaattagcagcaattaacaggcaatacactgccacagtgaggcgggtgtcatccaggtcctggggacctgcaggctgtgtatcctagggagaggtgccattcaagacctggcgctggctctggaagagtctcttaacctaatgcagctgggactcattaggctcagacggctcttgaccacactaattattagcaaagctctggtgttgggttccaaccattggtcaaagctgtaataagactgagtctgtaggcagagtgaagggggtgcctgagtaggaagggggaggcccgctgggagagggtcagtgggcagtgattgtaacatgattaggccttccttgcagatggcggctgtgctgaacggggagtggggttggaaggagccacaagccccctcactctgcctttgtactacactgaagacaggttgctcacatactctaaagcacattcttgatacaggaagaagggcttgtggggaaagcggcgatttggtattgggcaagagccacgttaagccttcatgagggcagccaccacagccttggcattgaggctgcgtaggtcacagtaggtctggccggtgcccacaaagacgatgggtttgcttgtgatgtacgtcatagaaatagcagctcccacctaagtggagaaagaggacagcccatcaacacaagcccacttttcactcaccctctcaggaacaggaagcgctggagccaagatttccttgcagcctcagctcctttgtgcaggacgcccattccagcctccagtctcacgtttaccttgtcatcaatggtatcaaatttggtaagaacaatgccatcaatgagccgaggtgtctgagccatagaatggtcagccaaggctctgttgaacttgacctggaaagaaaaagtgatagaagtgtaagaaccatctaaattgaccaaagctcaagttgtaaagggaactgggcccacgctctcaccagctggtccacggcttcattgcctactaaggcttctcctacaaacagcaccaaatcaggtgtattgacagtaatgagtttggccagggcagtcatcagaggggcattgtcttgcatgcggcctgccgtgtccaccagcaccacgtcaaagccttggttacgtgctagagaaagaaagtagtcaactctgaacacctggactaccactcatgctcgttcccagcttcctctcaaaaagtcctagtttgactacctgttcactgtcttgggctctggatttggttccaaggtaatgtgagaaaaacttgattatatgcttggccatcaccaaacatattcaggaaaaggaggacaacaggatgaaggtgaccaaattcaggtttctctggttaaggtatattagctttgcctgcaactacatctgttatccaaaagcagagcatggcaagtaactgatctgactttttactgtaattgaccaacgagtctgtagtagcacaagcctgatcttctgcaaattccaagagaacccaaggagaaaaagggaccccaaataagcccccacacttcccatgcactgtaccaaaagcaatggcttccatggcaatgccagcagcatccttgccatagcccttttcaaacaactgcaccatggtgcggccaccatgcttctctggagggtgtagggcactcaaacgccgggtgtgtgtacgcagctgctccacggccccagcacgaaatgtatcacaggcagcaatgaggacactgaagccattctctaacaaccagaaggaaatctgtgaaaaagacgtaagaaaagtcacctaaagccaggattttgagacacaagaagtacagaaatatcagcgataggctggggaactgcactgaccttggcaagattagtagatttccccactccattaacgccgcagaaggtgacgacataagggcgctggcgacgctgggcatccatgatgtcccggagcatgtctacacgacgctgtggctgcagaatctgcaccagggactcctgtagggcttgctttactgtggaagtcaccgctgaaaggggaggtggaggaggttgcagctgtgaaactcaaggaatgctctcaaaaatgcctaacacctttctgagctaaggggactaaaacagtaaattagactcttgtcccagaaatccagaacagacgcacattacaaggactaactcactgaatcctctcaataacccttaaaatctaggttacagaggtttagaggttaaggaatttgccgaaagtcacatacctagtaagaactgaggtctatgcacttaacctacacataagcactttctcacttaggtaagtacttactgctgaacgtccccatcaccttcccttccaacttgttggcaacagattcacagagctggacggcaatgtctgcagccacgttcttagctgaggagagggggacaggtatgtcagttccatgtcagcaatgaccaatctttatggtacaggtgagaaacgctaggtgattctgctctcaactacccctatcccgcgagtatgagtcagcccggtcctcagaacttaccaatgagatgatcacgcatcttgtccagcacagattccatgtcttcacgactcaagctctttgaacccacaaggcccttcagcataccaaacatgccacccagtgttcccttggtcgcactgcagggacaggagattacacatacacataaaaccagtaggcaggagttgtatcttaccagttttgcagatgcatataccaacccccacctgaaattcccctacctaggtttggtagagttttgagcagccccttcgtcatcagagctgctgcagtccagatcctgaagctgccccccagacccagtccctcgaatctggaagatacggggaaaggatgtggggtcaggaacactaaggtctctgaggaaaacgtccacattgctctatctctttcattttgggaagctccaagtataacttacccctcattcaaatcccagtatcacgttcccacactctacttcctcccaatttgttgttaaagatcactttgacccctgttacctcttaccaggttgatgtcctcagacaaggcagcctcaggggttccattggtggtgggagtactgtaatccaacacttctttgttagcacagccacccagttcccacacccggggtgcttttttgcccttctcctttggagcatctgacttcgtggacttgctgcaacaggttatgatacaaagagttatggtggagaagtaggaaaggaaacatgagccagagaccagaactcccttgcacccattgtgtctagataacagtattttgagagtactggagaaagagtgctcacttggacttctccatacccctcccatgcttctgaatgaactcctcgcgcttcctgcggatcagctcctctttggaaagttctactccgttctcaggacccactggaagacctgacttttctgcagggactggtttgctggtagccaaaggaccatcagaacctgttggggaaaaaactcactgaagaaaaaagaagaccaatcccaaccactagacaatggctaaaagtcttccaaattgttcaaaggaaatttggaccaaacatcttggagttcataaggcctggggattataggatggtgaccatttgagtgagaagcaggtaagcaatgacaaaaggaaggaccacctcagtccttagcaccgtgttaacacctttcatgtcccagtatatccaaagaactcaaacttgccttccttcttggcccccttttttttgctattctttgctttttccttgggcttttccccccgtgtctcaatcatggacctcacaggtttcttggccttttcagaatcttcaaatttcttcatggtagtgggagcacggatcttactgctctcctctgcttcactaaacaaaaaggagaatggtttatctttctaccccatgcagaaggaaaaataacggtccagagaaaggactctcacacccaagaggacaatgagaactgggtagcaaattaggaatgtctttgaacacatcaatttaccacctttgaaccaccttcagagaggtcatcaaatcatggaaataaattgattttagagaaggcaggtctctcaccgaaggagccgcaggaagtcattttggaaatcaaaagtgccatttaataaacttaaagcactttgctgttggatctctgtgcggtacttgtcccgaaacagccgatgcacgtcatctatcaatttgtctacatatgtcagtgtcaggatcttctgaaaaccaacctgtttaggggaagaaacagccaacagatctgcttacatactagcctagaatggagggacgccaactcaaccctggctttcagagataggttcagctacctggccggtttccctgtcctgagaggcagccaagctccctgcctgggcccagtagctgctgttttcccccatctacctttctagttttttcagttacgtcatcatatacactggctgcaattaatcagagttctcttaaaaatcagggctatgttaacaatgcaatcgtccctctacaacaccccacttaccacaaacaccagctcaaactggttgtccagtttatacttgagtgtgagtgcctcatgggtgaaggagttgttacctccccgttcctggagaaagagtatgtctcagtgttcagactatccccagaaaacccaggtttgggccctgggtttggataacctttgggaaagagccaaacatttcccccaaactcaaatctgtccccaggacaagaggatgttggggcacttctctctggcattccaccagaaataagataaccaagttgggggaaaaagatgagagagagagcaagacacatgggagccaaaagggaagtagtcatgtaaacaatcagattactagcagctatacaccatttagttttgtaaaggtgttttcccatctgttatttcacctaggctcgaaacaacaaaaccaagctgctggggataaatagagggagcggaggagaatcccaaaggcgccggaattcggctagagttgagacaccagaggcgggggccgtcattaagttgcggggtagtctgaaggggacgagaaaacgaagcggagtccgggttacgcgtgagtggtcagtgtgaggtgggcggggagggtgggaggaggcgcggaatagagtcgaaggggaccatggatcgggtcaggaaagaagagcctggagttctgatcccacggggacggtacctgcagcagcacggaacgaatcaacgcgttaacgggtccggtgcatgagtcgctaacgccctggaagcaccagagcacaagcccgcccttggagaaaatggtgaagaagtcgagcatggcggcagcggcagaggagctggggccggcgccgggaattcaggccgcgttcgccgccgcttcctgctgcgccaagcgcgggacacgtcacaccagtggccccggaaatcggctcaaccgtacttccgctcagaacgccgggtgccctccccatctccgcccgggggcgcgcaggact

SEQ ID NO: 2111 - DNA, 6065 bp, Homo sapiens; identical to SEQ ID NO: 2110

SEQ ID NO: 2112 - DNA, 11227 bp, Homo sapiens
tctttcacaaaaggtgaaatgagctctttgtagtgtttcccgcccaggctgcattttagaatcacagaggaggtacggcgctgatttgttttactattccctattcatgcctgggccccacccctaaccaattaaataaacatctcggagagtggggcctagactttatatgtttaagctcctcaggtcattgcattgtgcagccaatgctgtgacctatgaatacaaaggaagatgaaacgcaccctggtcatgcaaggaagatggagagagggagcagggagggtgagagaggctgcagttcgtaaggtcctgaaatgttagagctggagggatcctggttcggagcactgcaactcaaaagagtagttctagccatgcagcaggccccattagggagctggttagaatgcaaatccccgcctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaatatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctacatgtgggactagagctgcgaacaggacagacccaattccaaccctcacagagcttatatcccaactggggagacagacagaaagaaaacaagtaactaagctgatgacagatgggaaaagctatgaaggcgaggagggccatgtgtagggaacgactcagagattgctgtggggtgaggggtaggtaaggcacgcccctttcagaagagctgtcgggggagttactaggacaatacctttaactggggactcctgctgattacaaactgatcacttttctttactggacaggactaggcttcatcccctctggggtttggggatggtgcttctgactctcctgaggcagtctgaccctggtccctgcctggctgtctcctctgactcaagactctgatccttcagtgtttgtgggttcagagcagagcctgggaatgagcccgctggggagcaggacactgactccaccataggacagggctcaggatcattggttaatggtttgtaaaatggaccaggcctcatccagatgctgtccccagcccctatgaaaacatggaaagtttccactggtgcacaaacactagtgcttgcctccctttcctgatcaaccgtcggactcacatgggctgtttgtgaaaatgcctgtcccaggccatactcaggctgaccaaggtggtctggtctccagggaagggccgtgaaatgtatttttaggaagtggtccaaaggactcttctgatccagatcatcaggaagcatggcgtggatggaagaaactggcacttggcatctggtgcctctgtgtggctgtagaagctacagaaatgtcttctgcagtgactgcagcgtggccctggctgagctggtgcttgtgaggaagcctctgcttgtgtgcaggggtgaacagcagctcaccccttcccatgcacagtcctcaccttactaccttcacccttactggaagcatctcttgacttctctttggccagccagaccctcccagctccctgtgctccccatttaaacaccttccctccctgagcttagcccatggctgggtggggaggcgtgagcactgtttgcatttggtcagggcctagaagggatcaaggaggcctcatgaggaccatgtcatagccccaccctcactccccacccctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcactagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcgcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagca

SEQ ID NO: 2113 - DNA, 58998 bp, Homo sapiens
ccttccccgcccccaacccgggcccgggtccccgcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtgagtacgcggcggcggtgcgcgggggcccgcggggcggggcggggcggggagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggagttgtcagtgggaggccggctgtgcccagggtcctagggccacgttatgggggtcgtcaggcctaggccactgtgcctcagggctgcatgggtggtgagcagtgggagggatgcgatggggggagtgggctcagctgtctgctgtgggtgtttcctcggggacctggctggcagggacctcccggccagcccagaactgccaacatgtctgccagcactgcccctccattcccagtcctggggggaggctctgtctgggcagcttgaggcctgacctactgtggctgcttcctctgctccccagcctgggtcctgagggcctggcttaagggaactgctgccagaaggctgggagtgtaggcagtgttcgggtgcccagctgtgccctgtctgacctcatggccacccacaagctggcaccccccacaggcctcttggggaagcctgtactttccaccgccggaggcgggtaccgcgtggaagccaggctcaggcggactcattctttttgaactttgggaacaggcctggtacaggctgagttctcacaagagacacacacccgtgtcactgtctcctgagctgtgccggacccgtcctacagactccacctcctctaggtcctggccctggcatctgccagggggattttaaatgagttgatatatgctaagtgctttgaaaggcgcctgcacggagggagagctgtataaatattcactattggtaatatttctcccatgctgttactctccaaagctgcccgataattctagagtgggttccggggacgtgcccgctgtttggggcctagaaatgaactcgggaggttgttttgcttgctgagagctggtctgggaatgccccttgaccgttccctgccctgctcctggcccactcccagactgctcctgtgcctggccccattgcgctgggtgggtgatcctaagctgccccatgggccctgggctctgtcaagacatggggagcttgccaggagttggggccagatcccccagactccaagatggtaaccgaggttgtgagggtgcacatggaaggaagagttagaagagtgaattggaaattgccagcttggactttgggcagagtgggtgtctttagcttggggatgggttgttgttcagagacaacagggccgccttctctgtgagctggcggcccaggctgaggtgcctctgggctgccttccctacgggaagcagtgactggccctctgcttctcaggaagagagtgccgtgcccccgccagcctcccaacctcgttagactcctagaatccggttttctggatagaactaagaatctgctcctttctggacttttaatcctggaaagggctcccttccccagcaggagcagagagaccaaaccccctttctgtgctccatcttgagctgtcattctgtcctaactccccactggccaccatctgcccttgctttgggggctaccccaggtctgacttgggcacgttctctgggtctctcctcagagaggctgctcctggggttgtcccaatggaattgggaattcttctcagaatggctcaaaggtttgcaccatctgttggagggaagggatccctctatcttggactaatacaaatgtttccgtgcctgccaagttccagaccctgggccgatagggaaaggagctggctggggggcctgcaggggatggagagggagcttgggccccaagtggggtctgaagtccaagcctacagattgccatcaaggcagccgctagagcctagcccagctcctggcccctcggagatggaccttagatgctggagagcggggcagtccagcagtgcagggtgggacaccccgagcaaacagcccctgcttcctgccccctcagttcagtcgcactgggccggctggacgtttccctgcaacaggcccctgctggtggtttagctcccgctccgtgtttccctcacgctgggatcctccttcctactcaagacccacgaccttgacctgaagcttttggttgccgggaggaaatggtgagtgtaggcagatttgggtgactcttgttattaaccccctcttctttgttgcccccttcccagaggcttctgtatgagtgtcctgagtggccctggatggactactggctgtccctggcctcagaatcaccccaacccctgccacatttcggggagggaggtgtgtgaatgatgtcctttattctacagactgaggaagtggtcagtgtagcttcacgtgagagcagcagcgtgcgatgcccaggccctagccaagtgctggtcagctttctgactggagcccctgagccctgcaggggctgaattcccccaaaggttgcttgggttgttgcatttcggggttagagggtgtgggtgtccagagctgtgggtttttagtgttggctgagccctttacctgggacctacagcctggccacaaccccatctctgttcccctgtaccccacactgccctgtgataggatgtgataagatggtaggattgcctatactgaagccctgggtgccactgctggcccagcagggaggaggttgctgctgctcgggctgaagtgaggtgtgggtctggctgggcctccagtttcccacctgggccttgattgtgaggaaggcctggcctggctgcagaagcccagaagcacctgagtaggagagttcctttgtcccacctgcagctcattcaagcctgtgcatgggggttggggtcctcaggatcttgctttcctgtttaggggaggcagccccaaagagtgctgggaccagtttggagagtgctaaggaatgctggtctgcagcgaccctacttgtgctctgcgtcctctgccaactgcagcatgggtgaacatctgtacatctgtccccataatgaaaatggcctcagcaaataacaaaaatattaccatttagcaatcaggcacttattaaaagcctggcccaataaacttaaaaaaaaaaaaaagatgtgctagacactttacgtcccttcatgtgagcttcacacaaccctgtaattaagcccatttataaatgaagaaatggaggattgaaggattaagttacttggccaaggtcatacagctcgtaagcagctgagctaggactcaaatccaggcttgcttccaaaaccttcacttttcagcccagttctcaactgccccctggagtttgctcattttgccccatgaagaaacagatcccagctcaaaggcgtgaaggggtttgctcaaggccacagtgtattagtgtcaaaggtggaacacaaaccctgacctctgagtgctctcccgaaccccacatcccggccgggccgtaccctgagcacacgcttgtccgctttctcagctgggcggggcggggcaggacaaggttcttctccctccctccttccctccttccctccttccctccttccccgtgggccctcccagcctccccagcccccacctctgctgctttcccttggcaattgcttccatctggcctgcctgcagctcctattcctttggaaatgtggctgccgcccacatggctgcaaggcaaccacggccacacgtggggaaggggaggggccctatggggtctaagcacagggaacccagccaaagtggctgctcctggcgtctggcatcctgattcctgccaggcagaagcaccttggctgcctggccctccttgatgcccgtcctgggctggctcaaggccagagaggctcccaaagacccaattctccttccaacatggtgagctgttttgcccacagacaagctccgcaccggcagccctccctgtctcttagaggttgctcaggttgggaggagggattcctggcaggagagaattaggggccagccggggtataccctgggttcccactgggttctgatcatttggagggaagtcatgcaagggactgacgagggcagaggctgagggatccgcggagttctgggcaggcgaggaggcagctgacttgctcatgactgtgggtatgcgccaccacactaggctaatttttctattttttgtagatacagggttttgccatgttgcccaggctggtttttgtttgtttgttttgttttgtttttgagacagagttttgctcttgtttcctaggctggagtgcagtggcgcgatctcggctaactgcaacctccatcttctggtttcaagttattctcctgcctcagcctcctgagtagctgagattacaggcacccgccaccacgcctggctaatttttgtacttttagtagagacagggtttcatcatgttggccaggctggtctcgaactcctgaccttgtgatccgcccacctcagcctcccaaagtgctgggattacaggcgtgagccaccgtgcccagccgagcgtgtctgtcttgttcactggtgtattttcttaatgcctggaatgatgtctagcaaacaataagcactcaatagattcttgtgtgatgagtgatggaaatgcagctcaggtatgctgatttgtctttgctgcatctttactttgcttcctcctcccagggcaaagggaaaaagtttcccttttgccagttgagctgtttgccagagaaaggtctggccccatctgtgtgctgccaccttgggggtctctgttcagacctcagagaggcaggcaggaacccaggtgaggatgggcaggagcttgtcccctgaggagtgcatgccccattccacccaccacagggtcggctggccacatttctctacccatcacccctccctagtaaccttcaggtccctgcagacaggtcctgacctcagctccaatccctatgtcagtcctctccttatttgaggcccaagaaaggtacccctacggtggaaccctcacttgggtcctgagagggagtgacagctttggaagagcgaggggttcacccacatttgcctcctcctgaacagctccacttttattccttgtacatattgcgtttccacttcaatttttttttgaaactgtgacagagggtttcttggctttaatttttttttttttttgaaaacccccattgagttccagttgtgacccccctgtggttctcattttctggtagcatgccgtgtggggtctcacctcctcgcctttgcttctgctgccccctcacatggcttgggcattgttggtaatgaccttgctagactgcaaatgtccttcagtatcaactgaagccccagtcctgggaagcctccgtggccacccagcaccggcacttcctcccccttcctccccctgcgttctccactccctgcaggtcctatgcctgtgacagggagggaaccctgtgctggggtgaccccagcatggacctcagtggggctcaggctgaaccaaaggtaggtggttctgggggtagtgcctgaggtggttgtatggagctgtgagatttgtattcctagaagcaggttggaggctctcagcccttccctccatgcatggccttggatacagcttgcagcctgccactgtagcctccatttccttctccgagaaattaacacttctttttttttttttttgagatggagtctggctctattgcccaggctggagtgcagtggtgcgatctcggctcactgccatctctgcctcctgggttcaagtgattctcctgcctcagcctcccaagtagctgggatcacaggtgtgtgccactactcctggctaatttttgtacttttagtagaaatggggtttcaccgtgttggccaggctggtctcaaactcctgacctcaggtaatctgcccacctgagcctcccagagtgccaggattacaggagtgagccaccgtgtctggccaacatttcttccttttttttttttttttttttttaagacggagtctcactctgttgcccaggctggagtgcagtggcacaatctcagctcactgcaacctctgcctcccgggttcaagcgagattctcctacctcagcctcccgagtagctgggattataggtgcccaccatcacacccggctaatttttgtatttttagtagagatgggggtctcaccatgttggccaagctggtctcgaactcctgacctcaaatgatccacctgcctcggcctcccaaagtgttgggattataggtgtgaactaccgtgctccgcctggccaacacttcttaatgggataatgtttcagataacatccagtgcccggactccagcactctataaatgctggctggtgtgcttttctgggattccagggtggggtccagagactgaagagggtctgctttctggcccaggggaagaggggcaggtggctcactaggagctgtcctggcatcctttgtccccgtccacttaccagttatgtgacctcgggcaggtcttgcactctggcactcaattagcatctgtgttaattggggtaagagtatctgccacgtctcacagcctggtgatggacaaacaaaacaaacattttttaggctgggagaggcctcagaggttggctgtcatattgcaaacgagggagcagagactcagaaaagtaacttagttgtttaaggtcacagagcacctctctccccacaggcagggagccggtaattgggctgagcctcaggagtaacccttctctctctgcctctccagcccctaccttatgcctggcccattcagctggtctgttctccaggcccctaggactgggtgggctaagatgagtggtctagaaatccctccccagctgggctggactgaatgaggggctggccgaggagcgggtgttgatggagtatgggagattgtcctcacaggcagtgtgggccgtttctctagacctcctgcccccatctccttcctgtccctgtttgagccgtgctcttcttcttcaatccctttctgtctgccttctctttccacccctagatttctcaccatcttcagtgatccctcctccttcctttctgcctcctctgcattctctccttgcccttgcttctctgatctgccttttttctccagcctcagcattcaggttgtcctcatagtggaactgggactctgggggtggctgggttgggttgcctggaggccgggaatgttcaggagagccttcattgggagcccatgggagcaggagtcagctcctcctgttggcagctccagcattttcgaacaaaaatggctcttccaggagttgagtttggcgaagagacagtgcctgcccaaagtatgcaatgcttttatctttagctcagctcctgagccctcatgcaactctttggacatcttcctgcaaaggacggtgggatcttgtctttctggggcctcagggtctccaaagatgggctgactaagcttccctagcctgggacctgaaccctccaccctcctctctcttgagctctttctcccaggggaagctgctcgaatgaggggagttggccaacacagttttctactctcagaccccattgaggtgagcacacaacagtgttctgtgtgagggtctggatacactccccaccctcccaggcccggcaccgtgtcgccctgccccagcccagagcttgcctctgttggctttgtgaccctcgctttgtactgtggctttgttctgccttagggaccagctggtcccctgctgtggttccacacagtggagactgatccctgaccactcattcagctgcctggcggccctggggcaagtgtttgtcccccatctcccaaaatggcggggtgcaggggctccctgcccggagtcccaaccctgccaaggcagagggaatggggaacagctgcgctggcccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtgttgggctggatgtgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctctcagcccactcatccagggatgcagctctggccttggcccacccccatcagagggcctgtggccctgatcaccgcactccccactctgtgaccagacgttctctcctgagcatcgctgaccctgcagctgtccaaatagagcaagaagtgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcatggtgttggggcctcacagatgatggagaagccagagttcaggcacttggcatgacccctggcatcgccttcagttgatttagtgtctctgccctgggatattccatgggaccctgggctggcttctgtgtgcagaggtgggtgtgggccatagcccagacctgttgaaccagttgtaggctctggaatcctctgtccccaggtagtgaccaggccctgacaggccggtatctgtccctcccatcaccctcccagttatgggtgcagatgaccctgaaattgctaaagcctcagggcttgagcccagaaagtgtgagcaggctggtggggcagctggaggaaggccttgcaggttcctggatttgggtgccgggtgggctgagaggacagtccctgtcactgggactgggcacaggtgcagagaggctgagacgggcccagaggacagtgagtgtgtgttgtgtgggcgccgggccaggaagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctccgggctgcctggtgatagctcccagggacctgcaagctgacaaacaaagtctatacgagccagagctggggtgggaggaacccagtgggcctgggggaggtaaagcagcagcagctgctgtagctgagcccggcccacggccagccctgaggaatggaggaagagagtgccctggctgggggagcccctcaagccctggaagctgtatgtgggcatggggtggtgggggcgtgcagagaggaggaggactgagagctgggtgtgtgtgtgcgcatgcctgtgtctgtgtgatctggttcccgggtgtctgagtagggaccaatgtgtttgtgctggagaagcctgtgtaggttactgacatggggaggggtggggcttgctttcctcaccccgcttcccacgtcttcattgagtcctcatctgggggccctgttccactctccttcccgtgtgcagggccctcccctctggcgagtctgcctctcactcgctcagcccctttaaccctgctggctcctaatgagacttcaggtgtggaccctcgaaccctcagctgcacaggtctggaaacatccttgttcatcaagcaccaggctgaccatggtgtccgtctcagtgcccagcagatgttctggtgaggggaggcgggagtgcaaggtctgccgagtgagggttccttccgggaggaggcagggtgagcgcagaaaccactgctccaaaactcttaaaagcagagccgagagcctgaattcagaggctgtactgtggggcagggctggaatttgtggcacctgcagggctgaacgttgcctttgctgtccctgcttggggattttggggtactgggtttggatagagtgtgtcatctgcagagggagcactgttctggaagtggactctgctcaggtgtggggggcctgcctgtagggggcaccgtggtggagatggagcaccgctcatgacaggaggctggtgtctggtcaggctgagggatccgtgtgccagcccttctgggaaggctgaatggggcggaactggtcagggcctggcaccaactccaggaggtgctacacccagacagacagatggaaagccacctccctagaggcctcctccccctccccttctgcatgccaccacaccccagcagcgtctcctgaggctgggccatgggtgaatctgagtcgagggcagggcagagtgggagtggcagtgcctctgcctgtctccctggccgtggcaggtcctttgtcacgtatggaccaggagaggtgagtatgattgtggtagtggtgggggcagtggctgaggacccctctctttgctgggctggggcagagcttgaatggagaggggctgccttgtgcctgggaagggaggaccaggtgtcgctggtaccttccaggtcctgaatgcttgttctgtgcctagcccctgctgaggctgcggacgttacaaaccaggatgtgttttgaggctcaggacacctctgaggacttgctgctgttacccccatttaaaagacgaggactctgaagatctgaggtgcatagagtgtagggattaaaagtagttctggctgaattttaaatcctggttccaccatttttgagctctctgatcttgggacccttaatgtatttgctctgtgcctcagtttccccatctgtaaatgagaatgaaagagtaatcccacatccattggttgaaaacttcaataagattatgcatagcaggccgggtgtggtggctcacaccagtaatcccagcactttgggaggccaaggcaggtggatcacttgaggtcaggattttgagaccagcctggtcaacatggtgaaaccccatctctactaaaagtacaacaattagctggacataatggcgcgcgcctgtgatcccagctacttgggaggctgagcaggagaatcctttgaattcaggaggtggaggttgcagtgagccaagatcacgccactgaactccagtctggaccacagagtgagactgtctcacaaaaaaaaaaaaaaagattatgcacagcacctgcagcacagccccagggatgatttttaaaagtgaatccagggccaggtgtggtggctcatgcctgtaatcccagcacttggggaggctgagacaggattacctgacatcaggagtcagtgaccagcctggccaatatggtgaaaccccatctctactaaaaagaaatcccagattctgccatgccacagtgtccaagtcagtcacctgctcgcagtcggccctcaggccctgtggctcctgtttctgctgacttgtccagcctcacagtctggggaggccttggggtccccagcctgcgctgggacaggggtattattccgtcagcccttctgtggaacaagtagggaaggagtgatgtgacctccgtggctctcctgggacacaggttagtcctgtgggtgacctcactttagagagggctggccagctgtgccggaattaggaagtgggtacagctggacaaaaggtggctggagccagctctacagaagccacacctgctcatgagaagggtatccttgtgagtacaggggaaatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttgggggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccattttttaaaatccctatttacccagtggaaaacctgagacccggaaaggtcattcacactcccagaagtgatggttggtccagaattcaggtccaagtgtgagacttcaacatttacattccttattttttcttcttccttttttttattttaatcaaattattacttcaaaatgtatcacactcatcagtttgaaacagttaagcagtacaaatgggaatatgagagaaagtcactctcccacccgccctcttgagaggcaatagccttgttttgcatccttctgagtactctattcacataagatgtatctgaatatgcatgtaattcttttgtgaaagtgcatttggagatcactgttttacacctgccttttacatcttaatattatgctttggagatcagttgacatcagcatgcatcgatttgcatcctatttttcacagctgcatagtgtttcgttgtgtgtgcctaattttttaaaacaggtgcctgtgcatagatttcatgtttccatcttatgctgttagaaaaagtgctgcagtaaagatcctaacagacaagtctctttgcaaatataggaaacttttctgtggaataagcttctggcacggaagccccggggtaaagggtattttgataaatattgtgaaatgtcttcccagaaggtggcctggttttcacttccagcatacatctgtgagaggtcctgcttcccacactcccccagcactgtgtagctcaggacccttgttttttgctgttactatttgtgaaaaatggtatctcaaccacaccggaagttttaaatgtagataaatgtcttatgtgccatttatatttctctacagtaaagtatatattcatagccttagcttatttttaaattatgttccttcattgtttggggagtggggggtagacttgcatgagtatgttataggctaagggaattaactgataagttaatatatgtacatcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccacgctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctactatgatctattctattcttccccacattcctttttttttttttttttttgagatggagtctcactctgttgcccaggctggagtgcagtggcgcgatctcggctcactgcaatctctgcctcccagatccaagtgattttcctgcctcagcctcctgaatagctgggattacagacgcacgccatcacgcctgtctaatttttgtatttttagtagagacggggtttcaccatgttggccaggctggtctcaaactcctgacctcatgatccgcccaccgtggcctcccaaagtgctgggattataggcgtgagccaccgcgcctggcctattctttcatcatacacataagcacgcactatttacaaatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtatgtcagaatttctttttttcttttcttttcttttctttttttttttttctgagacagagtttcgctcttgctgcccaggctggagtgtaatggcgcgatctcagctcaccacaacctctgcctcctgggttcaagcgattctcctgcctcagcttcccgagtagctgggattacacgcatgcaccaccacacccggctaattttgtattttcagtagatacagggtgtctccatgttggtcaggctggtctcgaactcccaacctcaggtgatctgcgtgcctcgacctcccaatgtgctgggattaaaggtgtgagccattcacccggccgtctttggattttatacagcaaaactccataatatttcctttacatgaatttcctttctttttcaggctgaataatattccattgtacgcatagatcacattttgttcattcatccattgatggatacttgggttgcttcccgattagctattgtgaataatgctgctatgaacatgggtgtacaaatatcgctttgatattctggtttcagttctttggggtatataccccgaagcacagttgtgggatcctatcttgtctcttgttttctctttgcttccatgttttttctcattgtttcgtgggaatactgatattatatattcaagtatttgttgattacatgcactgtacctgacttgtttaaagcctgatgtcttgagtactgtgcacccctgtgcctggctgagtagtggaggaactttgaaagggtctgttctggagagggggtgctgctctggagaggcggtgctgctttggagatggattaatcaggaacttgggtgctgattctaggaggtactgcatctagaaagatgggaggtggggagtgcaacttccccaattttgcctttaacttcagatccttggggtgggtgcattgcttctcctgggatggaggggtgccggggagcccctgaccaggacctggagcaggtccacacaggcactggatttgtcctttactttgggcccaggctgcactcttgattccacctcctcacactggcttcagctttctcaccctcagaatggaattcaaagcctctgcccctcccaggcagacaccaaggtatgattttcaagtggttggtgtcttgtgactggcagctgataaacgggtgatacagtgtttctatacaggagtctgcagtgccaggctgcaggggcggacgggagggggtcgtggtgggtagcctgtggagcctgagggtgggaacagagagacttcttttgctgtaggtggaagcctgtctggctcctttccctcaaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctgcagcgtccagccagggactgtgccgcaggggccagaagatatctgacctactgtcactgcctcttccactctgttccacctgcactggagcgatgctatccgatgaacagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaaccccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaagttcggcagggaagccagaggagtccgcagcccgggagacctggcctacagcggagagagtcagtccatgccagtggtgggatgtggctgcaaaaaatggtcggattcatggaagtctggtgtccatctggcaggcgttagtggtcccacgaatacagctgtgtgccttgaacacatactgcagagcttccagagagcaccagggctgtgggggctagagactgtgtctcgtgcggaagcgtggctgaggaggggcttgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtgggggttctggctgaagtagccagaattccagtgccagctccgctcctcacgagctgtacaacctgggccggttactgacccctttcccaccttagttccctggctctacaatggaggtaattatcgtgttgaactcacagggtcgagatcatatttaatacttgcacagcccttagaagcatctagcacagtggtcctcagcatttggaaatgtctggaaacattctgtcacacctggggagtgggatttccttctggtgtctagtgggtagaggccagagatgctgctaagcgtcccacaatacacaggacagaccccgcaacaatgaactgtctggcccccaaagttagtggggcagagattgcaggatcctgattccttttcttccttttttttttttttttttttgcccctggctatgagtaagagatcctggtttcgcacaaagtgaacgtgcagtacattgtttcagttgttaattcgccatgcaatacatcgttagtcacgtattattgtttgtcaaatgtgtataaaacatctgccacattcttggcagtttaatagaatctagagatataaagaagttcctgaccacagagttcatagcctcacaggcaagataggaaaacacagaattatataatacgaaattacattatatcatagagcatattctatagtaagttactccgattggcttttggtattaaaatgtcttcagtttcagaggtcccaggatagtgggcaatatttgaaagccagtaaatataaaataaaatatattacctgtgtgaaagagaatttttcaggcacaataatattttaaagagtttatttgtgtaagaagtgaattgggaaacagaaaaccgaaagaggtttagtggcccaatgacagtttcagaggcaggtgtttggagagtgaatgtaaaagcaaaatgaagaatttatttgatttaattggttgcaattacaaaattgctttgtttggtttaccttgttggaagtttcctagtcacataaccatatgttagttggctacttatgattggctgaagttttatttgtgtcaaacagaagcatttaccataaataaccccagttaagatttgattatgctgtcttttaagcaaggttaaggctgttgttaaggcctcattggttttgtttggtaaggaatttttcaggcctggtctccaaattttgctttaacaattccttgcttctggttattctctcagcaagctgatagtgtgactagatgacacagtattactctctgttaccaccaccaatgtagtcactgggacaaagagtcaggtagatgttgttgtcatcatcagtaggtaggttggggatgagaattccatggccacagttagcagttacatagtcagtgttgctttcctcaagttgaatgatcctcatggtaactgtttgatatttgagcagctgttggaaatcatttagaacccttgagagaatacaaggcaccaggggggtaaacataataattataaggagaataatagccaaggattgaaaaattcctctgagcaaagattcccaggagccaagacttaaccagctgagtgaatcaatggagaaggcagtgcccatctaatgaaaaacccatgtgtgttctttaaggtattttaagttttcggtaatacctgatttgttaacataaaaatgacactttttttttttgagatcgagtcttactctgtcgcccaggctggagtgtagtggcgcaatctcagctcactgtaaactccacctcccaggttcaagtgattctcctgcctcaacctcctgagtagctgggactacaggtgtgtaccaccacacccagctaatttttgtgtttttagtagagatgggatttcaccatgttggccatgctggtcttgaactcctgacctcaggtgatccacctgcctcagcctcccaaagtgctgggattacaggtgtgagccaccgtgcctggccaacaccttctttttttttttttttttttgagatacagtctcactctgtcttgcccaggctggagtgtgcagtggtgtgatcttggctcactgcagcctctacctcctgggttcaagtgattctcctgtctcagcctcctgagtagctgggaatacaggcgtgtgccaccacacccggctaattttgtatttttagtagagacagggtttcacccaggctggtctcagactcttgacctcaggtgatccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccagaaccccttcgtaagactgtgtctgggatattatgattctcttttgtgaggggtcactttatgtacaaatgactctaaggatttgtatggcaattgaagagtcatatctagtcattttaggtagaagatagcccacaccacagatccagactggctaggtagaacacctttacatactttgttgctgcataaaatgaataattcggtgttatcgatagaaagggtcaaagtgcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagtgaggatggcttcatgttgagcagtagatcttagaggatattcagtgtggataatgaaattccctaacgaaaataaaagtgtgaaccttttgtgctaaaacaaaacaaaaacaagtctgagtcaatagaagggggccacatggagtcttgtttcattgtcttgggaaagctgtgtctatttcatgatatcatctacttttatggaaggatttctcttgggtatccttaattttgtttttatattattattattattattgagacggagtttctctcttgttgcccaggctgcagtgcagtggcacgatcttggctcactgcaacctccacctcccgggttcaagtaattctcctgcctcatcctcctgagtaactgagattacaggaatctgccaccacacctggctaatttttgtatttttagtagagatggggtttcaccacgttggccaggctggtctcaaactcctgaccttaggcgatccaaccaccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaagctgaggcgggcggatcacctgaggtcaggagtttgagaccatcctggccaacatggtgaaaccccatctctactaaaaatacaaaaattagccgggcatggtgacacatgcctgtaatcccagctacttggaaggctgaggcaggagaatcgcttaaacccatgaggtagaggttgcagtgtgccgagattgtgccaccgcactccagcctgggtgacacagcgagactgtatcaaaaaaaaaaaaaaaagatccagtttccagattccaggtcacgtaaggtgggatcatcaataggcaggtcacagaaagcctccttcacctggtgggatatactttggcatcatacatcaagaccttgcagtattgagtcacatcagagccaccagtagagtggataaatgaagttctgttatgaaaggcacaagtcgttcagtatttattttgtgaagggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatgatagtgccgtcaggtctgtaaactcttatttggtggataacctgtcaaataaagcgaattgccctagcactagagacctcctcggcaggtaggtgggatttcatctttctggagcctgagcatctccaaagaagagctgccgcatggagcttccctgactggtgacctccaccctcttctctccagagctctttgacccagaggaatctgcaggaatggagggagttggccaaagtagggagatttttactcagaccatatccaggtgagcacacaacagccttttgggcttgggctgatgcgtgcatttctgtctgtacatgcgtgcctggaagtgtgcagatgagtgtgtgagagagggtaatggccatgcatccttgcatagacaagaacatggggtgcacttctgcatgtgcacagcccctccccaacccgggcctgtggtgctgtcctgcccctagcccagagctggcctctgttggctttgagaccctagctttgcactgtggctttgctcggccttagagaccagctgctcccctgctgtggtctctcatagtggagactgatccctggccacccattcagctgcctgagggccctgggaccagtgttcatccccccacctcccaaaacagaggtgtgtaggggttccctgcctggagtcccaaccctgcaggatggagaaaatgggcaccagttactgtgacccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtattgggctggacttgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctcccagcccactcatccagggatgcagctctggccttggcccacccccatcagagggcctgtggccctgatcaccgcactccccactctgtgaccagacgttctctcctgagcatcgctgaccctgcagctgtccaaatagagcaagaagcgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcttggtgttggggcctcacagatgatggagaagccagagttcaggcacttggcatgacccctggcatcgccttcagttgatttagtgtctctgccctggggtattccatgggaccctgggctggcttctgtgtgcagaggtgggtgtgggccatagcccagacctgttgaaccagttgtaggctctggaatcctctgtccccaggcagtcaccaggccttgacaggcgggaatctgtccctctcatcacccccccagttatgggtgcagatgaccctgaaattgctaaagcctcagggcttgagcccagaaagtgtgagcaggctggcggggcagctggaggaaggccttgcaggttcctggatttgggtgccgggtgggctgagaggacagtccctgtcactgggactgggcacaggtgcagagaggctgagacaggcccagaggacagtgagtgtgtgttgtgtgggtgccaggccagggagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctctgggctgcctggtgacagcttcggggacctgcaagctgacagagtctccaggagccagagctggggtgggaggaacccactgggcctgagggaggtagagcagcagcagcagcagctgagcccagcccccggccagccctgaggaatgggggaaaagagtgccctggcttgggggggccctcaagccccggaagctgtatgtgggcatggggggcgggggcagagaggaggaggactgagaagtgggtgtatttgggcaggtgtgtgtgtgtgaccaagcttgcgggcgcctgagtatggactagtgtgtttgtgctggaggagcctgtgtaggttactgacatgggagggccggtgtgagctgcagggaccggagagctgctggaaggggctgtctatgccttcaggctctgagtgtggatgcagctgggcctgttcaggcagattcaccagaggggctactgcgcagagcctgggccctggacacctagaagggcccctcctcccctcgtcttccctccctcatggcccacctttactctgagggggtgggcttcctgcgggggacaaactggagagggactctcttgccgccttctctgttcctggggacaggctgctgcagggtggagggcttgcttttcctgcccaccctcatctttgccgagtcctcgtctgggggccctgccccactctcccttcccaatgcagggccctctcctctggcgagcctgccttgatactccccggctcaacccctttaaccctgctggctcctaatgggactaatgggatttcaggtgtggacccttggaccctccgctgcacagttccagaaacttgttcatcaagtgccaggctgaccatggtgtccgtctcagtgcccagcagttgttctggtgatgggaggtgggagtacaaggtctgccgagtgaggcagaggaaaggggtttctgagcccagatctccggtgctccaagacactcaaaaccagagctgagagcctgaattcagaggctgtactgtggggcagggctggaatttgtggcacctgtgtagggactccagggctgaacgttgcctttgctgtccctgcttggggattttggggtactgggtttggatagagtgtgtcatctgcagaggcagcactgttctggaagtggactctgctcaggtgtggcgggcctgcctgtggggtcaccatggacaggaggctggtgtctggtcaggctgagggatccgtgtgccagcccttctgggaaggctgaatggggcggaactggtcagggcctggcaccaactccaggatgtgctacacccagacagacagatggagagccacctccctaggggcctcctccccctccccttctgcatgccaccacaccccagcagcatctcctgaggctgggccatgggtgaatctgagtcgagggcaggacagagtgggagtggcagtgcctctgcctgtctccctggccgtggcaggtcctttgtcacatatgggccaggagaggtgagtgtgattgtggtagtggtgggggcagtggctgaggacccctctctttgctgggctgggacagagcttgaatggagaggggccgccttgtgcctgggaagggaggaccaggtgtcgctggcaccttccacgtcctgagtgcttgttctgtgcccagcccctgctgaggctgcggacattaaataccaggatatgttttgagactcaggacacctctgaggacttgctgctgttatccacatttaaaagacgaggactctgaggctctgagaggttaagtacctggtccaggtcacctggtcagtttctttcttttttttttttgagatggagtcttgctctgttgcccaggctggagtgcagtggcgatctcggctcactgcgagctctgcctcccgggttcacaccattctcctgcctcagcctcccgagtaggggactacaggcgcccaccaccacacccggctaattttttttatttttagtagagacagggtttcactgtgttagccaggatggtctcgatctcctgacctcatgatcctcccacctcggcctcctaaagtgctgggatgacaggcatgagccaccgcgcctgacccacctggtgagtttctgagctccagacaactcatcccaaatttcatgggtgcatagagtatagagattaaaagtagttctggctgaattttaaatcctggttccactattttcgacctgtctgattttggaacatttaatgtattccttctgtgcctcagttttcttctgtgtaaatgagaatgaaagagtactcccccatcaatttgttgaaaacttcagtaagattatgccaggagctgcagcacagccccagggatgatttaaaagtgaattcaggacagggcgtggtggctcacgcctgtaatttcagcactttgggaggctgaggtgggaggatcccttgagcccaggagtttgaggccaccctagacaacatagtaagaccttgtctcaaaaaaaaaaagcgaatccagtggtgtcactctttgttatcaatgccctccagtgacattcatgacacccaaacttagaatctgagcttttagggtggcctgtgacatctataccacgtgtccccgtggcctccctggcaccccctttccttcctggctgtctgccaccatatggaactttctgtgccttgcacccagccagctcagagtcttgggcacttctctcagtctggaaccttctcttgcctaccccatcttcccatggctgcccttcatgtaggcctccggtttatagccggctcctcagagacatggttctatccccccagtggccaagggctggtggccctcactctctgcccctgtgccctgtgttagtggtcctgtggttgtcattgccccgtcatctccaccatttcctgtttgccgtgtgtctgtgccccccaaggatgaatgccatgagtccagcatgtcaccctgtttctgtcctgccacagtgctcgagtcagtgccctccctgcttgcattcggcccacaggccttgtggctcctgtttctgctgacctgtccagcctcacagtctggggaggccttggggtccccagcctgtgctgggacaggggtattattccagtagcccttctgtggaacaagtagggaaggagtgatgtgacctctgtggctctcctgggacacaggttagtcctgtgggtgacctcactttagagagggctggccagctgtgccggaattaggaagtgggtacagctggacaaaaggtggctggagccagctctgcagaagccacacctgctcatgagaagggtatccttgtgagtacaggggaaatggcatggagaaagacaaacaccggtgggtggctctgccagcttcccctggggtgcttctggcaacgcccaggtctgtgcacatccagatctttgcactgcgctgttttgacttggagaggagaggaggaagttagctgctctgaatggtgttgctgctaatctctacagcactttcctgtaaattaggaacggtaacacacacacccctcccccaccccgctggagaagccctgcaccagagcatacagtttggcaagtaggaggagggctggagcccagcctcacttgctgccctggccaggccgtgattgcccagggtgcatactgtggctggtgctctgccactgctgtttctgtcctcagggtaggacacaaggagggcaagtagggccagtcagcgagaggcgcaggtgacgcgtgttctagggtctgagatcagctgcttccatttcagtaattgtctttggagctacattgtctgctcatacaacttcccttccagatagtgccattttaaaaatcccatttacccaaaagaaaacctgacacctggaaaggtcgtttgcactcacacaagtgatggttggtccagaattcacatccaagtgtgagatttcaatattttttttcttcctcctttttttaaatcaaattttatttgaaagggtatcacagtcaccagtttgaaaaaggtaagcaggccaggtgtggtggctcacacctttaatctttgcattttgggaggcagaggcaggcgtgtcagttgagcccaggagtttgagaccagcctgttcaacgtggtgagaccccatctctccaacatttacaaaactagctggtcatggtggtatgtgcgtgtggtcgcagccactggggaggctgaggtgggagggttgcttcagcctggtgggtggctgcagtgagctgagattgggcctttggtcttcagtctgggctacagagcaagactctgtctcaaaaaaaaaaaaaaaattataaaggtaagcagtacaaatgggaatatgagcataagtcactctcattccagacctctgacccccaggacttttctcttgagaggccatagcctttgttttgcatccttctgagtaaacctattcgtgtacagacatatctgggtatgcatgtaactgttttgtgaaagtgcatttggagatatggatatcgttgttttcacccatcctaagttttgatgctatggatactatgttttggagattagacgataccagcacgcataggtttgcagcctctttttcacagctccatagtgtttccttgtctgtgagcagatttcaagttgtttccatcttaacccctagaaaaagtgctgttgaagatcctgacagacaagtctgtagaaacataggaaactttgtagaataaagttctggccatgggccaaattccctctgagaggtagctctagtttttcttcctagtacatctatgagagctcaggtccctcgtgttttgctgttatgatgaatgaaatatgctgtctccatcacgctggaatttgtagatgtagatgaccatagtttcttatttgccattcatttctttacattaaggtaaatattcatgtcctttggctatttttattttatttcttttttcttttcttttttaagacagagtctcgctctctctcccaggctggagtgaagtggcttaatcctggctcactgcaacctccacctcctgggttcaagcgattcttctgcctcagcctcctaagtagctgggattacaggcacctgccaccatgcctggctaatttttatatttttagtagaggtgggggttttaccatgttggccaggctggtctcgaactcatgacctcaaatgatccatccaccttggccttccagaatgctgggataataggtgtgagccactgcgcctggccctttgcctatttttaaattaggtttcttgtttttttttttttttttttttctgatttacgtgagcacatcataggctcagtgaatttactgatatgttaggtataggttgcaaatgtactttagtttttcagtgtctttttttttttttttttttttgagacggatttttgttcttgttgcccaggctggagtgcagtgcaatgacacgatcttggctcactgcagcctccacctccttgggttcaggcaattctccagcctcagcctcttgagcagctgggatcacaggcgcctgccaccatgcctggctaatttttgtatttttagtagagacggggtttcaccatgttggccaggttggtctcgaactcgtgacctcaggtgatccacccgcctcagtctcccacagtgctgggattacaggcgtgagccaccgctccccggctcagttgtcttttaagtgtttcatttgtcttctctctactcctccctctctctcttgcacttgctgtctgtctcacttaaattttatgtaggtgaatatattcatctttccttgtttagcttctcaatttatatttcttcactatctctattaatatgaaaatatctcatctatataaatattaatgtaacagagttgcatgtgataatctgccaggttgaacaaatgggaatattatctctcatatgacgttagatttttttcctttaagaaataaaatattgcaagtagagaaccaaagacatgcccctgtgacctcttttattcttccccatctccccagaatataattatcacttaaagttgggtgtcaacctgtatttcattctttcatcatacacacaagcacacactgtttatacacataaataatgttgtttttggacgcatactttgtttttgcaacacctttaaacataagtttttacttttattattttatttaagataggatcttgctctgtcacccaggctggagtatagtggcgcgatcatagctcgctgcaacctctcatctcctgggctcaagtgatcctcccaccttagttagcctcctgaggaactgggataatcacagtcataagccaccaagcccagctaagttgtttattttatttttttattttttaaataaagatgaaatcttgctatgttatccaggctggtctcaaactcttgggctcaagcaatcctcctgccttggcctcccaaagtgctgggattacaggcatgactttaaaaagttaacattatgggccaggcgcggtggctcacgcctgtaatcccagcacactgggaggccgaggcgggtgaatcacgaggtcaggagatcgagaccattctggctaacgcagtgaaaccccgtctctgctaaaaatacaaaaaaaaaaaaaaaattagctgggcgcggtggggggcgcctgtagtcccagctacttgggaggctgaggcaggagaatagcgtgaacccgggaggcagagctgcagtgagctgagatcacgccactgcactccagcctgggtgacagagcaagactctgtctcaaaaaaaaaaaaagttaacattatgtcttcaagtttatcccaattgacccatatggattgatttcttcagtttacatggctatatagtattcaggtagcacagtgtatatagccatggctgtactgatgatagtgtttccagtttgtttgtttttttttgctattgcagcactgcctaataaatatcctggagtgggttgtacttatatacttcaaaatggaattaccagattgtaaaatatgcacatattcagcctcactagatactgtgaagtgctcttctaagcctttgtgtcagtttgtacttctgccagcaatgtggaaatgagatttggttttaatatgtattccctggtcacgagtgagcctcagcatcttttcatatgtccaccaagtgtttgggtttaatctgtgaattgcctttttgtgttctttgctttttttttttttttttttatttctttgattgttttggtggttgttatggtaaaatgcacaagcacgaggttgtatttaccatcttaactctttctgtgtgtatagtgcagtggcattaagcactttcagaatgtgctaccgtgctaccatcccaccatccatctcccgaactctcttcatcttgccaaactgaaacatcccacccactagtcaagaactcctcatttccgcctccccccagcccttggcagccaccattctgctttctgtgtctgtgagcttgactactttaagtatctattctaaatggaatgatacaggacttgtctttttgggactggcttatttcacttcgcgtagtaccttcaaggttgatccatactggtagcagaatttcctttctttttcaggctgaataatattccattgtatgcgtagaccacattttgtggatccgttcatccactgatggacgcttgggggttgcttccacattagctattgcaaagtcaataatgctgctgtgaccacgggtgtacagatatctctttgacatcctggtctcaaatattttggggatatacccagaagtgcagttgcttgatcctatcctgtcccttgcttttccctttgcttccttgttttttttttttctttttgttttatgggagtgctgatatattcaagtatttgttgattgcatgcattatgcctgacttgctcaaagcatgatgtcttgagcacttagcaaccttgtgcctgctgagtggtggaacagttctgaaaaggtctgttctggagtgggggtgctgtttcggagagcgatgaatcaggggcttgggtgctgactttaggaggtgcggctcttggaaagacagagtgtgacttccccagtgtggtctccttccttttcctcaccacttctcctacctaaccccaagaatgagtccttgagtctgtctcagtaggtggatctgcattcagtgcagggcagagcctgggtggcagtgcctctccttgcctccctggctgctacaaggtcctgtgtagcatctggtgtggacccagcagccaggaggagagctgagtgtgattggggtcgtggtggggccagtggcagtggatctctctctttgttgggctgggccagcgcttgaattgagaggggctgccatgtgtctggggagggcagaacccagcgtcactgacaccctccagatacagagttcttgctctgtgtttggcccatacctaatgttgtgaagtggaaatactggggtgtgttttgaggctcagaacacctgtgataacttggtcgtgtgtgtgtgtgtgtgtgtgtgtgtgtgtgtgtgtatgtgtgtgtatgtgtatatataaaattattttccttaacaccactgacctgaaggcagttacacgtaatttacaaatgaggaatctgaggctttgagattgtcaaggtcacctgaccagtgactgcagaggctggattggcctgtgggcctgagtccgtaccccttttcactggctcctcctggaggccacatgtaccttgcgcttcctggggcttggtcctggggtttcatctcaggttgacccccgttaggaggaagtaagtaggaaggaaggagatttcctgggtattagggtgtcctcaagcctgcagctctcctgggactgcacagagtttactgtcggacatcagttctgatatggtgcagcagacatggagctggtaagtggttaagatcagtcggacatgacaacctccagttctgcagaagccacttcatttgcctggggataaagcaggtccttgtgagctcatcgacatgcatttggcagaaagtgcgctggctctgccagctcccagtgtgagcttctagcaagccccttgtgccttagatgcccaggtcttttcagaataagcctggcttgttttaacttgatgcaacttgctgctcacagtcatcttattgtttgctgatgaattcagacctccattcatttaaatatttgtcagttatctaccatgtgtcaggcattaaatttagtgctggagatactatgggacataagaagtccctgcttgctgggagtgcgtggtctaattggtacttgggacagtgtggtttaactgccacaaagttaataaagcagcatgatgtgacagagctggatgtgggggagtgaggaagcttctctggactgggtggtctgaaccccatgcagggaggaaactgtggctgggaggagaggaggccggaagagaggtctgggcttgggtcccaaccactgattccagatctctcaacatttgtaacacgaccaactcctgttcttttttttttttttttttgagacaggctagagtgcagggggacgatcatagcttactgcagcctcgatctcctggactcagggggtcctcctgtctcagcctcccaagtatctaggactacaggtgtgtgccaccacacccggctaattttatttttatttttatagagacggggcagagtctgcagtcacatgccttgcaagtagcagagacagggtttagtctcggtagccagtgcctagggcacaggtcttggccagaggagagaaggctcaggtgaaccagtttcatctgacctgcttgctaactcaaacatggctgcccaactgcgtgggctggcaaggtatgtgaggtgggtagctgggtggcccgccccttgcaggcactggggcaggatatcagggggtccagaagaggttgggtttaggcagagtagaggtgattgtgtgggccgggggagcaatgtcaccttgaatgtgtttccatacccagggcccagatggctcaggaggagggggatggggacggggagagtgaggtctttttgactttgatgtgctttgactgcacatcagagtcaaacgagtcagaataagcgggacccctccacaggcatctcagccctcctaatttagcctttctgaagtggagccttgggagccgatgaagcttaataaactctcctggtgcttccagtaggcacttgagggtggacaccaccgtcttcaggtcataggaagtgtgagctagcaggaatcctggagattttctagcccaacagtgtccggtcaaaatagaatgggagccagaaatacaagccacatgtaattttaaattacttttaaaacatttaaatttagccacggttttaaaaagtaaaaataggtgaaattcgttttaatattttaacccaatatagccaaaatcttggcatttcaacatgggatgagcataaaataatgaaggtgatattttattctttttttggggtactaaatctttgaaatccggtgtgtattttccacttaaagcacatgtcagtgtggactggccccattgcaaatactcagtggcctgggactggggtgaccaagtgggatgtggtggggctggtgcagtccaccattctcacagcaggcatctggggtcaggggaggcagggcactggctgtgctggaagcaggggattggctgtgctggtgggaagccagattccagccccagacactggtacctttggctttagatccttggggtgggtgcattgcttctcctgggagggaggagcgcccgggagcccctgaccaggacctggggcaggtccacacaggccctggatttctcctgtatcctgggcctggccctgctctcttgactcccacctcgtcacagtggcttcagctttttcaccctgagaagggaattcaaagcctctgcccctctcaggcaggcaccaggatatgattttcttttttcttttctttttgtttgagacaggatctgacttggtctggagtgtagtagcctgatctcagctcactgcagcctccacctcccgggctcaagtgatcctcccacctcagcctctgaagtaattgggattacaagcacatgccaccatgcccggctaatttttgtattttttatagagatggggtttcaccatgatgcccaggctgttcttgaactcctgagctcaagcaatctgccctcctcggcctctcaaagtgctgggattactggcatgaggcacggggccctgccctgggtatgattttcaagtggttggtgtcttgtgactggcagctgataaacgggtgatacaatgtttctgtacaggagtctgcagtgccaggctgcaggggcggatggtggggggtgggtgggtagcctgtggagcccgagggtgggaacagagagtcttcttttgctgtaggtggaagcctgtctggctcctttccctctaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctacagcgtccagccaggggctgtgccacaggggccagaagatatctgacctactgtcactgcctcttccactctgttccacctgcactggggcaatgccatctgatgaacagatccatttattaattcaacacgtttgtattgagagcctgctgggtgccgggcactattgtcaacatgggtgatacagcagcaagcaaaacaagagaaacatctttgcaagcaggggagggggcctgcagtgttgggtgtgtggagttgttgctgggaagtagagaagctgagtaaagagctggacggagagagatagccaggcccatgtctacagaaaagcattctagactgagtgagcataaatcgcaaaggcccagaggagggagcatgcctagctagccccctagacctggtgaggctggtgtgggttgggcagtgatacggtttggctgtgtccccacccaaatctcatattgaattgtagctcccataattcccatgtgtcatgggagagacctggtgggagataattgaatcatggtggtgttctcccccaagttgttctcctggtagtaagtgtcaggtgagccgatggttttatgaggggtttcccttttcacgtggctgtccttctttcttgcctgctgccatgtaagatatactttttttcttctgccatgattgtcaggcctccccagccacgtggaactgtgagtccattaaacttctttttctttattaatttcccagtctcgtgcatgtctttatcagcagcacgaaaacagactaacgcaggcagcctgtgttgggaggagttggcaaggagggaggaggtgctggccagtagagcacatgtgtctctgtgcatcagagcaaggacccgggctctccccgtgagtgagaagagtccatggggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaggttcggcagggaagccagaggagtccgcagcccgggagacctggcctacagcggagagagtcagtccatgccagtggtgggatgtggctgcaaaaaatggtcggattcatggaagtctggtgtccagctggcaggcattagtggtcccatgaatacagctgtgtgccttgaacacgtactgcagagcttccagagagcaccagggctgtgggggctagagactgtgtctcgtgcggaagcgtggctgagaaggggctcgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtggaggttctggctgaaggagccagaattccagtgccagctccactcctcacgagctgtacaacctgggccggttactgacccctttcccaccttagttccctggctctacaatggaggtaattatcgtgttgaactcacagggtcgagatcatatttaacactttcacagcccttagaagtgtctagcacagtggtcctcagcatttggaaatgtctggaaacactttgtcacacctgagaagagggatttcctactggtgtctagtaggtagaggccagagatggctgctaaacaccccataatacacaagacagaccccgcaacagtgaactctctggcccctccaagtcagtggtgcagagattgagagatcctggtttcgcgttttgagcgtgcagtacatttcagttgttagtggaacatgcaatacatctttattcacatgttattacttatttgtcagatgtttgtaaaacatctgctacattcttggcagtttaatagaatctggagatacaaagaagttcctgaccacagaggtcatttaggcaagctaggaaagcacagaatgatataacacaaagttacattgtaccataaagcatattctatagtacacttaactctggtgggctcttggtataaaaatgtctccaatctcagaggtcatgggatagtgggcaagacatgaaaaccttgtataatataaaattttgttacctctaagtgctgaaattaaggtataaacaacgtctcatgggaaccaaaacatcagtcatttggaagtataagtcaagccttcgtaggagaggaaccatttcagcccgatattaccagagtgggatggtcccagcgagcgggatgtggagggttaggatgttatcttagtctgttttgtgctgccattaccaccaagtaggtaatttataaggagcagaagtttatttggctcacagttctggaggctcggatgtccaagatctagaggacacatccggtgagggtcttcttgctgcattgtctcatggtggatggaagaagggcaaggtggagagagagagcaggaaggggcctaattgtccttttataaggaacccactcctgtaataatggcattaaacccattcatgagaacagagcccttgacccattcatgagaacagagccctcatggcctactcttatgagaccccacctcacaacattgttaacatttaggatcaagtttctagcacatgaactttgagggacacattcaaaccatagcattctgccccagtccccaaaatggatgtccttgtcacatgtagaatacatttgcttcttacctataatcccaaattcttatttgtttcagcaccacattaaaagtccaaagtccacagtctcatctaagtcagctgtgggtaaaactcaaggtatggttcatcctgaatcaaattcccctccagtcatgggctgtgaaatcaagcaagttgtctgcttccaaagtacagtgatgggacaggcataggacagatattccattccaaaagggagagataggcaagaagaaaggggcaactggtccagacaactccagaacccagcagggggaacaataccaaatcccaacttgacaataatcttctttgactccatgtcctgccttccagacacactcgggtagggacttgggcccccaaggcctccggcagccctgcttccctggccttgctgggctcattccatgcagcagctctcaccggttggagtctcatgcttgcagctcccccaggttgctgttgcacactggtagctctgcagttctggggtgtcaggatggccttactcccacagctccactaggcttcctggggactctcagcagctcagactccacagttctgctgggcattgccctacaggggctccctggtggtggctctgaccctgcaaccagtctctgcctgggtcccgagtctgtccgcaatatcctttgaaatctagttggagggagccaggcccatagcccctgcattctgtactctggtggcattaggaccatgtgggatgccaccaagactcaccacttgcaccttctagaatggtaggtcaagctgcacctgggcccatttaagccatggctggggaggcagaggagcactgtgcccaaatgtgggagcagagacttgaggtggccctggacagtgagccacaggtcctgagggctcccaagacctggcttttgacatagttccttccctcagattttggcactgccggagctgtgatcacaggtcatctctgcagtacctttgggatcattcttattttcttgatgaatagcctctggcttcattcttattgtactaatctccttatcaaactgtggctctggccaatactaatctccttatcaagtggtccatactaatattcttattaaactatcaaacggtaacatgcctgcacccttgctttcctctcctgaaagttctttcattctctactacagggccggtctcagaatccttccagtctctaagttctgtttcgcttttcattataaatttctttctttctttccttctttttttttttttttttttttgagatggagtctcactctgttgcccaggctggagttcagtggcacgatctcagtttactgcaacttctgtctcctgggttcaaaccattctcctgccttagcctccctaatagctgggatttcaggtgtgtgccaccacacccagctaatttttttgtatttttagtagagatggggtttcatcatgtcagccaggctggtctcgaactcctgacctcaaatgatccgcccgcctcagcctcccaaagtgctaggattacagacgtgagctactgcgcccaaccctgcttttatttataagtttcatctttaaattatttatttcttctcaagttttacagtatacagttaaaataagtcatacagcaaccaaaatgctttgctgcttaggtatttcttccaccaaatagcctagtttatcactcttaagttctgcctgctatacagtttgaggacctggacacaatgtagccacattctttgctgctttgtaacaaggatgactgttatgccagtttccagtaccttaatcttcagatatatctgagacctcatcagaatggccttcacgatcgatatttctaccaccattctgatcacaaccacttagtctaagaagtttcagactttccctacagatcttctaatcccgctttattgcctgcctgcctccctccctcccttccttctttcctctctgctctctctctcttttcttcctttccctcccctcccctgctttcctctcccctctccacttcttggcaccaattttctgtcttagtccattttgtgctgctgtaacagaataccacagattgagtatattataatgaatagaattttatttggctcatggttctggaggctgggaagtccaagatcaaggggctgctctggcaagggccttcttgctgcatcatcccatggtggagagtggaatggcaagacagatcaagaggggacctaactggccttttataaggaacccagttccacagtaatggcattaacccatccatgagagcagagccccatgatctaaacaccttttattaggccctgcttatactgttgcactggggatcaagttgcagcacttggacttcgggcaacacattcaaaccatagcaggcaccttaataaaggtggaaaagggatgtggcagctacagtgggagggaaaaggtggctcccttagtgtgcttgggaggagggtaagagatgcgtttgcagttctcatggccgcagactgaaggggcctggttacctaagggaccttggcttcatgtaaggagtgcggagtgagtgaagcaagagggtgatttgatccatatcatttcttagaaggataccatgttggcagtttcgaagaaggggcatgagtgaggaaacagttgtggtgaagagaccagttaggaagcctgtaacttggggtgggatctggaaccaggctgtggctccggaagaggagctggagggctgcactgtgaagtatttctcagagtctagacaatgtgaccttcacactggggctgagttttgtaaaatccgacatccccagtttcacctatgatgccaggcctgtggtaaggagctttgcaagcatttgctagaatatgagcaaatggaggtagaactgataatatttagtaaccatggggggatgaaagagggaggtgttgggagactgggttgataatatgggggttgggagtgaggagagagtccagctttgaacatcttcttccatttgaggaatttaagatcatccagctagaaaattagaaatactaggatggagtgtggaagagaaattagtgctgaaaataaagagctcgaatcatcagtgtatgaatagtagttaaacctctgaaaatgagtgaacttgtcccctgaaaatgtgtggcaggggagaagcgaggttcaaggacagtgcccccgagaatgccagcatttaaagggtggaccctcggtggctcacgcctgtaatcccagcactttgggaggctgaggtgggcggatcgcttgaggtcaggagtttgaaaccagcttggccaacatggtgaaaccccgtctctactaaacatacaaaaattagccaggcatggtggtgggtgcctgtatcccagctactagggaggcacaagaatcacttgaacctacaaggcagaggttccagtgggttcgtgccacttcactccagcctgggtgacagagggagactccctctcagaaaaaaaaaaagaagaagaagaaaaaaaaaaaggtgggccccggcagcagagcctactgtcccggaggcaggaggaaaacctgaagggaatcttgaccttgacctagaagccaaggaggaggcatggccaacaacatcaaaggcctctgagcagcgcagtgaagactgacaatagacctttcttaagtttggcaattagaaggtcattggcctcagcaagagcaatttcagaataaaaacaagagtggagggagtggcataggggtcgggggacagagtaggaagtgagggtgtagtagaggggaagaagtttgatcactgagggaaggagggagatgcaggggtagcttgaggaggagatagagcagagagaggtttgctgtttattttaggaagaggagacttgagcatgtttataagtcagagaatagagaaggagaggtgggagacacagggaaaagaggagtcattgattgggaactattctgggaaggtgaggtggatctggtgtctaggtggaaggatttgggggaaagaggggaggtaggagagtctagacgtagacagcaggcagacaggggctccaggttttccctacagaactgaggacagtgatggccgagcgtggtggctcatgcctgcaatcccagcactttgggatgccaaggtaggtggatcacttgaggccaggagttggacaccagcatgggcaacatggagaaaccccatctctactaaaaatacaaaaattagccgggcatggtgacacatgcctgtagtcccagctactcaggaggctgaggcacgagaatcatttgaacctgggaggtggaggttgccgtaagctgatggcaccactgcactttagcctgggcgatagagcaagactgtctgaaaaaaaaaaaaaaaaaagaagaagaagaagaactgaggacagtaagagtaagtggtcgcttgtgatcacagaaccagcaagtaaaccgcgagcttctgcccctctggtcttcccagaccccttccccggaacattaagccatatcgcttttatgggtccaggggctctgaggggctgggcatcatactgtgcccctgggggcatatctagttctgccccacttggttgggcgggtacctgctgagtactcactgtgtgttaggctgtgaatgctggggcagcaggaggcatggtttctgcctccactgggccttatttcttcaccttgtcccccagttctgcccttgggtaagttctgtggcagaactgaccagctcccttcggccagggacatcttggttcctggcagagcaccaagaagagcagattgtcttcctacccgggggcacctttgcccagcaggtcgggtgagctggcctcttggtgagaggctggtccccttggacatgagtggattcgatgcctgctttcccacccaggtactctactgtggctttgctcctgccctttatgctcagagctagaccagcaatgtgggggagctgctggggaaaggcgccatgttgtcttgaggtagcagccagccccggaagccctggaatgcctggggccactgagcaatcctcaccctcagccccacaaggggagggcgtggctcgtgaaattcctgattgggtatagcccagcaagccccaagactcgcccagtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttccctggaaggcagccctggaggatacctgtgtatctgtctttcacaaaaggtgaaatgagctctttgtagtgtttcccgcccaggctgcattttagaatcacagaggaggtacggcgctgatttgttttactattccctattcatgcctgggccccacccctaaccaattaaataaacatctcggagagtggggcctagactttatatgtttaagctcctcaggtcattgcattgtgcagccaatgctgtgacctatgaatacaaaggaagatgaaacgcaccctggtcatgcaaggaagatggagagagggagcagggagggtgagagaggctgcagttcgtaaggtcctgaaatgttagagctggagggatcctggttcggagcactgcaactcaaaagagtagttctagccatgcagcaggccccattagggagctggttagaatgcaaatccccgcctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaatatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctacatgtgggactagagctgcgaacaggacagacccaattccaaccctcacagagcttatatcccaactggggagacagacagaaagaaaacaagtaactaagctgatgacagatgggaaaagctatgaaggcgaggagggccatgtgtagggaacgactcagagattgctgtggggtgaggggtaggtaaggcacgcccctttcagaagagctgtcgggggagttactaggacaatacctttaactggggactcctgctgattacaaactgatcacttttctttactggacaggactaggcttcatcccctctggggtttggggatggtgcttctgactctcctgaggcagtctgaccctggtccctgcctggctgtctcctctgactcaagactctgatccttcagtgtttgtgggttcagagcagagcctgggaatgagcccgctggggagcaggacactgactccaccataggacagggctcaggatcattggttaatggtttgtaaaatggaccaggcctcatccagatgctgtccccagcccctatgaaaacatggaaagtttccactggtgcacaaacactagtgcttgcctccctttcctgatcaaccgtcggactcacatgggctgtttgtgaaaatgcctgtcccaggccatactcaggctgaccaaggtggtctggtctccagggaagggccgtgaaatgtatttttaggaagtggtccaaaggactcttctgatccagatcatcaggaagcatggcgtggatggaagaaactggcacttggcatctggtgcctctgtgtggctgtagaagctacagaaatgtcttctgcagtgactgcagcgtggccctggctgagctggtgcttgtgaggaagcctctgcttgtgtgcaggggtgaacagcagctcaccccttcccatgcacagtcctcaccttactaccttcacccttactggaagcatctcttgacttctctttggccagccagaccctcccagctccctgtgctccccatttaaacaccttccctccctgagcttagcccatggctgggtggggaggcgtgagcactgtttgcatttggtcagggcctagaagggatcaaggaggcctcatgaggaccatgtcatagccccaccctcactccccacccctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcactagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcgcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagca

SEQ ID NO: 2114 - DNA, 13872 bp, Homo sapiens
tttgtttctgggcttctctttggactcctaagtccaaagtgagagaatacatttcttggccacaggccatgagagagtacacaggggacttggggcaaactgaggcctggtgcatgtagctcagctacacgtggagcttcctgtgggctcatctgcagaaggtctaaggcagagaacacagattcttagaactctggcaggaaagaatgttcatggcatgtaaagaccatggcatagttggatatcagccagtcatatagaaaagcccatcctgaattttcaatttgaggccccaggaaatgtggttgggtgagtcatggtcctcaaattatcttcacaaggaatctggtagctcagactgcagggcagggcactgctgggttctccccgtgcctggcccctcagagccttgatgtctggggccttccaggcgcatggatggaattaccaggcaaggccagggtttaggtgagcagggtgggttttctcagcaagaggaagagttcatttgctctctggcacaagatcttgactttgattctttgtactgttgtgacctccaggttttcagccaggttgtgctcaggaaggacagcaggaaggtatcctgtgcgataggggaagagagaaacaagctaactgccctggtgttgtgtgtgctgctgagctggcccttggctcccttctcagccttcagaccccactccaccccttcatgggccttgactccaaacaaatcaagttgcttcctctccccttccgtatacattctatgccctatacattcttgcctccgagtctttgctctgtttcctctacctgaataccctttctccaaattctaccttttttctagacctgatcctctgccttctcttccaggaggccttcctgggttcatccaggtagctagagtctttccttcctcctgcactgggattattttgtgtcttacagtagagctacttgcatacatgcgataagactgtaaactctcggagggagagagttgcccttgctctttcttgaacctcctggctccctgccccgacagctctggggagtgagcatatagaactctctgctgggcgcggtggctcacgcctgtaatcccagcactttgggaggccgaggcaggcggatcatgaagtcaggagtttgagaccagcctggccaatatggtgaaaccccatctctactaaaaatataaagagcatggtggcacgcacctgtagtcccagctacttgggaggctgaggcagaagaatcgcttgaacccaggaggcggaggttgcagtgagccaagattgcgccactgcactccagcctgggcgacagagcgagactctgtcaaaaaaaaaaaaaaaaaaaaggactctcacatggtattctctagcaagaagcgtacacagtaggcctgctccttaagaccatcccacacgcccggggtatgcagatgccctgcggggtttctcctggtgctgtaggcctcaggggtgggtgcttcctggcttacgtgagaactccagggttggcagcctccccaggtctgttccctgctgagcctggtctccccttgctctctacgcagctcgatgacttgtacttgatcgccatctgccatcgccggggcatcagatccctacgcgaccttactccggagcacttgccgctgctcaggaacatcctccaccaggggcaggtgagtggcttcaccaaaccacgtggaagctcagagaaattagactcagattccagtgtgttcctgggcccctttcctcacctttcccagagtccatcttggagagacttctctctggatgccagtcttggggaccccattaggctcttgaggttgaagagcagggctctttgtccctggtcctgccacctttcctcaccctcacacgccttcctcggcctttctccatctgggatgcacttccacccctcaccccatagactctggtccttaagtcctggcccctcctactccaggatcacctgtctctctcatgacaaccatgacaaccacatcatgccagagtttcttgggagtatgggcacatgacttcgatatgtgtgtacacgtgtgtctccttgtctagattgaagacaggctgaattctgtagcacctggtgttctgggatactttctctctgggatatttgttgaattgaatgaaattatcggggctctaaacagagcccaggagcacggggagatgggggaagagtgtctagaatcttgggtgtggtcctggcctgacatttggaccctaaccagctgagtggcctggggcaggtcacttcacctccctaaaccacattatctagatggatcccttctaaatccaccatcctaaggggctgggtctgagtcttttttccactctgaaatgtgatgctctgcctaacacgccagagctagcagtcacaacgatgcccagccaggagagaggtttgcccctttttgaccagtgatgcttcgaggtgttaatgcagacctggaggcaaggctctgcccatacccagcttcccctgctgctgggccccgatctatcttccctcctgctcacccacggcaccaccccttggctgcctttatctttgtggggtgacttgttcagatcctgaagcagtctctggatattacaaatggcaaagaatggtgtctttctcttggggagatgccaggccaacactttgacctgccctagcagctcagacagctccaccctggcagacagacctcacttactccaggaagcccctcgggtgccttggccctggtctcgccccgctgcagggattcctggggtgagctccaaatgcagaacacagttctggggtatatactgagcccactgaggccctagtacttttctcttcacctctgaccacctcagggatttgcccacaatggagatgagagtctccgcttaattctatgcctcacagcctcctgaaggtggaggttggtagaaaaagacccacccctgagcaaggtggaggtgggcaaagggagccagggccaaagtcaatgctttcctcttctgcaaggagcccgctgagacttcgccaggtctgtgtgggagcagcccctcccataccccttccacagtccctgctctttcaccaagttctcagcatagccccatccccaacttcattgtttccaagctccaccctgtgctatgctaaaagagagaatgaggcttcctcccatccacttcatgactgatgaaatgcttctaaatcatgaaagtccccatagtcttgggaatctggggcctgtctgtagacactgggccttccaagattcccagcagcaactgtttgaggaagccagtgttttttccacgttggggtggggaatgctgattgaggccgctccccacttcttttgggagagtctcagctttgctgctgtcacctgcacttgtggatttcctagactagaagacagaggaagctgaagcagacagcaggtagagagctgtttggagggtttttgtgagctgtcccaggccaatccaggattcagatgggaggagggtctaggtggggacatggcgccgggcctcaggcagcacggtgactcctgacctgcctgcccctgtctcatcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactcagtgtggacagcgtggcctgggaggcagacagatggtgggggacagtgggtgggtagaacctgtgggaaggccttgagaatggtggaaagtctccaggtggtggtttcaactgacaggtgggagctgccctggaagggtgccgagggccttctccaagccccagggctcaccgtccgtggtggcttccttctccccactctgtgcctctcctgtttgtacaacttcttattctgctcctccccatcacccctcctccttcccctgccatccacctctcctttgaggagttccccaaaaaaccaaacttggaagctttcaggaaattatctatacaggtttctgatggcacttcctccttccagcagtgaggtcacacctccctgtgagtcagtcaaccctgctgataaacttcttgttgacgaggataggggcttggtgcctggaaatcggcgggttttaataagaatcagattatgcaaggccgaaaagcctgccttgctctgttatttggtcagcgagtccccagccttgagtttttatctcggcaggaagacaaaacagactcacatgaagcagccagaagatcaagtgcaaaacagtgaatcagcaagggcaaatgatatggttgcagttgaatacaaaagcccggaggcggctcgggttcaaggcctatcagaggcagatgttcagaggatcttgagaccaggaagggacctcaaagcgtcagaggctgatgagcagttaggcagccaacagggctcaagcggcgcagggacatggcttgtatgggcgggcacacaagtaaacacacaggctctctccagcacacaggaccaaggcatcatgctgccagaggggctggtgtttgccactttgtcagagtagggctgtggattttgtgccttgcttgggaagctctcagggatggcaggatggcaggctcctaagtgacagcaggggggaagcttgaggcacagtgggtggtccttactctccatcccctgcctgagaaccaggaagcctcattcagagattagcccctttactgcaggtggtagcccaggtgcagccaacctgcttcagggtctcagggcctgctgtggacccccatggtcctgggagagactccttagaaacagcagaatcacgaacatggtgaaacccatctctactaaaaaacagaaaaattagccaggtgtggtggtgggctcctataatcccacctacttgggaggctgaagcaggagaatcccttgaacccgggaggcggaggttgccgtgagccaccgcactttggcctgggtgacagagcaagactccctctcagaaaaaaaaattaaaaaaatagaaacagccggggagtggagggtgtggtcagaaagcctcagggacctgcttcagccttcagggagttcagatgaggcacaatgaagccactggcctccactcagccattcttccctgcagctcttttttttttttttttttttgagacaatctcgctccatcacccaggctggagtgcagtggcacaatctcgactcactgcaacctctgcctcctgggttcaagtgattctcctgcctcagcctcctgagtagctgggactacaggggtgcgcccccatgcccagctaatttttgtatttttagtagagacggggtttcaccatgttggccaggctggtctccaactcctggcctcaggtgatccacccatctcggcctcccaaagtgctgggattccaggcgtgagccaccgcgcccagcccctgcaatacgtcaacagtccctagattcaggcaacatggagttgcagccaaggaactttgaggtagtgaccaatgcagggaggtctgacagagaatcagcaggatccatttcatggccaccacacatctgactgactccttcttgggctaagcaaatacttttgtgggcagtgacactggcagctgctggggtcttggcaggaggttggatggaggtcttctcccagagcagtgtccagcttgcaggaatgctccctgcgtctcagttgtgcccattccaggtccaggggaaagaagtgacccgcttcccctctgaaagcagatgtggtcccaacaagcaaacacggtctccatctccagcaccacaactgccacggagcagagggaggcctccctgtggagcagcccttccctgtggcctcagcccatgccctcctgcccagcccccagtggtgctgctggagggtctgactccacgggctcccgctgaccttgccgttccttcccctcatctcgtagcgcctggcccctggaggaaggtgggtaggaatttgacaccggataaataaatgtttgaggggcaagagagatgggacagagttcacccaacaggacagacgaggctggcagtcacagcagagggcaggcactcaggtctggagaggcagggcatggagacagggacccacactctggaaggtttctcgactcccccgaggggctggccagttctgtcttccttctgcccactctgtggggaggagcctctctgggatagcgtcccctcactcctctcccagcctcgtttatcttcaccacagtacagaagggggcccctctccaggcctcaccacttaacttttcttgtacatggaaagacaagcctctgctagaggcctggcaagggttccccttcagagccagccagtgctctgctgctgtaatctccagggaccctgccggccacggcccccatgcagctccctccctcaatccaaccctctttgggcttatcaccctcaaggtctagagtgcaccagggttggctgctctgccaagtcctgttgagactccaaaagcatagtctgtctttattagggtgaccttcatatcagactcccaggtaactcaagatgatagctttgcaatatagtgcctccttttattcctatttgtgagtttctccgctttcctcactagactgagagggtcttgagggtaggagctttgttttagttatctctctatccctggcccctaagacactacctggctcagcaaaccaacctttgagacaaagcaacattataacactacattcatatagcagatcatttcatgacccacattctccttcctttttacgaagaaatgggctcaggatgtcttgtccagcattatggagtgaacgtcagctccaggaagcagagacttctggccctttgttcaccatttccccagaacctagggtggtgactcacctataagtgctcaaaaaacatgtggcgaatggaggaccagagctaggctctgaatgaggcctcctggatctcacgcaggggatggagagtaaggaccagcccctctacctcatgctttcttcctgctatctcgtaagagcccaacatccttctgtcctgagcaagccacaagctgcagccctgccttgacaaaatggcaaatgccagcccctctggcagcatgacaccttggtcctgtgtgctgcagagtgcctcatgtgttgaactgtgtgccctcagaagcatgccatgcccccgctctgctggagcagtggcagatgtcacccttcctagataaatcctggacggctccacgactggcttttagccctcaacacttggcctacattctttctggcttggttggagaaggaaagaagcagttggaggcatgactgctattgttccttggcttctctccatttgtctcaaactttcctaatagagcaaaattgctgagtggtctctatttaccaacatgaaacagaaaaataccatctcaggctccatattccatgtccctgttgaatacagatccccgaactgagaaataagaaacaactacatacgaagtaatacttgaaaatgtttctcttgtaatacttccatatccaaagcatttgaatatatttattttattgatgtaggtctgccaactcttccttctcaggaaggactgtttttattccaaacatgtatatataaggttaaaatgtattttttaaaataagataattattgatagttgtttttaaaatagccttgcttagcaaaataaatgttggcaaccctaagtttgttctattataatattattgaaattacattgaattctgaaatccatgtcaacttgaagttaccaagttttaaccactgttagaaaataagcaggaatgaaatctgtttcaagcgtttcaatttcaatacaatttaataaacaggctttgagcatctacccccacccccttttggtttttttgcaagcacctggaggcagagctcatgtggagcttacaatttagtaggaacacaggcattaattacaaagtaattacaatgctgatgagtgtgttgaagtggagggggctatggggcttcagccccaaaaagctaaacctgcaggctaaaactttaaaaaaatatatttaattggcaaataaaaatagtatacatttatggtgtacaacatgttttgttatatgtatacactgtggaatcactaaatcgggctaattaacatatgcattatgtcacatatttatcattttgtaatggtgagaacatttaaaatctctgtgagcaattttcaagtatacagtacattgctttttttgtttttttgaaacagagtctcactgtgtcacccaggctggagggcagtggcgcagtctcgactcactgcaacctccacctcctgggttcaagcgattcagcctcccaagtagctgagattacaggcgcacaccaccacacctggctaattttgtagttttatagtagagacggggtttcaccatgttggacaagctggtctagaactcctgacctcaagtgatctgtctgcctcagcttcccaaagtgctgggattacaggcgtaggccaccaccccccgcccagtacattgttattaactattgtcaccatgtggcacaatagatctctggaacttcttcctcccatccaactgaaagtttgcattctctgaccatctccccattccaacaggcaaccaccattctactctctgcttctgtgagttccactttgttaggttctacacacgagatcacgcagcgtttgtcttcttgtgctctaggctggatcttggttatcagcccaatgacaagcagagtaaaggcccggaagttagggagaccagggctcagtgtggctggcactgagagctgagcttctagcgtgggcccacacatacatttaagactgtagccaattttcctttcagaaccacgatgaagaaatgaaagccaaggccaagaaaatctttaatgttctgttcctcccctgcttgggaagtagagtggtctgaaggctccaacacagaatctgtgccataaccaagtcttatctggggcaagttacataactgctcatgaaataggagtgataacaatgcttcccccagacggtttttctgagggttaaataagaattttgtgggacatagtaatcactcagtaaatgttctggtctgagagtgaccaaaaggatggaactagagatatttgggcaagatatttgctatggcctgaacgtctgtgttcccctaaaattcatatgtggaaatcctaacacccaaggcaatcgtggggcctttgggaggtgattaggccatgagggtggggggcccccattaatgggattagtgcctcataaaagagatcccagagtcacccctaggcccttcctctcactgtgaggttacagtgagaagatgaccttgtatgaaccaggaagcaggctgctggcatcttcatcttagactttctagcctacagaactgtgagagatttctgtagtttataagccatccagtctacattttgtataacagaccaaacaaatattaaaaataacttcgtgattagaagtgctacaaaatgctagactacgcatggaaccaagagtttctatttatttactttttgagacagtctcactctgttgccaggctggagtgcagtggctcaatctcggctcactgcaacctccgcctcccgggttcaagtgattctcctgcctcagcctcctgagtagctgggattacaggcacccactaccacgcccagttaatttttgtgtttttagtagagatggggtttcaccatgttggccaggctggtctcgaaattccgacttctggtgatccacccacctcggcctcccaaagtgctgagattacgggcatgagccaacactcctggccaaccaagaggtttcaaggaaaaaagccgtaaacttttggtggttaactgactgtggtcctaaacagaggcaggggctgtgtgcaatgacttctcaggatctctttcagcctacaggttcctggaatgcatttcagctaacactacaagagtgatgtcccttgctactgagaaccctgggaacagctcagctccatggtccagccatataaatctgataaaaataggagctgaaataccatcctggagttgctatttttaaaatcatctgagatgctggatggggtatatttcttcctcaaacacatcttgctgtttcctcctcttggtgggcaggatgctaacgtggcacatgatacaggagctgttccacgctgctgctcacacccactcctgccagagaggggccgcagggccagggcttcccagatctagatgcacctgctcctccctctgctcctgaggcccctctggttgccccagcacagaggtgtcctgccacttccaccaagcagaaacacaggagagtttgggaggcaaaggaaatgggaatggaggcagcactgatggcttggaaggggactaagacctgttgttcctctggttgccttggtcccactttggcacagttaacatccaaaagaaacagtccccatgggccaaagccctgcttatcccatcctactgcctcttgctgagccgctcatcatgtgttgtagttgcaccaaaggggggcctggggccaaaaaagcacatggagaggagagaggagagaagaggagaaggaaagatggaaagacaagaaaagagagagagagaggaaggaaggaaagaaggaaggaagaaaaaaaaagaaagaaaaagaaagaagaggagaaggaaagatggaaagacaagaaaagagagagaaaggaaggaaggaaagaaggaagaaaggaaagaaaagagaagaggagaaggaaagatggaaagacaagaaaagagagagagaaaggaacgaaggaaagaaggaaggaagaaaggaaagaaagaaaaagagaagagaaggaaagatggaaagacaagaagagagagagagaaagcaaggaaggaaagaaggaagaaaaagaaagaaaaagagaagaggagaaggaaagatggaaagacaagaaaagagagagaaaggaaggaaggaaagaaggaaggaagaaaggaaagaaaaagaaagaagaggagaaagaaagatggaaagacaagaaaaagagagagaaaggaaggaaggaaagaaggaaggaagaaaggaaagaaagaaaaagaaagaagaggagaaggaaagatggaaagacaagaagagagagaaaggaaggaaggaaagaaggaaggaagaaaagaaagaaagaaaaagagagaagagaagaggagaaaggcaccagaattgcttccctcctgccccaaagatgacatggcttctaggcagtgagctaagcttgtggccatgctgttaagaaactggagggaaaagatcatcatgagtaagcacattgtggcctaacctgaggggagcagaattacggttagcttctgggcacctagtaaccaggcttgggataagctgggggagaggcctgaatacagcttataggttagaaaaggcacgccacctgcatagtaacagcacacacttatatatagcaggttatgctttcagaccaaattcgcatccattgcctgatttaatgccaacaatagccctttgaataagcagttatttcctttcccctccccccaccccagtaagaaaactaaagctatttagtggcagagacaagagttggaactcaggtctccaggaacaaatgctggttcttaagttccattttctggtagagtgacatttacgtgattcacggcaagaactgcaaactgtgcttagatctagttcatcaaatggccaagtttagaggctgggctgacgcttggatcagttctgtcagattcacttagttatgaagggcagctgcttactccctttgggccagtcttcccatctgtagaacaaggaggctcttccctcttcctcgacttgcccgaggcagggacttagtcattgtgttctttatacccagcttaattccaggcctggagatggcatgcaataaatagttgttgaatggctcacgcctgtaatcccaacactttgggaggccgaggcgggcggatcataaggtcaagagatcgagaccatcctggccagcatggtgaaacctcgtctctactaaaaatacaaaaattagctgggcatggtggcacgcgcctgtagtcccagctactcgggaggctgaggcaggagaatcacttgaacccgggaggcagaggttgcagtgagccaagatcacgccagtgcactccagcctggcgacagagcgagactctgtctcaaaataataaataaataaataaataaataaataaataaatagttgttgaatgcatgtctgactgattaagccaaaggcaccatattcaaacaaaatcagacactggtgcaatgccaaacagcttctgcccgtgcaaggaatgatttagcatggagcacagtcacctgcagaggaacaacttggaggcagactctccttactcagctcacttggagcagagcttcctgagttgggggttcttgacagataagccctccagcttcagcagaagcaggcttggagctgccacttctctgaacccccttgcacttactgtcagtcactcacaccttgcacttattcacatcctatcctgcctcgttcttgaatggagtccatggtgagccttctctgtgccgctggatggtaagcttcctggggacagggaatgggtctgatagtttccttggagcccctggcgctcccggcactgggctgttgatacgtggggctccggaaacactgtgctgacctgtgaaagggactggcctaaggggctgtggattgtcctgtagggtgacttctgaactgttcttcagcctgggcagttcccaggtttatttggggggatgcctgggtccaaagaaccagggtcaggggcccaggggtttcttcctggagacaggatgcctggcgccttcaataacggaaaggaaactgagaaactttctgaggccaagataaagagtatgcaagtgaggggtgcagagagagcagtttaggggcagcaggccccaaccgaagcagaggaagggcccacgtctgggcccaggggactgactggctgccttgcgtgcatggggcacgggaagcataggctcccggaacaggaccctgccccagtttccccagtgagggaaggacaccgttccccgtgggatagagcactgcaccctttcttgattctcattgttcccgggagcgagcgccttggctgcgctgggcatacccaccctggcgccattcacaggcagtgcctgccctggccctgtgctcaccccatcaggcctcctcttccgcctctctggcacccacggcgcccctgcttgcctctgtccgggtctcggaggcgcgaacaccatcccaagcctgcgaccgcgcggcatcacccccgcccttccccctcctccaccccgccctttct

SEQ ID NO: 2115 - DNA, 58749 bp, Homo sapiens
ggagccgcggggtcctcggccgcctgaccccagccggcgccgcgcctcccggagggggtcgggccctgcacgtgggcgcagcgcgggtcggggtggggctgccacagccctgcggagctgctttccggggtccctttccctggaccagattttcgcgggaagccggatcctctccgttcccttggagtgagcaagcgggacagttctgcggaaagtttccgcccccaatcccccagccctgcgcccggactgaagcggcggcccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggagttgtcagtgggaggccggctgtgcccagggtcctagggccacgttatgggggtcgtcaggcctaggccactgtgcctcagggctgcatgggtggtgagcagtgggagggatgcgatggggggagtgggctcagctgtctgctgtgggtgtttcctcggggacctggctggcagggacctcccggccagcccagaactgccaacatgtctgccagcactgcccctccattcccagtcctggggggaggctctgtctgggcagcttgaggcctgacctactgtggctgcttcctctgctccccagcctgggtcctgagggcctggcttaagggaactgctgccagaaggctgggagtgtaggcagtgttcgggtgcccagctgtgccctgtctgacctcatggccacccacaagctggcaccccccacaggcctcttggggaagcctgtactttccaccgccggaggcgggtaccgcgtggaagccaggctcaggcggactcattctttttgaactttgggaacaggcctggtacaggctgagttctcacaagagacacacacccgtgtcactgtctcctgagctgtgccggacccgtcctacagactccacctcctctaggtcctggccctggcatctgccagggggattttaaatgagttgatatatgctaagtgctttgaaaggcgcctgcacggagggagagctgtataaatattcactattggtaatatttctcccatgctgttactctccaaagctgcccgataattctagagtgggttccggggacgtgcccgctgtttggggcctagaaatgaactcgggaggttgttttgcttgctgagagctggtctgggaatgccccttgaccgttccctgccctgctcctggcccactcccagactgctcctgtgcctggccccattgcgctgggtgggtgatcctaagctgccccatgggccctgggctctgtcaagacatggggagcttgccaggagttggggccagatcccccagactccaagatggtaaccgaggttgtgagggtgcacatggaaggaagagttagaagagtgaattggaaattgccagcttggactttgggcagagtgggtgtctttagcttggggatgggttgttgttcagagacaacagggccgccttctctgtgagctggcggcccaggctgaggtgcctctgggctgccttccctacgggaagcagtgactggccctctgcttctcaggaagagagtgccgtgcccccgccagcctcccaacctcgttagactcctagaatccggttttctggatagaactaagaatctgctcctttctggacttttaatcctggaaagggctcccttccccagcaggagcagagagaccaaaccccctttctgtgctccatcttgagctgtcattctgtcctaactccccactggccaccatctgcccttgctttgggggctaccccaggtctgacttgggcacgttctctgggtctctcctcagagaggctgctcctggggttgtcccaatggaattgggaattcttctcagaatggctcaaaggtttgcaccatctgttggagggaagggatccctctatcttggactaatacaaatgtttccgtgcctgccaagttccagaccctgggccgatagggaaaggagctggctggggggcctgcaggggatggagagggagcttgggccccaagtggggtctgaagtccaagcctacagattgccatcaaggcagccgctagagcctagcccagctcctggcccctcggagatggaccttagatgctggagagcggggcagtccagcagtgcagggtgggacaccccgagcaaacagcccctgcttcctgccccctcagttcagtcgcactgggccggctggacgtttccctgcaacaggcccctgctggtggtttagctcccgctccgtgtttccctcacgctgggatcctccttcctactcaagacccacgaccttgacctgaagcttttggttgccgggaggaaatggtgagtgtaggcagatttgggtgactcttgttattaaccccctcttctttgttgcccccttcccagaggcttctgtatgagtgtcctgagtggccctggatggactactggctgtccctggcctcagaatcaccccaacccctgccacatttcggggagggaggtgtgtgaatgatgtcctttattctacagactgaggaagtggtcagtgtagcttcacgtgagagcagcagcgtgcgatgcccaggccctagccaagtgctggtcagctttctgactggagcccctgagccctgcaggggctgaattcccccaaaggttgcttgggttgttgcatttcggggttagagggtgtgggtgtccagagctgtgggtttttagtgttggctgagccctttacctgggacctacagcctggccacaaccccatctctgttcccctgtaccccacactgccctgtgataggatgtgataagatggtaggattgcctatactgaagccctgggtgccactgctggcccagcagggaggaggttgctgctgctcgggctgaagtgaggtgtgggtctggctgggcctccagtttcccacctgggccttgattgtgaggaaggcctggcctggctgcagaagcccagaagcacctgagtaggagagttcctttgtcccacctgcagctcattcaagcctgtgcatgggggttggggtcctcaggatcttgctttcctgtttaggggaggcagccccaaagagtgctgggaccagtttggagagtgctaaggaatgctggtctgcagcgaccctacttgtgctctgcgtcctctgccaactgcagcatgggtgaacatctgtacatctgtccccataatgaaaatggcctcagcaaataacaaaaatattaccatttagcaatcaggcacttattaaaagcctggcccaataaacttaaaaaaaaaaaaaagatgtgctagacactttacgtcccttcatgtgagcttcacacaaccctgtaattaagcccatttataaatgaagaaatggaggattgaaggattaagttacttggccaaggtcatacagctcgtaagcagctgagctaggactcaaatccaggcttgcttccaaaaccttcacttttcagcccagttctcaactgccccctggagtttgctcattttgccccatgaagaaacagatcccagctcaaaggcgtgaaggggtttgctcaaggccacagtgtattagtgtcaaaggtggaacacaaaccctgacctctgagtgctctcccgaaccccacatcccggccgggccgtaccctgagcacacgcttgtccgctttctcagctgggcggggcggggcaggacaaggttcttctccctccctccttccctccttccctccttccctccttccccgtgggccctcccagcctccccagcccccacctctgctgctttcccttggcaattgcttccatctggcctgcctgcagctcctattcctttggaaatgtggctgccgcccacatggctgcaaggcaaccacggccacacgtggggaaggggaggggccctatggggtctaagcacagggaacccagccaaagtggctgctcctggcgtctggcatcctgattcctgccaggcagaagcaccttggctgcctggccctccttgatgcccgtcctgggctggctcaaggccagagaggctcccaaagacccaattctccttccaacatggtgagctgttttgcccacagacaagctccgcaccggcagccctccctgtctcttagaggttgctcaggttgggaggagggattcctggcaggagagaattaggggccagccggggtataccctgggttcccactgggttctgatcatttggagggaagtcatgcaagggactgacgagggcagaggctgagggatccgcggagttctgggcaggcgaggaggcagctgacttgctcatgactgtgggtatgcgccaccacactaggctaatttttctattttttgtagatacagggttttgccatgttgcccaggctggtttttgtttgtttgttttgttttgtttttgagacagagttttgctcttgtttcctaggctggagtgcagtggcgcgatctcggctaactgcaacctccatcttctggtttcaagttattctcctgcctcagcctcctgagtagctgagattacaggcacccgccaccacgcctggctaatttttgtacttttagtagagacagggtttcatcatgttggccaggctggtctcgaactcctgaccttgtgatccgcccacctcagcctcccaaagtgctgggattacaggcgtgagccaccgtgcccagccgagcgtgtctgtcttgttcactggtgtattttcttaatgcctggaatgatgtctagcaaacaataagcactcaatagattcttgtgtgatgagtgatggaaatgcagctcaggtatgctgatttgtctttgctgcatctttactttgcttcctcctcccagggcaaagggaaaaagtttcccttttgccagttgagctgtttgccagagaaaggtctggccccatctgtgtgctgccaccttgggggtctctgttcagacctcagagaggcaggcaggaacccaggtgaggatgggcaggagcttgtcccctgaggagtgcatgccccattccacccaccacagggtcggctggccacatttctctacccatcacccctccctagtaaccttcaggtccctgcagacaggtcctgacctcagctccaatccctatgtcagtcctctccttatttgaggcccaagaaaggtacccctacggtggaaccctcacttgggtcctgagagggagtgacagctttggaagagcgaggggttcacccacatttgcctcctcctgaacagctccacttttattccttgtacatattgcgtttccacttcaatttttttttgaaactgtgacagagggtttcttggctttaatttttttttttttttgaaaacccccattgagttccagttgtgacccccctgtggttctcattttctggtagcatgccgtgtggggtctcacctcctcgcctttgcttctgctgccccctcacatggcttgggcattgttggtaatgaccttgctagactgcaaatgtccttcagtatcaactgaagccccagtcctgggaagcctccgtggccacccagcaccggcacttcctcccccttcctccccctgcgttctccactccctgcaggtcctatgcctgtgacagggagggaaccctgtgctggggtgaccccagcatggacctcagtggggctcaggctgaaccaaaggtaggtggttctgggggtagtgcctgaggtggttgtatggagctgtgagatttgtattcctagaagcaggttggaggctctcagcccttccctccatgcatggccttggatacagcttgcagcctgccactgtagcctccatttccttctccgagaaattaacacttctttttttttttttttgagatggagtctggctctattgcccaggctggagtgcagtggtgcgatctcggctcactgccatctctgcctcctgggttcaagtgattctcctgcctcagcctcccaagtagctgggatcacaggtgtgtgccactactcctggctaatttttgtacttttagtagaaatggggtttcaccgtgttggccaggctggtctcaaactcctgacctcaggtaatctgcccacctgagcctcccagagtgccaggattacaggagtgagccaccgtgtctggccaacatttcttccttttttttttttttttttttttaagacggagtctcactctgttgcccaggctggagtgcagtggcacaatctcagctcactgcaacctctgcctcccgggttcaagcgagattctcctacctcagcctcccgagtagctgggattataggtgcccaccatcacacccggctaatttttgtatttttagtagagatgggggtctcaccatgttggccaagctggtctcgaactcctgacctcaaatgatccacctgcctcggcctcccaaagtgttgggattataggtgtgaactaccgtgctccgcctggccaacacttcttaatgggataatgtttcagataacatccagtgcccggactccagcactctataaatgctggctggtgtgcttttctgggattccagggtggggtccagagactgaagagggtctgctttctggcccaggggaagaggggcaggtggctcactaggagctgtcctggcatcctttgtccccgtccacttaccagttatgtgacctcgggcaggtcttgcactctggcactcaattagcatctgtgttaattggggtaagagtatctgccacgtctcacagcctggtgatggacaaacaaaacaaacattttttaggctgggagaggcctcagaggttggctgtcatattgcaaacgagggagcagagactcagaaaagtaacttagttgtttaaggtcacagagcacctctctccccacaggcagggagccggtaattgggctgagcctcaggagtaacccttctctctctgcctctccagcccctaccttatgcctggcccattcagctggtctgttctccaggcccctaggactgggtgggctaagatgagtggtctagaaatccctccccagctgggctggactgaatgaggggctggccgaggagcgggtgttgatggagtatgggagattgtcctcacaggcagtgtgggccgtttctctagacctcctgcccccatctccttcctgtccctgtttgagccgtgctcttcttcttcaatccctttctgtctgccttctctttccacccctagatttctcaccatcttcagtgatccctcctccttcctttctgcctcctctgcattctctccttgcccttgcttctctgatctgccttttttctccagcctcagcattcaggttgtcctcatagtggaactgggactctgggggtggctgggttgggttgcctggaggccgggaatgttcaggagagccttcattgggagcccatgggagcaggagtcagctcctcctgttggcagctccagcattttcgaacaaaaatggctcttccaggagttgagtttggcgaagagacagtgcctgcccaaagtatgcaatgcttttatctttagctcagctcctgagccctcatgcaactctttggacatcttcctgcaaaggacggtgggatcttgtctttctggggcctcagggtctccaaagatgggctgactaagcttccctagcctgggacctgaaccctccaccctcctctctcttgagctctttctcccaggggaagctgctcgaatgaggggagttggccaacacagttttctactctcagaccccattgaggtgagcacacaacagtgttctgtgtgagggtctggatacactccccaccctcccaggcccggcaccgtgtcgccctgccccagcccagagcttgcctctgttggctttgtgaccctcgctttgtactgtggctttgttctgccttagggaccagctggtcccctgctgtggttccacacagtggagactgatccctgaccactcattcagctgcctggcggccctggggcaagtgtttgtcccccatctcccaaaatggcggggtgcaggggctccctgcccggagtcccaaccctgccaaggcagagggaatggggaacagctgcgctggcccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtgttgggctggatgtgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctctcagcccactcatccagggatgcagctctggccttggcccacccccatcagagggcctgtggccctgatcaccgcactccccactctgtgaccagacgttctctcctgagcatcgctgaccctgcagctgtccaaatagagcaagaagtgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcatggtgttggggcctcacagatgatggagaagccagagttcaggcacttggcatgacccctggcatcgccttcagttgatttagtgtctctgccctgggatattccatgggaccctgggctggcttctgtgtgcagaggtgggtgtgggccatagcccagacctgttgaaccagttgtaggctctggaatcctctgtccccaggtagtgaccaggccctgacaggccggtatctgtccctcccatcaccctcccagttatgggtgcagatgaccctgaaattgctaaagcctcagggcttgagcccagaaagtgtgagcaggctggtggggcagctggaggaaggccttgcaggttcctggatttgggtgccgggtgggctgagaggacagtccctgtcactgggactgggcacaggtgcagagaggctgagacgggcccagaggacagtgagtgtgtgttgtgtgggcgccgggccaggaagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctccgggctgcctggtgatagctcccagggacctgcaagctgacaaacaaagtctatacgagccagagctggggtgggaggaacccagtgggcctgggggaggtaaagcagcagcagctgctgtagctgagcccggcccacggccagccctgaggaatggaggaagagagtgccctggctgggggagcccctcaagccctggaagctgtatgtgggcatggggtggtgggggcgtgcagagaggaggaggactgagagctgggtgtgtgtgtgcgcatgcctgtgtctgtgtgatctggttcccgggtgtctgagtagggaccaatgtgtttgtgctggagaagcctgtgtaggttactgacatggggaggggtggggcttgctttcctcaccccgcttcccacgtcttcattgagtcctcatctgggggccctgttccactctccttcccgtgtgcagggccctcccctctggcgagtctgcctctcactcgctcagcccctttaaccctgctggctcctaatgagacttcaggtgtggaccctcgaaccctcagctgcacaggtctggaaacatccttgttcatcaagcaccaggctgaccatggtgtccgtctcagtgcccagcagatgttctggtgaggggaggcgggagtgcaaggtctgccgagtgagggttccttccgggaggaggcagggtgagcgcagaaaccactgctccaaaactcttaaaagcagagccgagagcctgaattcagaggctgtactgtggggcagggctggaatttgtggcacctgcagggctgaacgttgcctttgctgtccctgcttggggattttggggtactgggtttggatagagtgtgtcatctgcagagggagcactgttctggaagtggactctgctcaggtgtggggggcctgcctgtagggggcaccgtggtggagatggagcaccgctcatgacaggaggctggtgtctggtcaggctgagggatccgtgtgccagcccttctgggaaggctgaatggggcggaactggtcagggcctggcaccaactccaggaggtgctacacccagacagacagatggaaagccacctccctagaggcctcctccccctccccttctgcatgccaccacaccccagcagcgtctcctgaggctgggccatgggtgaatctgagtcgagggcagggcagagtgggagtggcagtgcctctgcctgtctccctggccgtggcaggtcctttgtcacgtatggaccaggagaggtgagtatgattgtggtagtggtgggggcagtggctgaggacccctctctttgctgggctggggcagagcttgaatggagaggggctgccttgtgcctgggaagggaggaccaggtgtcgctggtaccttccaggtcctgaatgcttgttctgtgcctagcccctgctgaggctgcggacgttacaaaccaggatgtgttttgaggctcaggacacctctgaggacttgctgctgttacccccatttaaaagacgaggactctgaagatctgaggtgcatagagtgtagggattaaaagtagttctggctgaattttaaatcctggttccaccatttttgagctctctgatcttgggacccttaatgtatttgctctgtgcctcagtttccccatctgtaaatgagaatgaaagagtaatcccacatccattggttgaaaacttcaataagattatgcatagcaggccgggtgtggtggctcacaccagtaatcccagcactttgggaggccaaggcaggtggatcacttgaggtcaggattttgagaccagcctggtcaacatggtgaaaccccatctctactaaaagtacaacaattagctggacataatggcgcgcgcctgtgatcccagctacttgggaggctgagcaggagaatcctttgaattcaggaggtggaggttgcagtgagccaagatcacgccactgaactccagtctggaccacagagtgagactgtctcacaaaaaaaaaaaaaaagattatgcacagcacctgcagcacagccccagggatgatttttaaaagtgaatccagggccaggtgtggtggctcatgcctgtaatcccagcacttggggaggctgagacaggattacctgacatcaggagtcagtgaccagcctggccaatatggtgaaaccccatctctactaaaaagaaatcccagattctgccatgccacagtgtccaagtcagtcacctgctcgcagtcggccctcaggccctgtggctcctgtttctgctgacttgtccagcctcacagtctggggaggccttggggtccccagcctgcgctgggacaggggtattattccgtcagcccttctgtggaacaagtagggaaggagtgatgtgacctccgtggctctcctgggacacaggttagtcctgtgggtgacctcactttagagagggctggccagctgtgccggaattaggaagtgggtacagctggacaaaaggtggctggagccagctctacagaagccacacctgctcatgagaagggtatccttgtgagtacaggggaaatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggccaggccgtgattgcccagggtgcatactgtggctggtgctctgccacctgctgtttctgtcctcagggtaggacacaaggagggcaagtagggctagtcagtgagaggcacaggtgatgcgtgttctagggcttgagatcagctgcttccatttcagtaattgtctttggaggtacgttgtttgctcaagcaacctcccttcaagatagtgcctttttctttctctctctctcttttttttgggggggggaggcagagttttactcttgtcgcccaggctggagcacagtggtgtgatctcggctcactgcaacctcggcctcctggattcaagcgattctcatgcctcagcctcccgagtagctgggattacacgtgtgtgccaccacgccctgctaatttttgtatttttagtaaagatagggtttccccatgttggccaggctggtctcgatctcctgacctcaggtgatccgctcgcctggcctcccaaagtgctgggactataggcatgagccaccgtgctggctgatagtgccattttttaaaatccctatttacccagtggaaaacctgagacccggaaaggtcattcacactcccagaagtgatggttggtccagaattcaggtccaagtgtgagacttcaacatttacattccttattttttcttcttccttttttttattttaatcaaattattacttcaaaatgtatcacactcatcagtttgaaacagttaagcagtacaaatgggaatatgagagaaagtcactctcccacccgccctcttgagaggcaatagccttgttttgcatccttctgagtactctattcacataagatgtatctgaatatgcatgtaattcttttgtgaaagtgcatttggagatcactgttttacacctgccttttacatcttaatattatgctttggagatcagttgacatcagcatgcatcgatttgcatcctatttttcacagctgcatagtgtttcgttgtgtgtgcctaattttttaaaacaggtgcctgtgcatagatttcatgtttccatcttatgctgttagaaaaagtgctgcagtaaagatcctaacagacaagtctctttgcaaatataggaaacttttctgtggaataagcttctggcacggaagccccggggtaaagggtattttgataaatattgtgaaatgtcttcccagaaggtggcctggttttcacttccagcatacatctgtgagaggtcctgcttcccacactcccccagcactgtgtagctcaggacccttgttttttgctgttactatttgtgaaaaatggtatctcaaccacaccggaagttttaaatgtagataaatgtcttatgtgccatttatatttctctacagtaaagtatatattcatagccttagcttatttttaaattatgttccttcattgtttggggagtggggggtagacttgcatgagtatgttataggctaagggaattaactgataagttaatatatgtacatcttgcaaatgcacttcttagttttttactcttttaagtatgagcttgctcacttgctctctgtatctcacttaaactttatgtgagtgtattaatctttcattatttagcttctgaatttatatttcttcaatctccattcctttttttttttttccttgaaatggagactcgctctgtcacccaggctggagtgcagtggcacgatctcggctcactgcaacctctgcatcccgggttcaagcaattctcctgcctcagcctcccgatttgctgggactacagacatgtgccaccacgctcggctaatttttgtattttttagtagagaccattttggtcaggcaggtctcgagctcctgaactcaatcaatctacctgccttggcctcccaaagtgctgggattactggtgtgaaccactgtgcctggccctcgttcttttttttatatgaaaatatttcaaatatgtaaaaattaatataacagacctccatgtgataatcagccagatttatcaagtgtgaaccttatcccatattagatattttttcctttaagaaataaaatattacaagtatagaactaaagatgtgctactatgatctattctattcttccccacattcctttttttttttttttttttgagatggagtctcactctgttgcccaggctggagtgcagtggcgcgatctcggctcactgcaatctctgcctcccagatccaagtgattttcctgcctcagcctcctgaatagctgggattacagacgcacgccatcacgcctgtctaatttttgtatttttagtagagacggggtttcaccatgttggccaggctggtctcaaactcctgacctcatgatccgcccaccgtggcctcccaaagtgctgggattataggcgtgagccaccgcgcctggcctattctttcatcatacacataagcacgcactatttacaaatatacacaaacttagtgctgttttctgattcatcctttatctatttgcaacactttaaaaagttaatgttatgttttcacattgatcccagttgacctgtatggattaatttcttcagttgacatggctatataatattcagttgcgtgaatgtagcacagcttatgtagccatccctctcctgacgatagttaagttgtttccattttttgctattgtaacactgctaataaacatgcttgaatggggtgtcccgtacaagggagggttactcggggctgtgcccggaaatgcaatcgccagattgtaaggtatgcacgtgttcagcctgactacatattgtgaagtgctcttctaagcctttgtatcaactggtactcccaccagcaatgtgtgagaaactatatttggttttaatctgtattccctggttactagtgagcctgagcatcttttctgtctattaggtgtttgaatttaatctgtgaattgcctttttgtgttcttttttattcctttgattgttttggtggtggttatgataaaatgcacaagcacaaggttctgttgacctgttgaccgtcttaaccctttttatgtgtatagttcagtggcattaagtacatttagaatgtgctaccatcccgccatccagctccagaaatcttttcgtctcgtcaaactgaaacatcctcctgctagtcaatggctcatctccttttcccctcagtccttggcagccgccattctgctttctgtgtctatgagtttgactgcttttgagtacctcctataagtggaatgatacagtatttgtccttttgtaactggcttatttcactttgcatagtgtcttcaaggttgatccatgttgcagtgtatgtcagaatttctttttttcttttcttttcttttctttttttttttttctgagacagagtttcgctcttgctgcccaggctggagtgtaatggcgcgatctcagctcaccacaacctctgcctcctgggttcaagcgattctcctgcctcagcttcccgagtagctgggattacacgcatgcaccaccacacccggctaattttgtattttcagtagatacagggtgtctccatgttggtcaggctggtctcgaactcccaacctcaggtgatctgcgtgcctcgacctcccaatgtgctgggattaaaggtgtgagccattcacccggccgtctttggattttatacagcaaaactccataatatttcctttacatgaatttcctttctttttcaggctgaataatattccattgtacgcatagatcacattttgttcattcatccattgatggatacttgggttgcttcccgattagctattgtgaataatgctgctatgaacatgggtgtacaaatatcgctttgatattctggtttcagttctttggggtatataccccgaagcacagttgtgggatcctatcttgtctcttgttttctctttgcttccatgttttttctcattgtttcgtgggaatactgatattatatattcaagtatttgttgattacatgcactgtacctgacttgtttaaagcctgatgtcttgagtactgtgcacccctgtgcctggctgagtagtggaggaactttgaaagggtctgttctggagagggggtgctgctctggagaggcggtgctgctttggagatggattaatcaggaacttgggtgctgattctaggaggtactgcatctagaaagatgggaggtggggagtgcaacttccccaattttgcctttaacttcagatccttggggtgggtgcattgcttctcctgggatggaggggtgccggggagcccctgaccaggacctggagcaggtccacacaggcactggatttgtcctttactttgggcccaggctgcactcttgattccacctcctcacactggcttcagctttctcaccctcagaatggaattcaaagcctctgcccctcccaggcagacaccaaggtatgattttcaagtggttggtgtcttgtgactggcagctgataaacgggtgatacagtgtttctatacaggagtctgcagtgccaggctgcaggggcggacgggagggggtcgtggtgggtagcctgtggagcctgagggtgggaacagagagacttcttttgctgtaggtggaagcctgtctggctcctttccctcaaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctgcagcgtccagccagggactgtgccgcaggggccagaagatatctgacctactgtcactgcctcttccactctgttccacctgcactggagcgatgctatccgatgaacagatccatttattaattcaacacgtttgtattgagagcctgctgggtgccgggcactattgtcaacatgggtaatacagcagcaagcaaaacaagagaaacatctttgcaagcaggggagggggcctgcagtgttgggtgtgtggagttgttgctgggaagtagagaagctgagtaagagctggacaaagaggccaggcacagtggctcacccctgtaatcccagcactttgggaggccgagtttggcagatcacttgaggtcaggagttcgagaccagcctggacaacatggggaaaccccgttcctactaaaaatacaaaaattagctgggtatggtggtgcatgcctgaaatcccagctacttgggaggctgaggcacgagaattgcttgaacccgggaggtggaggttacagtgagccaagatcacacaccattgtaccccagcctgaatgacaaagcaagactttgtctccaaaaaaaaaaaaaaaaaaaaaaaatagagaaaaggaaagctggatgaagagagatagccaagcccatgtctacggaaaagcattcttgactgagtgaacgaaagtacaaagcctcagaggagggagcatgcctaggtagccccctagacctggtgaggctggtgcgtggggcagcctccatggagaggagttgggcaaggagggaggaggtgctggccagtagagcacgtgtgtctctgtgcgtcagagcaaggacccgggctctccccgtaagtgagaagagtccatggaggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaagttcggcagggaagccagaggagtccgcagcccgggagacctggcctacagcggagagagtcagtccatgccagtggtgggatgtggctgcaaaaaatggtcggattcatggaagtctggtgtccatctggcaggcgttagtggtcccacgaatacagctgtgtgccttgaacacatactgcagagcttccagagagcaccagggctgtgggggctagagactgtgtctcgtgcggaagcgtggctgaggaggggcttgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtgggggttctggctgaagtagccagaattccagtgccagctccgctcctcacgagctgtacaacctgggccggttactgacccctttcccaccttagttccctggctctacaatggaggtaattatcgtgttgaactcacagggtcgagatcatatttaatacttgcacagcccttagaagcatctagcacagtggtcctcagcatttggaaatgtctggaaacattctgtcacacctggggagtgggatttccttctggtgtctagtgggtagaggccagagatgctgctaagcgtcccacaatacacaggacagaccccgcaacaatgaactgtctggcccccaaagttagtggggcagagattgcaggatcctgattccttttcttccttttttttttttttttttttgcccctggctatgagtaagagatcctggtttcgcacaaagtgaacgtgcagtacattgtttcagttgttaattcgccatgcaatacatcgttagtcacgtattattgtttgtcaaatgtgtataaaacatctgccacattcttggcagtttaatagaatctagagatataaagaagttcctgaccacagagttcatagcctcacaggcaagataggaaaacacagaattatataatacgaaattacattatatcatagagcatattctatagtaagttactccgattggcttttggtattaaaatgtcttcagtttcagaggtcccaggatagtgggcaatatttgaaagccagtaaatataaaataaaatatattacctgtgtgaaagagaatttttcaggcacaataatattttaaagagtttatttgtgtaagaagtgaattgggaaacagaaaaccgaaagaggtttagtggcccaatgacagtttcagaggcaggtgtttggagagtgaatgtaaaagcaaaatgaagaatttatttgatttaattggttgcaattacaaaattgctttgtttggtttaccttgttggaagtttcctagtcacataaccatatgttagttggctacttatgattggctgaagttttatttgtgtcaaacagaagcatttaccataaataaccccagttaagatttgattatgctgtcttttaagcaaggttaaggctgttgttaaggcctcattggttttgtttggtaaggaatttttcaggcctggtctccaaattttgctttaacaattccttgcttctggttattctctcagcaagctgatagtgtgactagatgacacagtattactctctgttaccaccaccaatgtagtcactgggacaaagagtcaggtagatgttgttgtcatcatcagtaggtaggttggggatgagaattccatggccacagttagcagttacatagtcagtgttgctttcctcaagttgaatgatcctcatggtaactgtttgatatttgagcagctgttggaaatcatttagaacccttgagagaatacaaggcaccaggggggtaaacataataattataaggagaataatagccaaggattgaaaaattcctctgagcaaagattcccaggagccaagacttaaccagctgagtgaatcaatggagaaggcagtgcccatctaatgaaaaacccatgtgtgttctttaaggtattttaagttttcggtaatacctgatttgttaacataaaaatgacactttttttttttgagatcgagtcttactctgtcgcccaggctggagtgtagtggcgcaatctcagctcactgtaaactccacctcccaggttcaagtgattctcctgcctcaacctcctgagtagctgggactacaggtgtgtaccaccacacccagctaatttttgtgtttttagtagagatgggatttcaccatgttggccatgctggtcttgaactcctgacctcaggtgatccacctgcctcagcctcccaaagtgctgggattacaggtgtgagccaccgtgcctggccaacaccttctttttttttttttttttttgagatacagtctcactctgtcttgcccaggctggagtgtgcagtggtgtgatcttggctcactgcagcctctacctcctgggttcaagtgattctcctgtctcagcctcctgagtagctgggaatacaggcgtgtgccaccacacccggctaattttgtatttttagtagagacagggtttcacccaggctggtctcagactcttgacctcaggtgatccacctctctcagcctcccaaagtgctgggattataggcgtgagccatgcgctcggccagcaacacctttctaccaattagggaacaaggtctccctttttgagcagttaaagtagcaagaagtcttctattgtacagtactactgaggccaattcattcatcccagattgtactgcttaagataattcgaagtgtcaattaaactttttcagaagttggtaaaatattaattgatttttttcaattcactcaactgagagaaacgggctcttacagaagtatgaaatccagaaccccttcgtaagactgtgtctgggatattatgattctcttttgtgaggggtcactttatgtacaaatgactctaaggatttgtatggcaattgaagagtcatatctagtcattttaggtagaagatagcccacaccacagatccagactggctaggtagaacacctttacatactttgttgctgcataaaatgaataattcggtgttatcgatagaaagggtcaaagtgcatcctattacccacgagttgggggtgatacgaatgtcatggttattctccgtcacatctgcgtctgcacagcgccacgttgaatggttatggtttcaattggagtaggaacaaaaaacatttctatgaatttgataaaatgactgtatgccatcatcaattagggatgattggttttctttttatttgagacggagtcttgctgtgtcactcaggctggagtcagtggtgcaatcttggctcactgcaacctctgcttcccgggttcatgcgattctcctgcctcagcctcccaagtagctgggactacaggcaccaccaccacgcccagctatttttttgtatttttagtagagacagggtttcaccgtgttagccaggatggtctcgatctcctgacctcgtgatccaccctcctcggccccccaaagggatgactggttttctttccaaatatgacctgagcattgatctgtccaataagcaagactgttatgtacattatgtagtggatctattgaggcatacgattttcctgtagcatttccattgaaccaatgtctagttctagtaagttctctgatgatatggttgaggctttcatggtcatgttcagattttatatatgtgtctcatgtaggaatctagtcttcataatctgtgtcaaacctaagaatttgagtacagagggattctggaacactgcccagatttggcccagttccattcatgttttctgtgcgtagagataagttaccattaatgacatcaatcgtagttgtaggccatccctttgcctctgttgcttcttccaagagctacactggttgatcataaatatcagccaactgccaagggaaggataccaacccttttcataacgccattttcctgaattgctcactcaagtgtgtatgggagcaggttctaatattagttgtgattctttccatttatctagaggattacgtagccaccaattgctttgcttagtagtgaggatggcttcatgttgagcagtagatcttagaggatattcagtgtggataatgaaattccctaacgaaaataaaagtgtgaaccttttgtgctaaaacaaaacaaaaacaagtctgagtcaatagaagggggccacatggagtcttgtttcattgtcttgggaaagctgtgtctatttcatgatatcatctacttttatggaaggatttctcttgggtatccttaattttgtttttatattattattattattattgagacggagtttctctcttgttgcccaggctgcagtgcagtggcacgatcttggctcactgcaacctccacctcccgggttcaagtaattctcctgcctcatcctcctgagtaactgagattacaggaatctgccaccacacctggctaatttttgtatttttagtagagatggggtttcaccacgttggccaggctggtctcaaactcctgaccttaggcgatccaaccaccttggcctccttaagtgctgggattacaggcatgagccaccacacccggcctgttatccttaattttaaatcacatgtggattgacaagtccaaaactctaagagagctctcattagctgtgaaacatgtacccaaggttcaagatcctgacattttgctacggtgagaatagtaactgaaactggtgtagtgtctttcaatggggctcaagggcagttgttctctgctgtcttttacaaaagagctagtctcggccgggcacagtgacttgcgcctgtaatggtagcactttgggaagctgaggcgggcggatcacctgaggtcaggagtttgagaccatcctggccaacatggtgaaaccccatctctactaaaaatacaaaaattagccgggcatggtgacacatgcctgtaatcccagctacttggaaggctgaggcaggagaatcgcttaaacccatgaggtagaggttgcagtgtgccgagattgtgccaccgcactccagcctgggtgacacagcgagactgtatcaaaaaaaaaaaaaaaagatccagtttccagattccaggtcacgtaaggtgggatcatcaataggcaggtcacagaaagcctccttcacctggtgggatatactttggcatcatacatcaagaccttgcagtattgagtcacatcagagccaccagtagagtggataaatgaagttctgttatgaaaggcacaagtcgttcagtatttattttgtgaagggccactttatgtgttcccctaggggctgatgttcttgccataaaggtcggtgataattcttttggccaaggtaattcagttgactctgttaatttagctaattttagttttgtgataccatttctgcattcagcctttccagaagagagagtgatgagggcaatgatagtgccgtcaggtctgtaaactcttatttggtggataacctgtcaaataaagcgaattgccctagcactagagacctcctcggcaggtaggtgggatttcatctttctggagcctgagcatctccaaagaagagctgccgcatggagcttccctgactggtgacctccaccctcttctctccagagctctttgacccagaggaatctgcaggaatggagggagttggccaaagtagggagatttttactcagaccatatccaggtgagcacacaacagccttttgggcttgggctgatgcgtgcatttctgtctgtacatgcgtgcctggaagtgtgcagatgagtgtgtgagagagggtaatggccatgcatccttgcatagacaagaacatggggtgcacttctgcatgtgcacagcccctccccaacccgggcctgtggtgctgtcctgcccctagcccagagctggcctctgttggctttgagaccctagctttgcactgtggctttgctcggccttagagaccagctgctcccctgctgtggtctctcatagtggagactgatccctggccacccattcagctgcctgagggccctgggaccagtgttcatccccccacctcccaaaacagaggtgtgtaggggttccctgcctggagtcccaaccctgcaggatggagaaaatgggcaccagttactgtgacccattccggctccatatggatttggtttgacaacaaagctccctctgtgtgttcccaagccccttacataaccaggggctgtgggcagaggaggaaaggaggaggaggtggagatggggaccaggagacaccaggatgggatggctggaaaggacacagggaccgggaggagagggcaggagacgagggccagagaggaggagagggtgggagcaggagggggaagtgctggtcttgacctcccagttctgcctcctgcttcctggggaggggagggtggagtccagccaccgacttctgcttgtggatgctttgtcttcttttctttggacctttcccaccagtcctggataggctgaggaggggccgtgggacctgtctggggtgaggtgaggtcaggtattgggctggacttgggaggctgttccttggccgcagcctgtaactgaataaatgccattaaaaggggaatccatttcctccctcactcctggcttccattgccttcccccaggccccagccctggttccagaatccctctgaccactcctcttgtgctcaggagggcagaataactgcagcctttccctgtgccctgccaggctggtcccgggccccctcccagcccactcatccagggatgcagctctggccttggcccacccccatcagagggcctgtggccctgatcaccgcactccccactctgtgaccagacgttctctcctgagcatcgctgaccctgcagctgtccaaatagagcaagaagcgaatgttctctttggggcacagctggactggcagccctgcagggtcaggtgagctgccagtcctgggtgtgttctcgggggtgggggtgggaggatcacgtcctgggctgagatcccttcagctcctcctgggcaggaggaaacagccatgcaggggcggccaggaggactgggtggcgggtggttctgggctctcccagcttcggttggggctgggaccctgggggacatgctctcctgggtgttcccaggctctgtgtctggcctgtgcctcagtgtgtgggttttctggcaccaggcttccttgggaagagcctctggttgtgcaccagccctgagggtggggctcatcccaggctgcaggggactgagggccgagctcttccaccttgaggacaaggatggttcctcagggctgggaggaggaggaggcgctggccaggaccttagattacgcagggcttggtgttggggcctcacagatgatggagaagccagagttcaggcacttggcatgacccctggcatcgccttcagttgatttagtgtctctgccctggggtattccatgggaccctgggctggcttctgtgtgcagaggtgggtgtgggccatagcccagacctgttgaaccagttgtaggctctggaatcctctgtccccaggcagtcaccaggccttgacaggcgggaatctgtccctctcatcacccccccagttatgggtgcagatgaccctgaaattgctaaagcctcagggcttgagcccagaaagtgtgagcaggctggcggggcagctggaggaaggccttgcaggttcctggatttgggtgccgggtgggctgagaggacagtccctgtcactgggactgggcacaggtgcagagaggctgagacaggcccagaggacagtgagtgtgtgttgtgtgggtgccaggccagggagtgccctccatggggcagcaggctctgcagtaccctcggccaaatggccacaggctgccctgggacactctccaggcctgctggggacacacctgtggggctcataggcgtggctgggtctcctctcaggtgccagaatctttctgggagctgagcctggctgggcagagggcgaggagcccaggattcccctttccgtgactttggaggaacgaggttcctgagggctggcacagccactccctgccccttagaggctctgggctgcctggtgacagcttcggggacctgcaagctgacagagtctccaggagccagagctggggtgggaggaacccactgggcctgagggaggtagagcagcagcagcagcagctgagcccagcccccggccagccctgaggaatgggggaaaagagtgccctggcttgggggggccctcaagccccggaagctgtatgtgggcatggggggcgggggcagagaggaggaggactgagaagtgggtgtatttgggcaggtgtgtgtgtgtgaccaagcttgcgggcgcctgagtatggactagtgtgtttgtgctggaggagcctgtgtaggttactgacatgggagggccggtgtgagctgcagggaccggagagctgctggaaggggctgtctatgccttcaggctctgagtgtggatgcagctgggcctgttcaggcagattcaccagaggggctactgcgcagagcctgggccctggacacctagaagggcccctcctcccctcgtcttccctccctcatggcccacctttactctgagggggtgggcttcctgcgggggacaaactggagagggactctcttgccgccttctctgttcctggggacaggctgctgcagggtggagggcttgcttttcctgcccaccctcatctttgccgagtcctcgtctgggggccctgccccactctcccttcccaatgcagggccctctcctctggcgagcctgccttgatactccccggctcaacccctttaaccctgctggctcctaatgggactaatgggatttcaggtgtggacccttggaccctccgctgcacagttccagaaacttgttcatcaagtgccaggctgaccatggtgtccgtctcagtgcccagcagttgttctggtgatgggaggtgggagtacaaggtctgccgagtgaggcagaggaaaggggtttctgagcccagatctccggtgctccaagacactcaaaaccagagctgagagcctgaattcagaggctgtactgtggggcagggctggaatttgtggcacctgtgtagggactccagggctgaacgttgcctttgctgtccctgcttggggattttggggtactgggtttggatagagtgtgtcatctgcagaggcagcactgttctggaagtggactctgctcaggtgtggcgggcctgcctgtggggtcaccatggacaggaggctggtgtctggtcaggctgagggatccgtgtgccagcccttctgggaaggctgaatggggcggaactggtcagggcctggcaccaactccaggatgtgctacacccagacagacagatggagagccacctccctaggggcctcctccccctccccttctgcatgccaccacaccccagcagcatctcctgaggctgggccatgggtgaatctgagtcgagggcaggacagagtgggagtggcagtgcctctgcctgtctccctggccgtggcaggtcctttgtcacatatgggccaggagaggtgagtgtgattgtggtagtggtgggggcagtggctgaggacccctctctttgctgggctgggacagagcttgaatggagaggggccgccttgtgcctgggaagggaggaccaggtgtcgctggcaccttccacgtcctgagtgcttgttctgtgcccagcccctgctgaggctgcggacattaaataccaggatatgttttgagactcaggacacctctgaggacttgctgctgttatccacatttaaaagacgaggactctgaggctctgagaggttaagtacctggtccaggtcacctggtcagtttctttcttttttttttttgagatggagtcttgctctgttgcccaggctggagtgcagtggcgatctcggctcactgcgagctctgcctcccgggttcacaccattctcctgcctcagcctcccgagtaggggactacaggcgcccaccaccacacccggctaattttttttatttttagtagagacagggtttcactgtgttagccaggatggtctcgatctcctgacctcatgatcctcccacctcggcctcctaaagtgctgggatgacaggcatgagccaccgcgcctgacccacctggtgagtttctgagctccagacaactcatcccaaatttcatgggtgcatagagtatagagattaaaagtagttctggctgaattttaaatcctggttccactattttcgacctgtctgattttggaacatttaatgtattccttctgtgcctcagttttcttctgtgtaaatgagaatgaaagagtactcccccatcaatttgttgaaaacttcagtaagattatgccaggagctgcagcacagccccagggatgatttaaaagtgaattcaggacagggcgtggtggctcacgcctgtaatttcagcactttgggaggctgaggtgggaggatcccttgagcccaggagtttgaggccaccctagacaacatagtaagaccttgtctcaaaaaaaaaaagcgaatccagtggtgtcactctttgttatcaatgccctccagtgacattcatgacacccaaacttagaatctgagcttttagggtggcctgtgacatctataccacgtgtccccgtggcctccctggcaccccctttccttcctggctgtctgccaccatatggaactttctgtgccttgcacccagccagctcagagtcttgggcacttctctcagtctggaaccttctcttgcctaccccatcttcccatggctgcccttcatgtaggcctccggtttatagccggctcctcagagacatggttctatccccccagtggccaagggctggtggccctcactctctgcccctgtgccctgtgttagtggtcctgtggttgtcattgccccgtcatctccaccatttcctgtttgccgtgtgtctgtgccccccaaggatgaatgccatgagtccagcatgtcaccctgtttctgtcctgccacagtgctcgagtcagtgccctccctgcttgcattcggcccacaggccttgtggctcctgtttctgctgacctgtccagcctcacagtctggggaggccttggggtccccagcctgtgctgggacaggggtattattccagtagcccttctgtggaacaagtagggaaggagtgatgtgacctctgtggctctcctgggacacaggttagtcctgtgggtgacctcactttagagagggctggccagctgtgccggaattaggaagtgggtacagctggacaaaaggtggctggagccagctctgcagaagccacacctgctcatgagaagggtatccttgtgagtacaggggaaatggcatggagaaagacaaacaccggtgggtggctctgccagcttcccctggggtgcttctggcaacgcccaggtctgtgcacatccagatctttgcactgcgctgttttgacttggagaggagaggaggaagttagctgctctgaatggtgttgctgctaatctctacagcactttcctgtaaattaggaacggtaacacacacacccctcccccaccccgctggagaagccctgcaccagagcatacagtttggcaagtaggaggagggctggagcccagcctcacttgctgccctggccaggccgtgattgcccagggtgcatactgtggctggtgctctgccactgctgtttctgtcctcagggtaggacacaaggagggcaagtagggccagtcagcgagaggcgcaggtgacgcgtgttctagggtctgagatcagctgcttccatttcagtaattgtctttggagctacattgtctgctcatacaacttcccttccagatagtgccattttaaaaatcccatttacccaaaagaaaacctgacacctggaaaggtcgtttgcactcacacaagtgatggttggtccagaattcacatccaagtgtgagatttcaatattttttttcttcctcctttttttaaatcaaattttatttgaaagggtatcacagtcaccagtttgaaaaaggtaagcaggccaggtgtggtggctcacacctttaatctttgcattttgggaggcagaggcaggcgtgtcagttgagcccaggagtttgagaccagcctgttcaacgtggtgagaccccatctctccaacatttacaaaactagctggtcatggtggtatgtgcgtgtggtcgcagccactggggaggctgaggtgggagggttgcttcagcctggtgggtggctgcagtgagctgagattgggcctttggtcttcagtctgggctacagagcaagactctgtctcaaaaaaaaaaaaaaaattataaaggtaagcagtacaaatgggaatatgagcataagtcactctcattccagacctctgacccccaggacttttctcttgagaggccatagcctttgttttgcatccttctgagtaaacctattcgtgtacagacatatctgggtatgcatgtaactgttttgtgaaagtgcatttggagatatggatatcgttgttttcacccatcctaagttttgatgctatggatactatgttttggagattagacgataccagcacgcataggtttgcagcctctttttcacagctccatagtgtttccttgtctgtgagcagatttcaagttgtttccatcttaacccctagaaaaagtgctgttgaagatcctgacagacaagtctgtagaaacataggaaactttgtagaataaagttctggccatgggccaaattccctctgagaggtagctctagtttttcttcctagtacatctatgagagctcaggtccctcgtgttttgctgttatgatgaatgaaatatgctgtctccatcacgctggaatttgtagatgtagatgaccatagtttcttatttgccattcatttctttacattaaggtaaatattcatgtcctttggctatttttattttatttcttttttcttttcttttttaagacagagtctcgctctctctcccaggctggagtgaagtggcttaatcctggctcactgcaacctccacctcctgggttcaagcgattcttctgcctcagcctcctaagtagctgggattacaggcacctgccaccatgcctggctaatttttatatttttagtagaggtgggggttttaccatgttggccaggctggtctcgaactcatgacctcaaatgatccatccaccttggccttccagaatgctgggataataggtgtgagccactgcgcctggccctttgcctatttttaaattaggtttcttgtttttttttttttttttttttctgatttacgtgagcacatcataggctcagtgaatttactgatatgttaggtataggttgcaaatgtactttagtttttcagtgtctttttttttttttttttttttgagacggatttttgttcttgttgcccaggctggagtgcagtgcaatgacacgatcttggctcactgcagcctccacctccttgggttcaggcaattctccagcctcagcctcttgagcagctgggatcacaggcgcctgccaccatgcctggctaatttttgtatttttagtagagacggggtttcaccatgttggccaggttggtctcgaactcgtgacctcaggtgatccacccgcctcagtctcccacagtgctgggattacaggcgtgagccaccgctccccggctcagttgtcttttaagtgtttcatttgtcttctctctactcctccctctctctcttgcacttgctgtctgtctcacttaaattttatgtaggtgaatatattcatctttccttgtttagcttctcaatttatatttcttcactatctctattaatatgaaaatatctcatctatataaatattaatgtaacagagttgcatgtgataatctgccaggttgaacaaatgggaatattatctctcatatgacgttagatttttttcctttaagaaataaaatattgcaagtagagaaccaaagacatgcccctgtgacctcttttattcttccccatctccccagaatataattatcacttaaagttgggtgtcaacctgtatttcattctttcatcatacacacaagcacacactgtttatacacataaataatgttgtttttggacgcatactttgtttttgcaacacctttaaacataagtttttacttttattattttatttaagataggatcttgctctgtcacccaggctggagtatagtggcgcgatcatagctcgctgcaacctctcatctcctgggctcaagtgatcctcccaccttagttagcctcctgaggaactgggataatcacagtcataagccaccaagcccagctaagttgtttattttatttttttattttttaaataaagatgaaatcttgctatgttatccaggctggtctcaaactcttgggctcaagcaatcctcctgccttggcctcccaaagtgctgggattacaggcatgactttaaaaagttaacattatgggccaggcgcggtggctcacgcctgtaatcccagcacactgggaggccgaggcgggtgaatcacgaggtcaggagatcgagaccattctggctaacgcagtgaaaccccgtctctgctaaaaatacaaaaaaaaaaaaaaaattagctgggcgcggtggggggcgcctgtagtcccagctacttgggaggctgaggcaggagaatagcgtgaacccgggaggcagagctgcagtgagctgagatcacgccactgcactccagcctgggtgacagagcaagactctgtctcaaaaaaaaaaaaagttaacattatgtcttcaagtttatcccaattgacccatatggattgatttcttcagtttacatggctatatagtattcaggtagcacagtgtatatagccatggctgtactgatgatagtgtttccagtttgtttgtttttttttgctattgcagcactgcctaataaatatcctggagtgggttgtacttatatacttcaaaatggaattaccagattgtaaaatatgcacatattcagcctcactagatactgtgaagtgctcttctaagcctttgtgtcagtttgtacttctgccagcaatgtggaaatgagatttggttttaatatgtattccctggtcacgagtgagcctcagcatcttttcatatgtccaccaagtgtttgggtttaatctgtgaattgcctttttgtgttctttgctttttttttttttttttttatttctttgattgttttggtggttgttatggtaaaatgcacaagcacgaggttgtatttaccatcttaactctttctgtgtgtatagtgcagtggcattaagcactttcagaatgtgctaccgtgctaccatcccaccatccatctcccgaactctcttcatcttgccaaactgaaacatcccacccactagtcaagaactcctcatttccgcctccccccagcccttggcagccaccattctgctttctgtgtctgtgagcttgactactttaagtatctattctaaatggaatgatacaggacttgtctttttgggactggcttatttcacttcgcgtagtaccttcaaggttgatccatactggtagcagaatttcctttctttttcaggctgaataatattccattgtatgcgtagaccacattttgtggatccgttcatccactgatggacgcttgggggttgcttccacattagctattgcaaagtcaataatgctgctgtgaccacgggtgtacagatatctctttgacatcctggtctcaaatattttggggatatacccagaagtgcagttgcttgatcctatcctgtcccttgcttttccctttgcttccttgttttttttttttctttttgttttatgggagtgctgatatattcaagtatttgttgattgcatgcattatgcctgacttgctcaaagcatgatgtcttgagcacttagcaaccttgtgcctgctgagtggtggaacagttctgaaaaggtctgttctggagtgggggtgctgtttcggagagcgatgaatcaggggcttgggtgctgactttaggaggtgcggctcttggaaagacagagtgtgacttccccagtgtggtctccttccttttcctcaccacttctcctacctaaccccaagaatgagtccttgagtctgtctcagtaggtggatctgcattcagtgcagggcagagcctgggtggcagtgcctctccttgcctccctggctgctacaaggtcctgtgtagcatctggtgtggacccagcagccaggaggagagctgagtgtgattggggtcgtggtggggccagtggcagtggatctctctctttgttgggctgggccagcgcttgaattgagaggggctgccatgtgtctggggagggcagaacccagcgtcactgacaccctccagatacagagttcttgctctgtgtttggcccatacctaatgttgtgaagtggaaatactggggtgtgttttgaggctcagaacacctgtgataacttggtcgtgtgtgtgtgtgtgtgtgtgtgtgtgtgtgtgtgtatgtgtgtgtatgtgtatatataaaattattttccttaacaccactgacctgaaggcagttacacgtaatttacaaatgaggaatctgaggctttgagattgtcaaggtcacctgaccagtgactgcagaggctggattggcctgtgggcctgagtccgtaccccttttcactggctcctcctggaggccacatgtaccttgcgcttcctggggcttggtcctggggtttcatctcaggttgacccccgttaggaggaagtaagtaggaaggaaggagatttcctgggtattagggtgtcctcaagcctgcagctctcctgggactgcacagagtttactgtcggacatcagttctgatatggtgcagcagacatggagctggtaagtggttaagatcagtcggacatgacaacctccagttctgcagaagccacttcatttgcctggggataaagcaggtccttgtgagctcatcgacatgcatttggcagaaagtgcgctggctctgccagctcccagtgtgagcttctagcaagccccttgtgccttagatgcccaggtcttttcagaataagcctggcttgttttaacttgatgcaacttgctgctcacagtcatcttattgtttgctgatgaattcagacctccattcatttaaatatttgtcagttatctaccatgtgtcaggcattaaatttagtgctggagatactatgggacataagaagtccctgcttgctgggagtgcgtggtctaattggtacttgggacagtgtggtttaactgccacaaagttaataaagcagcatgatgtgacagagctggatgtgggggagtgaggaagcttctctggactgggtggtctgaaccccatgcagggaggaaactgtggctgggaggagaggaggccggaagagaggtctgggcttgggtcccaaccactgattccagatctctcaacatttgtaacacgaccaactcctgttcttttttttttttttttttgagacaggctagagtgcagggggacgatcatagcttactgcagcctcgatctcctggactcagggggtcctcctgtctcagcctcccaagtatctaggactacaggtgtgtgccaccacacccggctaattttatttttatttttatagagacggggcagagtctgcagtcacatgccttgcaagtagcagagacagggtttagtctcggtagccagtgcctagggcacaggtcttggccagaggagagaaggctcaggtgaaccagtttcatctgacctgcttgctaactcaaacatggctgcccaactgcgtgggctggcaaggtatgtgaggtgggtagctgggtggcccgccccttgcaggcactggggcaggatatcagggggtccagaagaggttgggtttaggcagagtagaggtgattgtgtgggccgggggagcaatgtcaccttgaatgtgtttccatacccagggcccagatggctcaggaggagggggatggggacggggagagtgaggtctttttgactttgatgtgctttgactgcacatcagagtcaaacgagtcagaataagcgggacccctccacaggcatctcagccctcctaatttagcctttctgaagtggagccttgggagccgatgaagcttaataaactctcctggtgcttccagtaggcacttgagggtggacaccaccgtcttcaggtcataggaagtgtgagctagcaggaatcctggagattttctagcccaacagtgtccggtcaaaatagaatgggagccagaaatacaagccacatgtaattttaaattacttttaaaacatttaaatttagccacggttttaaaaagtaaaaataggtgaaattcgttttaatattttaacccaatatagccaaaatcttggcatttcaacatgggatgagcataaaataatgaaggtgatattttattctttttttggggtactaaatctttgaaatccggtgtgtattttccacttaaagcacatgtcagtgtggactggccccattgcaaatactcagtggcctgggactggggtgaccaagtgggatgtggtggggctggtgcagtccaccattctcacagcaggcatctggggtcaggggaggcagggcactggctgtgctggaagcaggggattggctgtgctggtgggaagccagattccagccccagacactggtacctttggctttagatccttggggtgggtgcattgcttctcctgggagggaggagcgcccgggagcccctgaccaggacctggggcaggtccacacaggccctggatttctcctgtatcctgggcctggccctgctctcttgactcccacctcgtcacagtggcttcagctttttcaccctgagaagggaattcaaagcctctgcccctctcaggcaggcaccaggatatgattttcttttttcttttctttttgtttgagacaggatctgacttggtctggagtgtagtagcctgatctcagctcactgcagcctccacctcccgggctcaagtgatcctcccacctcagcctctgaagtaattgggattacaagcacatgccaccatgcccggctaatttttgtattttttatagagatggggtttcaccatgatgcccaggctgttcttgaactcctgagctcaagcaatctgccctcctcggcctctcaaagtgctgggattactggcatgaggcacggggccctgccctgggtatgattttcaagtggttggtgtcttgtgactggcagctgataaacgggtgatacaatgtttctgtacaggagtctgcagtgccaggctgcaggggcggatggtggggggtgggtgggtagcctgtggagcccgagggtgggaacagagagtcttcttttgctgtaggtggaagcctgtctggctcctttccctctaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctacagcgtccagccaggggctgtgccacaggggccagaagatatctgacctactgtcactgcctcttccactctgttccacctgcactggggcaatgccatctgatgaacagatccatttattaattcaacacgtttgtattgagagcctgctgggtgccgggcactattgtcaacatgggtgatacagcagcaagcaaaacaagagaaacatctttgcaagcaggggagggggcctgcagtgttgggtgtgtggagttgttgctgggaagtagagaagctgagtaaagagctggacggagagagatagccaggcccatgtctacagaaaagcattctagactgagtgagcataaatcgcaaaggcccagaggagggagcatgcctagctagccccctagacctggtgaggctggtgtgggttgggcagtgatacggtttggctgtgtccccacccaaatctcatattgaattgtagctcccataattcccatgtgtcatgggagagacctggtgggagataattgaatcatggtggtgttctcccccaagttgttctcctggtagtaagtgtcaggtgagccgatggttttatgaggggtttcccttttcacgtggctgtccttctttcttgcctgctgccatgtaagatatactttttttcttctgccatgattgtcaggcctccccagccacgtggaactgtgagtccattaaacttctttttctttattaatttcccagtctcgtgcatgtctttatcagcagcacgaaaacagactaacgcaggcagcctgtgttgggaggagttggcaaggagggaggaggtgctggccagtagagcacatgtgtctctgtgcatcagagcaaggacccgggctctccccgtgagtgagaagagtccatggggttttggggctgaggaggagttttacagatgaccggtctgttcttggcacttgcaattagcggaccgtctgtatccgagtgttgatcgggtggattctaaccctgtgggagaactccccagcccgtagcctgcgctcactgtacctggcagttgtattaatgacgtcaaatgcacagtccagcttgagtcccctctagaacgtgggcagcggacactaagccgagaggaatcgctgtgggttggcagacactgtggagactgactcctggacaggctgtggaatgtgtggaagcaggtacagcccaggcccgcgctgaggttcggcagggaagccagaggagtccgcagcccgggagacctggcctacagcggagagagtcagtccatgccagtggtgggatgtggctgcaaaaaatggtcggattcatggaagtctggtgtccagctggcaggcattagtggtcccatgaatacagctgtgtgccttgaacacgtactgcagagcttccagagagcaccagggctgtgggggctagagactgtgtctcgtgcggaagcgtggctgagaaggggctcgacaggctcttcgtcactgtgcggagccttcgaaggacttggatgtgcttgagaccccttcccctaattgctgtgtagggcaggggtggacatcccggggatcgtggagtctagggagccagtctgcacgggatggttttagaagccgtaggatgtggaggttctggctgaaggagccagaattccagtgccagctccactcctcacgagctgtacaacctgggccggttactgacccctttcccaccttagttccctggctctacaatggaggtaattatcgtgttgaactcacagggtcgagatcatatttaacactttcacagcccttagaagtgtctagcacagtggtcctcagcatttggaaatgtctggaaacactttgtcacacctgagaagagggatttcctactggtgtctagtaggtagaggccagagatggctgctaaacaccccataatacacaagacagaccccgcaacagtgaactctctggcccctccaagtcagtggtgcagagattgagagatcctggtttcgcgttttgagcgtgcagtacatttcagttgttagtggaacatgcaatacatctttattcacatgttattacttatttgtcagatgtttgtaaaacatctgctacattcttggcagtttaatagaatctggagatacaaagaagttcctgaccacagaggtcatttaggcaagctaggaaagcacagaatgatataacacaaagttacattgtaccataaagcatattctatagtacacttaactctggtgggctcttggtataaaaatgtctccaatctcagaggtcatgggatagtgggcaagacatgaaaaccttgtataatataaaattttgttacctctaagtgctgaaattaaggtataaacaacgtctcatgggaaccaaaacatcagtcatttggaagtataagtcaagccttcgtaggagaggaaccatttcagcccgatattaccagagtgggatggtcccagcgagcgggatgtggagggttaggatgttatcttagtctgttttgtgctgccattaccaccaagtaggtaatttataaggagcagaagtttatttggctcacagttctggaggctcggatgtccaagatctagaggacacatccggtgagggtcttcttgctgcattgtctcatggtggatggaagaagggcaaggtggagagagagagcaggaaggggcctaattgtccttttataaggaacccactcctgtaataatggcattaaacccattcatgagaacagagcccttgacccattcatgagaacagagccctcatggcctactcttatgagaccccacctcacaacattgttaacatttaggatcaagtttctagcacatgaactttgagggacacattcaaaccatagcattctgccccagtccccaaaatggatgtccttgtcacatgtagaatacatttgcttcttacctataatcccaaattcttatttgtttcagcaccacattaaaagtccaaagtccacagtctcatctaagtcagctgtgggtaaaactcaaggtatggttcatcctgaatcaaattcccctccagtcatgggctgtgaaatcaagcaagttgtctgcttccaaagtacagtgatgggacaggcataggacagatattccattccaaaagggagagataggcaagaagaaaggggcaactggtccagacaactccagaacccagcagggggaacaataccaaatcccaacttgacaataatcttctttgactccatgtcctgccttccagacacactcgggtagggacttgggcccccaaggcctccggcagccctgcttccctggccttgctgggctcattccatgcagcagctctcaccggttggagtctcatgcttgcagctcccccaggttgctgttgcacactggtagctctgcagttctggggtgtcaggatggccttactcccacagctccactaggcttcctggggactctcagcagctcagactccacagttctgctgggcattgccctacaggggctccctggtggtggctctgaccctgcaaccagtctctgcctgggtcccgagtctgtccgcaatatcctttgaaatctagttggagggagccaggcccatagcccctgcattctgtactctggtggcattaggaccatgtgggatgccaccaagactcaccacttgcaccttctagaatggtaggtcaagctgcacctgggcccatttaagccatggctggggaggcagaggagcactgtgcccaaatgtgggagcagagacttgaggtggccctggacagtgagccacaggtcctgagggctcccaagacctggcttttgacatagttccttccctcagattttggcactgccggagctgtgatcacaggtcatctctgcagtacctttgggatcattcttattttcttgatgaatagcctctggcttcattcttattgtactaatctccttatcaaactgtggctctggccaatactaatctccttatcaagtggtccatactaatattcttattaaactatcaaacggtaacatgcctgcacccttgctttcctctcctgaaagttctttcattctctactacagggccggtctcagaatccttccagtctctaagttctgtttcgcttttcattataaatttctttctttctttccttctttttttttttttttttttttgagatggagtctcactctgttgcccaggctggagttcagtggcacgatctcagtttactgcaacttctgtctcctgggttcaaaccattctcctgccttagcctccctaatagctgggatttcaggtgtgtgccaccacacccagctaatttttttgtatttttagtagagatggggtttcatcatgtcagccaggctggtctcgaactcctgacctcaaatgatccgcccgcctcagcctcccaaagtgctaggattacagacgtgagctactgcgcccaaccctgcttttatttataagtttcatctttaaattatttatttcttctcaagttttacagtatacagttaaaataagtcatacagcaaccaaaatgctttgctgcttaggtatttcttccaccaaatagcctagtttatcactcttaagttctgcctgctatacagtttgaggacctggacacaatgtagccacattctttgctgctttgtaacaaggatgactgttatgccagtttccagtaccttaatcttcagatatatctgagacctcatcagaatggccttcacgatcgatatttctaccaccattctgatcacaaccacttagtctaagaagtttcagactttccctacagatcttctaatcccgctttattgcctgcctgcctccctccctcccttccttctttcctctctgctctctctctcttttcttcctttccctcccctcccctgctttcctctcccctctccacttcttggcaccaattttctgtcttagtccattttgtgctgctgtaacagaataccacagattgagtatattataatgaatagaattttatttggctcatggttctggaggctgggaagtccaagatcaaggggctgctctggcaagggccttcttgctgcatcatcccatggtggagagtggaatggcaagacagatcaagaggggacctaactggccttttataaggaacccagttccacagtaatggcattaacccatccatgagagcagagccccatgatctaaacaccttttattaggccctgcttatactgttgcactggggatcaagttgcagcacttggacttcgggcaacacattcaaaccatagcaggcaccttaataaaggtggaaaagggatgtggcagctacagtgggagggaaaaggtggctcccttagtgtgcttgggaggagggtaagagatgcgtttgcagttctcatggccgcagactgaaggggcctggttacctaagggaccttggcttcatgtaaggagtgcggagtgagtgaagcaagagggtgatttgatccatatcatttcttagaaggataccatgttggcagtttcgaagaaggggcatgagtgaggaaacagttgtggtgaagagaccagttaggaagcctgtaacttggggtgggatctggaaccaggctgtggctccggaagaggagctggagggctgcactgtgaagtatttctcagagtctagacaatgtgaccttcacactggggctgagttttgtaaaatccgacatccccagtttcacctatgatgccaggcctgtggtaaggagctttgcaagcatttgctagaatatgagcaaatggaggtagaactgataatatttagtaaccatggggggatgaaagagggaggtgttgggagactgggttgataatatgggggttgggagtgaggagagagtccagctttgaacatcttcttccatttgaggaatttaagatcatccagctagaaaattagaaatactaggatggagtgtggaagagaaattagtgctgaaaataaagagctcgaatcatcagtgtatgaatagtagttaaacctctgaaaatgagtgaacttgtcccctgaaaatgtgtggcaggggagaagcgaggttcaaggacagtgcccccgagaatgccagcatttaaagggtggaccctcggtggctcacgcctgtaatcccagcactttgggaggctgaggtgggcggatcgcttgaggtcaggagtttgaaaccagcttggccaacatggtgaaaccccgtctctactaaacatacaaaaattagccaggcatggtggtgggtgcctgtatcccagctactagggaggcacaagaatcacttgaacctacaaggcagaggttccagtgggttcgtgccacttcactccagcctgggtgacagagggagactccctctcagaaaaaaaaaaagaagaagaagaaaaaaaaaaaggtgggccccggcagcagagcctactgtcccggaggcaggaggaaaacctgaagggaatcttgaccttgacctagaagccaaggaggaggcatggccaacaacatcaaaggcctctgagcagcgcagtgaagactgacaatagacctttcttaagtttggcaattagaaggtcattggcctcagcaagagcaatttcagaataaaaacaagagtggagggagtggcataggggtcgggggacagagtaggaagtgagggtgtagtagaggggaagaagtttgatcactgagggaaggagggagatgcaggggtagcttgaggaggagatagagcagagagaggtttgctgtttattttaggaagaggagacttgagcatgtttataagtcagagaatagagaaggagaggtgggagacacagggaaaagaggagtcattgattgggaactattctgggaaggtgaggtggatctggtgtctaggtggaaggatttgggggaaagaggggaggtaggagagtctagacgtagacagcaggcagacaggggctccaggttttccctacagaactgaggacagtgatggccgagcgtggtggctcatgcctgcaatcccagcactttgggatgccaaggtaggtggatcacttgaggccaggagttggacaccagcatgggcaacatggagaaaccccatctctactaaaaatacaaaaattagccgggcatggtgacacatgcctgtagtcccagctactcaggaggctgaggcacgagaatcatttgaacctgggaggtggaggttgccgtaagctgatggcaccactgcactttagcctgggcgatagagcaagactgtctgaaaaaaaaaaaaaaaaaagaagaagaagaagaactgaggacagtaagagtaagtggtcgcttgtgatcacagaaccagcaagtaaaccgcgagcttctgcccctctggtcttcccagaccccttccccggaacattaagccatatcgcttttatgggtccaggggctctgaggggctgggcatcatactgtgcccctgggggcatatctagttctgccccacttggttgggcgggtacctgctgagtactcactgtgtgttaggctgtgaatgctggggcagcaggaggcatggtttctgcctccactgggccttatttcttcaccttgtcccccagttctgcccttgggtaagttctgtggcagaactgaccagctcccttcggccagggacatcttggttcctggcagagcaccaagaagagcagattgtcttcctacccgggggcacctttgcccagcaggtcgggtgagctggcctcttggtgagaggctggtccccttggacatgagtggattcgatgcctgctttcccacccaggtactctactgtggctttgctcctgccctttatgctcagagctagaccagcaatgtgggggagctgctggggaaaggcgccatgttgtcttgaggtagcagccagccccggaagccctggaatgcctggggccactgagcaatcctcaccctcagccccacaaggggagggcgtggctcgtgaaattcctgattgggtatagcccagcaagccccaagactcgcccagtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttccctggaaggcagccctggaggatacctgtgtatctgtctttcacaaaaggtgaaatgagctctttgtagtgtttcccgcccaggctgcattttagaatcacagaggaggtacggcgctgatttgttttactattccctattcatgcctgggccccacccctaaccaattaaataaacatctcggagagtggggcctagactttatatgtttaagctcctcaggtcattgcattgtgcagccaatgctgtgacctatgaatacaaaggaagatgaaacgcaccctggtcatgcaaggaagatggagagagggagcagggagggtgagagaggctgcagttcgtaaggtcctgaaatgttagagctggagggatcctggttcggagcactgcaactcaaaagagtagttctagccatgcagcaggccccattagggagctggttagaatgcaaatccccgcctgccctgcaccccatctggcaccctctgagtcacggcgtgcacatcgaggtttgagaagtgtgctttcaggtcacccacagatcatccagaccagtggttctcaaccttggctgcactttagaatcacccagcgggcttcagcgaattccagtgctgggctagatgaattaacccagaatttctaggtgttgggacccaaatactcatttaaaaaattttttttgtttaagtacttcaggtgagtctcttcttcagccataatcaagaatatcaggcttgaccagtgcttctcaaacttggacagatagatgaatcgccagggtatcgtgtttaaatgcagattctgattttataggtctggaaggggccaaagaatccacttgtctgggctctgggatgcccatgggactgatctggccttttttgagcagtgggaataggctgacttctcagtttgacagcaaggaaactgcaggtcagagagggaggtgtgatcgtccacggtaaccaacctgatatgcattcagtactttctgatgtactctactgtgtgccaagcagcatgctacatgtgggactagagctgcgaacaggacagacccaattccaaccctcacagagcttatatcccaactggggagacagacagaaagaaaacaagtaactaagctgatgacagatgggaaaagctatgaaggcgaggagggccatgtgtagggaacgactcagagattgctgtggggtgaggggtaggtaaggcacgcccctttcagaagagctgtcgggggagttactaggacaatacctttaactggggactcctgctgattacaaactgatcacttttctttactggacaggactaggcttcatcccctctggggtttggggatggtgcttctgactctcctgaggcagtctgaccctggtccctgcctggctgtctcctctgactcaagactctgatccttcagtgtttgtgggttcagagcagagcctgggaatgagcccgctggggagcaggacactgactccaccataggacagggctcaggatcattggttaatggtttgtaaaatggaccaggcctcatccagatgctgtccccagcccctatgaaaacatggaaagtttccactggtgcacaaacactagtgcttgcctccctttcctgatcaaccgtcggactcacatgggctgtttgtgaaaatgcctgtcccaggccatactcaggctgaccaaggtggtctggtctccagggaagggccgtgaaatgtatttttaggaagtggtccaaaggactcttctgatccagatcatcaggaagcatggcgtggatggaagaaactggcacttggcatctggtgcctctgtgtggctgtagaagctacagaaatgtcttctgcagtgactgcagcgtggccctggctgagctggtgcttgtgaggaagcctctgcttgtgtgcaggggtgaacagcagctcaccccttcccatgcacagtcctcaccttactaccttcacccttactggaagcatctcttgacttctctttggccagccagaccctcccagctccctgtgctccccatttaaacaccttccctccctgagcttagcccatggctgggtggggaggcgtgagcactgtttgcatttggtcagggcctagaagggatcaaggaggcctcatgaggaccatgtcatagccccaccctcactccccacccctgacctgagcaaacctgtttggctggattgatgatggagaggcaggcagtgaccagaccaagagacgccttggatggtggagaataggtgaccctctgttgggtaaaagaggactcaagccctcacacagtgagttggctaactttttgtctcaacagtgggcgggggtagctgtctgcctcctggagctggcccttcctgggtcaaaatgcagaaggagatggtgagaagaaccacaccagagaggctggagtaggccagcctggcttgggaccgagtcccgagtccctggctggaccctcggttttcccttccgtggcagggctcacctggatccttaatgccgcccttggaggagttaggaggatcctggatgagaaaactcaccctcaggatgattgccccagggagcagcttcctgctttctggtggaagggaggggcagacagtgggtgtgtcctgctccagtgtctaggcaggagagtttgtgaagctgaccggacacctgtggctcttatttcctaggtggcccgaggcagccgggatgacagctctccccaggaatcctgctgcctgctgagaaacatggtcagcaagtcccgtgagtgtcatccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcactagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcgcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagca

SEQ ID NO: 2116 - DNA, 8461 bp, Homo sapiens
atccgagggctcccccaccctggaggacaggcctcagaagccgtcttcagcaggatcctgggacctctgggggctgtggagggacagacagggagccaggggcccttctcttcatcttgaaggacagtgggtacaatcagggtcaagccctcagccagggccaggagagggccagagactgcttctgttgagttaggggtcggagggactcagaagggggcaggtgggaaggtggacgggggttgtacctgcctgttgctgcctctagctcctctctgcatgtgtcctgcaggctggaagctcctggccatgttggctctggtcctggtcgtcatggtgtggtattccatctcccgggaagacaggtacatcgagctgtgagttcaccttccatgtccttccagtggctcttgtcagggacagggcttagggatggagcatcatggagcgggggacctagtagggcaggaaggttccaagagccggcacatgacctcatcccttcagctgctggtacggagtgtttccatgagggtgggtgggggtagggcctgggatgtctcactgggccctcacccagggagtgcaggggcaggaagacctggatcctcaaggacttgggttccaagtggaacttaacttgagatgattcctccccggcaccttgggaccttcatgccgtgggagaaggcttaggctgcctggaacatgggtccctgggtctgactggggcttctgcctcctgtccttttttctctccagtttttattttcccatcccagagaagaaggagccgtgcctccagggtgaggcagagagcaaggcctctaagctctttggcaagtaagtacttaaggatgaggagggtagagcagggcatggagcgagctgggattgagggtttcacagtgtggggagtagatggaaagagcagctgtgttggtggacatgggttaggtgaagccagggagggaagagaaggccttataatattagtcatgggcctaaccctacttctggcatcaagattaattctgttctcatccccacccggctttcacctctgtgcagctactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaaggcagccagcgctctgaggagcagtggagggagggcaggcagccttcagaatgctatctgtcacatcagtccctccgcctggtactttttgtagaggatctgctcctccgggtgctagccatcaccagctcctccatccccaagaacatccagaggtaaggcggcactccgactccagtctgggcaccttctcctatttcctgccccctgcccgctccccccactccccacccccccgctctgtgaaacagtcatggactggtaccatcccagccaattctcatggtagcctagcctgggcatctgggtgcagagtgggcagaggctgctcgagggtattgcaacagtggggcaggcgtttctcattgatacacccccccatgccttccctccactcctctgccctcttctgtgctctgcgcagtctcctcctcttacaaagcccagggctgtaaagtcagcatgaccctaagcaggaccacggggtgatgcctgcttcatggggaccaggggctgagggggcctaggaagtggtcctgagatgggcccaggcagatccagggcagcgagcctgggttagagtgtggggtgacatagaccactcctctttctatggcagcctcaggtgccgccgctgtgtggtcgtggggaacgggcaccggctgcggaacagctcactgggagatgccatcaacaagtacgatgtggtcatcaggtgtgtgtgactgtctcttcctactgttgtttgggaactggatgtccgagccagggactgtagacaggcccaggaggcctctagtgatgggaatcctcctcccaacccccagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtaagttgggggacagactgggggctgaggcctggcggtggggacgctgcccgagtcaggacctcacgctccttgatgtccgcctggcagtcctaaagaggctgtgaggggacagcatgaaccgggctcccggaagtcagcgccttaggctgccctccaagggtggtgctctgataagctgccccagcaactgggtataaaagcctgcaggcgtcaggtggcagcagccacaggcacccatgctccaggcgtgtctgtgacaggaaagctttccgagtaggtgtttgcctgtgaggaactcgggagctgagcaaccctccagcagccatctccaggctgagggcaggttagagcaatgaggcctgtgtccaaacagatggtccccagaaagagttcactacatcactttgccatccggtcacaggctgaactgtcccatctggcatttttgtcaagtgtttagacagcctaaaactttagtcccttctacctgtgtggatgttcttggaagtggtccatggtttagaccctccactctatacacctggtcacctggcctcccgagggggtgcctttcctcctctctttccctggtcctctcctggtctcccatctgtggcacagacttcacctccctttcctctcaccttgtgctcctgaaggcctctgccatcgcttggaccccctcgcctcgctgaggaccactgggttggatttgagaaacagggcttcacccgcttctgtctctctcttctgaccccatcctcctaggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggtgatgatgggaagtcaggcctgagggctaggatcctgggcgggaagtaggagggatgatcctatgggcttaggaagccctggaaggatcccataacagaggcggcggtttgcattttccctccaggaacacacctgtcattaaagttgctgctgcaaaggggagtgcacactttagagaaccaaggggcatttactaagtggggagggatggggatggcctggatcaggtttaggggctggtgtgagaggatggttttggcaggcgctggtcagaatttgtcaactggggagctgctggaacagtcagtggtctgatctgtggaacaacttgagccatgcagagttactgttagatacttcatctgtgatcttatcttgaaacactagtctgaacgagttataagagttggagctaaacagtttgtcttgcatgtcatgatttggtatggtgtgtcaattcagggagtcaatgtagttttgcaagttatgggtttttgttttgttttaaagatagcgtctcactctgccacccaggattgggtgcagtggtgcaatcatagcccactgtaacctcaaacttccaggctcaggtgatccttctgcctcagcctcctgagtagctgtgagactacaggtatgcaccatcacgcctggctaatttttaaatttttttgtagagatgggggtctcactgtgttgcccaggctggtcctgaactcctggcctcaagtgatcctcgtgtctcagcctcccaaaatgccgggattacaggtgtaaggcactgtgtctgaccacaagttatgtgttatgtgtttcttctttttaacctgatgtccttgagccatagcaagttatggttttgagtgcagtgccctggtggtcttcagctggtgggctttaacccactttgtagcttcccaagtacttccacccatatcttggagcccctcggggaggccgtgtgggatggtgagagacaggcactagcagacacaggtatggcgcttggctgtgctgtgtactgtgtggggcttggcaggtcaactgctcagatccttgtttttcttgcctgtgtggtgggataatatccataatgaccttttaaggctgttgtaggagtttgaaaaataataatgatgtaaaatacctattctggagaccggtacacagggcctgccctttaaatatttgccagattttgaataaatgattttattgtttactgaacatttcctgttattccatgttctgtgttgaatggctgcttttgtgactgctcaatgccaggccccgagtcttcttgcttggcgaggaagttgtgctccttgctctaagggacctcagtctagcagagtaagaatgcaggttgcactgtggggtgataaaattccacaatggagagttgttcccaatgccgtggaatctcagaggaggggcagacatctgctgagagatgtctgggaggctccccagaggaggtggtgctggagccgggcctggaaggatcaggcagagagctggggaaaggcattccatttggccagagcaggcggctcctccagcactgaactgtttccagtacaagtggcgttgaagggcaacaaggagtttcatgccattcataggattacagatggagaggaggctggagagggagatgagagagggcgaggacctgaacccagctcctggcagtgggaagggaaaaggaggagatggactcaacattgtgttggttgtttttttttttgagatggagtcttgctctgtcacccaggctggagtgcagtggggtgatcttggctcactgcaacctctgcctcccaggttcaagtgattctcctgcctcagcctcccaagtagctgggattacaggcatgtaccaccacacctggctaatttttgtatttttacgaaaatacaaaacacaggagtgctggtctcgaactcctgaccttaggtgatctacccgcctcggcctcccaaagtgctgggattacaggtgtgagccactgcgcctggcctgtattagctttctgttgctccctaactaataccacaagtttagccggctaaaacaatacccatgtactggctcatggtcctgtagatcagaacagcagggtgtggctggttctctgtttagggtgtcacaaggctggactcggtgtgtcaaccagacagttctcatctggaagcttgggggaaaattttgcttccaggctcattcttgtggttgaaataattcggttcctgcgattgtagaactgaggtccccatttccttgctggctgtcagctggaggctgggggccacgctcagctcttggaggtggcccacatttcttgaccgtacagcctccatcttcaagccagcgacggcacaatagatcctttctgtgcttcaaatctctgacctccgtttctgatcttgacacccggatttaaaggttcaggtaattaggtcaagctcagcaggacagcctctccttttgtgttcaactgtgccatataaagtaacgtcacgtaatcgcatcatattcacgggctccccacacgcgcaagggaggagattacatgagggttagcgtcactggggttctcttacgattctgccttatatattttacaggtggaattgagagatttctgaccaattctgggtttctagcttggacagccggtagggggcggggggtggtaacatatttaactaatagagagagagtgcaaggaagaggaggaatttggtgagtgtaaggagactgtgtccaggcagagctggctagaaggccatggaagtgtggctcagcccagctggatgagataacacactggtggtgaaagcaacaagggtggaaaagaaggtccagccagggagtggaagatgagaagacaggagagctcagagagggagaaagctggcatgtcgacaggcctgatgaggtccaggaaaggctcccaaatgggtatgggcagctgaaattgtgtgcaaagcaggttgctgaagcggaggaaggcggggctggagaagtgagaatatcaggctgcccgtcactgtggatgaattaggcatgagcaactgaggttctcagagcagccagtaaggtgaatgggaaaggtactgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcgcacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggtaagtgcctggcttgtgagcatggtgggccagggcgtggacgggcagacagtcagaggggcactgggtgagtgggagcagtgctgagacccagaggtggctcccgcagtcagaactggaaccgaggcacctggactccctggccagcatcctccatgttcagccacatgggctttgtcttccttccaagagccagcctggggaagggagctcccaagaagtgtggggccattgggaggggcagggagactttcctggggacagagaggtccctgggagtccctcagtttatttccttggctgtctccacaggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaagca

SEQ ID NO: 2117 - DNA, 169800 bp, Homo sapiens
agacgaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaaggtaggagagcccgaggcaaccgggcctgcggtgggaggcggtggctagcacggggtgggagggggcctgggaagcggagttcgccgcagccccagtgcactgcccgagagggaggtgctgcagggtcttagggtctgcatctctcctcgccctcctcctttcccctttttccagttgggggacaaagccttgtgctagctgataatacttccgcgaggattgaatattgtggctcctttctcgtgaatgtccaaataaaactccccttttactgtattgctgtaaactagtgtttagttgcttctaaacctccgatctttcatttttttaaggagttttctgggtggtgcaggcattgtgctttccagggtggggatttagggcttttctttattgggttggggatttgtgcgctgatcatcagcttgtcttccttaggtagcacgctggcactcttgggtgtgtgtgattggcctgtgacagctgtctcagcagtggcttgtgtgtgccacaagtgccagctgtgaacttggctttaggggcgtttttagaagcgtgtctttgtatgtttgtacttgaaggtctttgtcatggcatgcgcttttgtgtcctatggaatgttaatgcagtctgtgaatggaacttctgaggaccgaaaggttccatatgccaacacctatagaattcctgctttaaataatttagttgttatatatctctctggcgaatcctggttgtgtgtgtgtgtgtgtgtgtgtgtgtgtgaacggttatggaaaagcctgtaaagcaaacaatacaatacacaattatacacaggcatcgttcattgggcttcatgagaaatttaacatatacagaatataagctgcgtagcatatttcttttaaaaattacatatttgagcatatattttgtctgggctcaaaagcccccttcctcccttcaatgaagtcttcttttatggattatattatttttagagataattgttagcagtcatacttggacaaaaattgtattacaggtaactgtttttcctctcttcctttctcttctcctcacataaacaaaggaaaccaggttagtgatttattatcaatgaagggccataccgcagagatgcagtgatagaagctcaacacaagtttgttaaatgaatatatatataaaaactagcttcatatttctaaaatatagttgactttcctataagctccctctatttaagatcaaggtttaaatgcttgtatatagccaggtaaatttttactttcgaatctataaatggtgggaaaggggaatcagggtatctttagaagtccaaagcctacacttgtgcaatctgaggggctgagcaagctctatgcatctacggaagtagtggaggtgaagtgtgtgcccctccaaaagcattgaagatctgattagatgtcttacttgtctgttacctcacaatttttattgcctgcccccagaaatgtctttcctgaatatatgtgaagcagtcctacaaaacatggtttactttggacatacacatttcataatagaggatttatttaaattgcttgcagttgtagttgatgtggcaaaatacaattctagtttctttgtgtgtttctttatctttcagaattctatgtatggggtaaaaacctgtttaaggtgaatttttgttgtaaaagattatcttcttttagaatttagccctttttccagtaagatataaatctatgagacttgtaaggcaaggtgtgtttgctgcaacattagctatacaatataaaaatgctgacattgggagcctggggcgagaggattgcttgacaccaggagttcaagaccaacctgggcaacatagtgagactctacaaaaaattaaataaaaaaaaaaaatagcagggcatggtggtgtgcgcctgtatgtagtcctagctactcaggagtctgaggtgggaggatcacttgagcccaggagttcgaggctgcagtgagctatcatcatgctactgcactccagcctgggcaacagaatgagatcctgtttcagaaaacaaacaaacaaaaaaaaacccctggaaataacttttaaagacaacacgaagggaatcattttctaagttatataaatatgatggaatattttaaagccattaagattatgaagactgataggaatatgaaaaatagtgtgaaaagggcattatcaaaaatagtatgtacattatttcatttgtataaacgtgtgctttcagattagaactgaaaaactctggattataattttattcagcaaacgtatattgaatccctattttatacctagaggtggtgacagtgtctgctctcaagttgctcactgtttagtgggagagacagactctgggtgataagtacaaagagggatgagctgcagtaggatttgggggatattcttccacgttttgttaaagtgttttaaatactactatgtcattttatagaattactaagaaagctttactattgatattaatgcaccataatataatgcctttcaaatagttattcatacatatttgcttaatgaatgaacagaatgattaatgagtcattaataagtgttactttcctagcacggttgtaatttaataacattaatctagaattctcttaatgtgaaatccatattgctggcatcagaaacaactttaaatgatcattttccaaagtttatctgagacttcattctgcaaatgtctcatttgttcactggacttaagtattgtatttgataatctagttttgcaaaccacaacttacaaatctttttgggggtaatttattgataaacagttccattggaaaattccctttctgtatctaaaccttataaatgatcactttttaaacagtttgtcatgtatgcagtataatatatagtatactgtataaaatgttttatactaccccaaatctgtaataatgggttaataaattatgatatgtaaaataattctacaaagactttttgagtgtggaaaatgcccacaaataatgccaggttaaaaagaaaaaagttaccaggaaaaggtatatgtacatatttaaatatgaagacacctgaaaaaaagcaccaagatgtaaatcgtggctatctctgggtggtggcttataggcaattttaattttctttatacttttagtattttccaaattcttgatacaatgtatctcttttatgaccagaaaagaatattcaaatgccattttttttttttttgagacagcctgtctcccaggctggagtgcagtggcaggatcttggctcactgcagcctccacctcccaggttcaagcgattctcctgcctcagcctcccaagtagctgggattacaggcatttaccaccacgcctggctaatttttgtatttttagtagagatggggtttcaccatgttggccaggctggtctcgaactcctgccgttaagtgatctgcctgcctcgacctcccaaagtgctgggattacaggcatgagccactgcactcagcctcaaatgccattttttaaaaaacataaaggcttatcaaatacattatattaaacacatgttatagtgtatgaccattatccagaacaggaaaatgaggcacagaataactaggtttcctattttagcgtaggcctggaattgtaattgctatttcagtgcagagtgtataatatagttgggattatattgttagacattttatagatttcctttctgtttttgttgtgcttattctttccttgctgttagttcgtattgctatgggcatgctcttactcctcatctgcctcttttcctaatttgctgttttagatttgctacgactaaggaacccagaactgaggttgacagaatactatgtaaaaagaaaaaacaacaacaacaaagaccttaggcggggtgtgatggctcactcctgtaatcccaacactgggaggctgaggtgggaggatcgcttgagcccagaggttctagatcagcctgggcaatgtagtgagaccccatctctaaaaagaaaaaagtataaaaaacaaaacaggtggggcgcagtggctcacacctgtaatccaagcactttaggaggttgaggtgggtggatcatctgaggtcaggagtttgagaccagcctggccaacatggcaaaaccccgtctctactaaaaaatacaaaaaaattagccaggcgtggtggcaggtactaatcccagctactggggaggtggaggcaggagaatcacttgaacccaggaggtggaggttgcagtgaaccgaggttgtgccactgtactccagcctgggtgacagagcaagactctgtctcaaaaaacaaaacaaaacaaaaacagaggccagtgtagcctgcccagtgggctttagggcagtttagtttttctgctgcttgttggttgttttggtttactgttgggtcctcagctatttcctcagtattgatgttgcaagaagcatgaccctgggagatgtgagacattactgcattatgtattaagtaaatattttcagagctgggctagctccctctgcagtgttttgacgaggatggcactacataggttgtccttgtgttgaaccaaactattttaactccattttaaatgacttcatttttttccaagtataattattcatggcacgtaaaggaagtattgtaatttaagtgaacagaattaaatagaggacagttgtatatttaatataaaattattactcatgtaaatttgcattaggtatactttttaaagttattcagtattttatataatgggcattatttgctgaataattataaaaaactactgtctattatattcagtaatttgtaattacatgacttttgtttaacaaacattttcagtgtgaagagtagttccaattgtgtacaaaaaaaaggatggtgctccatgcaagctgtatattgattattgatagcaggacttttcagttactgtttccactgtgatagacaaagctggttatggtgtaaaactgttctttgcatatttcagatactttgttccacagctaagaaagtgttttcccttcctgttttaagcattctagtttttcatacttagatgtggcagagcttacttagcattccgagtagatgcagcagtttgatagcttcatcaacatttattgcagcaatagtgcagtgcctgtgacttaaaactaattcataaccttcaggctttttttttttttgagacgagatctcgctgtgttgtccaggctggagtggcagcctgccttgacctcctgagctcaagtgatcctcctgcctcaacctcctgagcacctgggactacagatgtgcaccaccacacctggctaattgttaaaatttttttgtagagatgggatttcaccatgttgcccaggctggtcttgaactcctgggctcaagcaatcctcctgccttaacctcccaaagtgccgagattataggggtgacccactgcacccagcttaggctttgtcggaatgaagcaaaacatggtgtttagagagagaatgtggaggaaggaacgtgatgccctgtcagtgaaactgaaagttgaatgatagctcatggaaagaggaagtgaaaaaggtaggatacatccaagtgattgaaatatgacaagaatggaacaaaaattttttcaaacaaaaacatctcttattttataaataaaaaggttcatagtaaaagctaaactatgtctacaaaatatctattataggctactgaatattgaaatgtaaatgaatttcttctaatatagctagaaaaggttatggtaaattgctaaacaataagggacattatttatattcatttcttagtaagattccactaaaattaagattagtcactttatgtaattgcttaacatccatttaaaaactataatttggaaaagctacggaatttttcaaaacttatttataaaagtggtttggtgtctggggtgtgtgtgtgtgtgtgcgtgtgtgtgtgtgtgtgtgtgctggagagagggagaaagagaatttataatactgctatctggtctggtagaaatggcactaggactttggagacatttatgtgttcatttgttcaaccaacatttttgaatgcctacgactgcagctatgaacttttacttagcaagcatttttttttccccccgagatggagtctcactctgtcacccaggctggagtgcagtggcacgatctcggctcactgcaacctccacctcctgggttctagctattctcctgcctcagcctcccgagtagctgggactacaggcgcccaccaccacacccggctaggtttttatttttagtagagacagggtttcaccatattggccaggctggtctcaaactcctgaccttgtgatccgtccaccttggcctcccaaagtgctgggattacaggcgtgagcaaccgcgcccggccgcaaacatttatttaaatgatcacaaattctgtgccttattgtctgttggaataatcttatgatgtgtacctcaacaggtgttttgaaggataaatgaaataatggttgggagctttttgagttctctaggtgctagatataaagaagctataattttttttaattgaggtgaaattcataagcaaaattaaccatctttaagtgaacttaacacagtggcttaacacaatcttatgcaactactgcttctgtctacttcccaaacatctttccatctcaaaatataaccctgtgcccattaagcagatattcttcattgcttcttccctctagccactaacaatcaccaacgcactctctggatttaccagttgtagatatttaatatgaaaggaatcatataatatgtgaccctttgtgtctggcttctttcacttagtatgttttcaaggttcatccattttgctgcatatatcagtacttcattcctttttatggctgaataatattccattgtatgtatataccataatttgtccaatgataggcatttgggttgtttctgtcttttggctattgtgaatagtgctgctgtgaacatttgtatggatgtatttgagtacctgttttcatttctcttgggtatatacctagtagtagaactgagcaaggtcatatggtagttatatttcaactttttgaggaactgccaaactgtttccatagtgactgtaccattttaccttcccatcagcaatgtataggacattccaattttcccataacctcattaacagttgtgttttctgttttttttgtttgtttgttttgtttttttgtttttttaatactcatccttgtgggtattaagtggtttctaattgtggttttggtttgtattttcctaatgaataatgatattgagtatcatcttttaatgcactttttggccacttgtagatttctttttttttttttttttttttttgagatggagttttgctcttgtctcccaggcttgagtgcaatggcgcaacctcagctcactgcaacctccacctcctgggttcaagtgattctcctgcctcagcctccctagtagatgggattacaggcatccaccaccatgcccgattaatttttttgtatttttagcagagatggggtttcaccatgttggccaggctggtcttgaactcctgacctcaggtgatctgcccgcctcagcctccccagtagctgtgattacaggcatccaccaccatgcccgattaatttttttgtatttttagcagaaatgggatttcaccatgttggccaggctggtcttgaactcctgacctcaggtgatctgcccacctcggcctcccaaagtgctgggattacaggcctgagccactgcgcctagcccatttgtagatcttctttagagaaatgtctattaatatcccttgcccattttttaattgggttgttaccaacttcttttatctaatattaattatatatgtatataaaatatatatatatcctttccgtatgtgtggagagagagagaacgtgtgcactcaagcaccagagaggaatgggtagaaatacgtatccccagtgggattatcttccatatatatatatttttaggctttttgggctttgccaaaatttaaattgttgcttcctttgagtgataggttcttggtgagttgataacagcatgatgctgaagcttgatttctttgttggccagtgagtcattccattccatgagcagctgttttacaagtgcatgcagttggttaaaggggcacctgttggatttttggcttgatcattgccagtccatttacactgtgagaaaaaagtaacttagtgttcaaaaatgaaaagacctgtcattttaaacatgggggatctgtagctacttcactagtatgagatgtctttgttgtcatattgacaccccttttattttttgtcttagtcatcaccaaactgtaacttacaacacttagtgcccttctaggtacattgcataaagctttggttgatttttgcatgggtttaacagtattcaaaagtgttcaatattcagagtattcaaaaatttaacattatttcaggagtagttttgcttaggttctttgtttaaatttatagattcttttgtaatatgtaaaattcctttttcctccttgttcactaacaatgtagtgtttgttttcagttaccatcagagttaagattcttattgtggtttactgttctctgagatttttgtgtggtgtgaaagtttctctgtaaaagtctaagagtttttcccccttttaagaaataatttcttaaagcccccaagattattgttttgatgattcagaactataatcaactttactatacaaagtcctaatctgtaaagattgatttcataggttctctgatttacagatctctgaaaaactaatagggtataaaatctaggctctctctcctattagtactgaacacactataaaattccttgttgtttactaggattgctcattgtgggctctgtggttaggctgtatttattcctccagggtctcacttttttttttttttttttttgagacagagtcttgctctgtcacccaggctggagtgcagtggcactatctcggctcagtgcaagctctgcctcccgggttcacgccattctcctgcctcagcctccccagcagctgggaccacaggtgcacgctgccaagcccggctaatttttctgtatttttagtagagacggggtttcactgtgttagccagtatggtctcaatctcctgacctcatgatccgcctgcctcggcctcccaaagtgctgggattacaggcgtgagccacaacgtccaggctagggtctcacttttattcaagttagtattgccttattagttgtttccccagagaagatagtgacagggatcaattataactaaaatagtagttctccatatgtatcatgaatcaaattttgtgtgtggagaccttgtggggattgcagtgggcatggggcagagatctcagttaattcttacgccgtttatatcctctactccatttcttgagagccaaataaattagtagatcttcttctaaatggcaagatattagaaaatatgttaaaactgcattaggaaatatctactaggagtttatatatgaaataatgagttttggctgaaagttacagaaactcttttctattcatatacaacttaaaaatactggaaattcttttggtgtgaaattttttatatttgccaaaataatatttaattttaatttgtataaattcatttcacaatgaaaattcatatctgagcatttctaatgactcaacaagagaactctcacttttccactttaaacaaccattagtaatttttataataaagtttgagaaaaagaaaagataatttgaggttttttttttagttgagaagaatgcgtaattttttaataaattcaaagggtgaaataaggtaggcaattttaataagcctcagaattttaattgtatggcaggagagtctgtctactttttctctaggatttgtacttaaatttttttaatgttctaagctttctcttctttctttctctatctcactctctttctctctattttcttttatttctcttttttttcttttctttcattttttgagacaggatctcactctgttgccccagctggagtgtggtggcatgatcacggctcattgcaacctcgacctcctgaattcaattgatcctctcacttcaggctcccgagtagctggggctgcgggggctcaccaccatgcctggctaatttttaaattttttgtagagacagggttttgccatgttgcccaggctggtcttgaactcctgggctcaagcggttctcccaccttggcctcccagtgtgctgggattataggtgtgagccaccacgcccagccaattttctcttttctgtctcatgtatcatcatattttctaggctcagtagtttagttcatacctattaatatattcagaaagcatcttgattgaaagatcctttgaattattctgtgattattttcctttattctatatactcataaccacatcctactttttaaattaaaaatttgtctcacacgcttgcagtgagccaagatcatgccactgcactccagcctgggcaacagagtgagactccgtctcaaaaaataaaaataaaaaataaaaataaaaaaatttgtctcccacttaacctttttctttctattctaatattgcagtccaataaaatcaggcccacatcccctcatctgtctagttcccttgcctctattcatcttctctggttcatcctatatattgtcactgggttcatcttaaaacacccttttcattttgttaatcctctactccattcttttcagtctttcagatcaaatcctagataacttagtatttactcgagcctctactttatgcaagtcagtgggaattcagagatagtcacaagcttgcctctgatactttcacattcgagtagaaagtcaatcacgatacaataagttaagtattcagagtgatctacagggagctatttatttactcattcagtaaatatgattgaacacttactacttgctaggcactttgctaagatgataggatatgagagacatggactctgccaagcataagcattatttagttagtaggcagacacataaagagataattataaatacacaatgggtaatataattctgggtccatgaaaaacacagaagagggatatctgattctatcttggcagttagggaaggctttctggatggataaacactgaatgaagccttaaaggatggggaggaactgcccaggtgagaagggagtggaaggtgagtagaagcttccagaagaatgagacaaaatggaaaaagcacagagatgtggaatcgtttgacttgttttggggaaggtattgtattacctaccttgtttggtattattggagtataaagctattagcaagatgtggcaagaaatgagactataggctagggctccatcttgaaaatccttgaatctatgttaaggagattggattatatcctgtagattgtggggatctattaatgaggggtatttttgtgttttatatattttttagaggcagagtctcactctttcacccaggctgcagtgcagtggcgtgatcataggtcattgcagccttgaactcccaggctcaagcagtcctcctgcctcagcctcctgactgaggactacaggcatgagccaccccacctggcttattgatgagtgtttaagctggggaataatatggttagctagatttgcattttagatagatgtatttgacagctgtgtggaggataggttgaggaggataaaaccatttacgaggctgttgaaagtacaaatgacagacagtgaggcaggaacagaggggatacatcagtaaatatttagaaggtaaaatcagcagaacttggtgactggctggatctgaaaggtaaaggatagtgagcatggagaggaggtttctgttactactaagaaaaatgtggtcaaggtttcagttgttgacctaggcaagattgtgaaatcagttttgtacattttttaattagaagttctttattatacatctaaatggaatttttcaaagattttgaattgataattgtagtggttatgaggttggactggaccagaccgtctaggctcaaatcctgactgccatttactagttttttggcatcaggaatttacttaacctctctgttgctctgttcctcctctggaaaatgagaacaataatagtacctgccttggtacttgcggttgttgtgaggattcactaataagtctaaaacatttagaacactgtcagtctataagaagtgttcaagaagtgtcagtcattatcatcattatcgtcattctggagcatagaggattaagctatatagcagaaaatgggattggagaactagggatcagataatgaggagccacatatgacatttaaaatggtgtggatgttatcctaacagtagtggaaaactgttaaagaatgtctgtcattgataacttctaatgttatttctttaccccccgccccccaccacacacaaaaatctcatcttaagataggtatgctgccaccaggtggcagttatatgttatgttgtacaaatgaagtagtaaaaaccattatgtgtttcttttttaacataaaatatttacttgattaaaatagccaagtgtaagcagtctaattctagtaggactcttttgttccaaaacaaaacaaaactcgttaagcgaaggagagaaaagagagggttattgtaaagatgtggagatttcagaggaaggtcagtgtatagctgggtctcatggaaactgaaaagccattggaaactggtgccattctctccatcattttttctctcactttcacaatatgttatactcctctgtttgtagatcagcttccttgcctgcatgtcagtttgcacatgaccaaaattatgggatgagtctccaaatctgttctatccaatggaattgtttcctactaaatatacccttatttatttattttgagacagggtctcactctgtcacttaggctggagtgcagtggcatgatcattactcactgcagcctcaacctcctgggttcaagtaatcctcccatctcagcctcccaagtaactgggactacaggtacacaccaccatgcccaattattttttatagaggcagggtctcactatgttgcgtaggttggtcctggactcaagtgatcctcccacctcagcctcctgaagtgctggggttatgggcgcaagccactgtgcccagccccagtaaatatactttaaaaagaaagaaggggaaaataaaaattatataaatcatagaaacacatctactcatagagtaatcatctagcctagaggctcccaaattttgctgcatataggaaacacctgggaagctttacaaattttttgatgcctacattacatcccataccaaaatcagaaaatctgcagtgtcaggcctcactattttttgtaaagatccccagtgagcaatagactttaggacccactaacatagccactttacttgattctacaatactgtgccagctactttacttggtgtggaactaaaggaatagggatgattcaatgccagaaggaaaattgactatgttggatacaaagagaagtgttttatagtctgtaacatgtttaataggttgattatataaactgtactttatagatgattttaggagtatctgtagattgatatgattattgtatgacacactcattttagaatcctttatataagatgaatctcctcgtgttatctttctggacagcttcttacctccttgttccctaattctaagagaagaatctaagtgactgacctttctttccttatcaaacttagggtgggaggagaggcaggggtgtcatggatgggagaagctatgagcactgaccagttccctcagaaggaagttctacttactttaaaaatacttaaatatttcttctaaaaaagaatatatgtaaaatgtatgtataaaataaagactgatgataaaaagaacacctctatacctatcaccctgctgaagaagcatacacatacgaatatatttgaaacctttcctcatctaatcccaacccctcaccacttgaggtacctatagttctaaatttgtttatttccttgcttttctataccacatatatgtacacatacaacatactagttttcctgtgcttgaacttaatggtatcatatgaagtcatcagtgatttgccttttgttcagtatcatgtagagcatgttcacgtctgcatagtattccattataggaatttacgtcagtatccattgtgaggtcagtaagtatttgggttgtttccagtttttgctattgtaaatactgccactaagtgacatgatcttggcttgctgcaacctctgcctcccgggttcaagtgattctcctgcctcagcctcccaagtggctgggattgcaggcacctgccaccatgcccggctaatttttgtatttttggtagaaacagggtctcgccgtgttggccaggctggtctcgaactcctgacctcagatgatcgcccaccttggcctcccaaagtgctgggattacaggtgtgagccactgcacccaaccgccttgaatttttttctaagtttactttttattttcaaaaaattattatgtatttcctcattttccataagaacattttagtagtgtttcctcatcaataaacacaaaaaagagtctttactatgctattttcactattaactttaattcagtaataagcaaatctttgttaaaagtagagatggaggctgggcgcggtggctcacgtctgtggtcccggcactttgggaggctgaggcgggcggatcacgaggtcaggagatcgagaccatcctggctagcacggtgaaaccccatctctactaaaaatgcaaaaagttagccgggtgtggtggcaggcgcctgtggtcccagctgctcaggaggctgaggcaggagaatggcgtggacccggggggcagaacttgcaatgggccgagattgcaccactgcactccagcctgggcaacagagtgagactctgtctcaaaaaaaaaaaaaaaaaaaaagtagagatgggatttctagcctcctaaatgccagacaaacaatctaacataaaatttaccttgaataagatatatgatattgattctgagctgctttgtattttttctaactttggcatctgtatcttggtgctttctattagactgatagagttttagaacctaaggagtatgcattgtacttcagcgcttttttcttcattactttctgtgtatatagacagcatatttttttttgtagaacattaacccagattgctaatagcttcatgttatggcattcttccacacagtccagattgatttaaggaaaagcagaaatggaagtcaaagtgtgttataaattgagactgaaaaacgtgctctaaaaaaatagatttaatttcttacactgtgaatagccattgtattgttttgtttctgataaatcagttgttttgggcttctatttttgaactgttaaaaaattttgatgctttttgtggataaaagtagtgcctctctttatacaactgatggggttttgaaaagtatgtaagttgccttttttgttaaacttattttaaatgctttagtatttaaagggtatatgtttttaattaatctgcatatttaaaaactttttgtaacgcgaataactacttcctgatttacatctcaatatattctcctttcatttgcccaattaaaaaaatatgtagtctctattattgctgtttactaatagttttagatcccaatgtgtattagaattatagctacaaaaagttgcaagtaaaatttaacaatttcctattgaaacaggatctcattattatgtttttaaatgtgtagaattaacactttaaataaacaggtgtgaaaattgtaaaggaatatatatgacaactattttctgtacattaacgtccaaacattatacttgtttttcataataaaaaacattttgaaacaaaatttgctgagtttagcataaaagcatctttgaattatttctgagtttcctaaaatatgcaacattttaatcttggcatatctaatcctatgtgctgttctataagaggtacactggacttctaaccactatatgtatttagtagaataatggaatcacaaaggaacaagaattccagacttatagtttgaaatgtatcataaacaaccctttcatattttaggttagtagctttggatagctatttaacacagatgagtacagttagctttatatatattatcctctgagtcttatctatgacaatgtatatttagattaaatatgttcctcctgtaactaaagttgcatctttgcaaatgatgaaagttcatttcagcagacacaaattctttaaaagatttgggctataaactaacacttcaaattttgtaataatcagtatacttttatcaagaatgaaattatttcatgcttaattaccctccttattttgtttccataataaaactattttcagaaaaaaaaatactgcccctgtgctatttttttctgttctgacgtacagcacatgccaagggtttagagatatgcagagattatgatcccaaggtccttcagtccttggggagtagtgactacattcaggaatggagtaagaagagggagtgaagtcaaaagcaaactgatattcatgtgtttattacatgcctggtttcatcacataaatgatctctgacagatgtccatgggagctgatgatggatacctgatgtccatcaacatggatcactatgctgaccagatgcagcagttcttttattttttagtaaatatttcctgcaaaaatatatccatatgaaagggaataatgtataatgtaggtttataaatgagttaacctcagatggtaaactggcatgcattttatgctgttgagagagtgtctatttgttacaaatataccttgctttgggcattctcctttacataaactgtgcagtgttatttgttgtttatttttaatgggattaaacttaataatatacttagggtagataacgttaggggtaaagtgccgttcttctcactgttcattgttagcagtaactgagatgactgtaaaatgaagcagagataggataggtgacatctaaacagcactttctttagggataagatttctagtaggtatgtagttgtatatatcctttaaaaatagtgatattagcatatgggcccacgataattttattagtaaatatactttagagttgtgtgagggaggcaggcagtaaagatctttcaaagagaaaaacaattacctgttgtgttataacctgcaagtaatgattttgaatagtttgttgtttattctttttcttctatgcataagtaaaacgttacttaaatcttactctatatatgcagctttgttcttttttatccaagtttatgttgagagcatttttgctcattaagattttttttttgaaaacatcattattattattattattattatttgagacagggtctcactctgtcacccaggctggaatgcagtggcatgatcttggctcactccattctccacctctcaggctcaagtgaccctcccacctcagcctgccaagtagctaggaccacaggcctgcaccaccacgcccggcaaatttttgtattttttgtagagatgaggtttcactatgttgcccaggttggtctcgaattcctgggcttaagcaatatgcccacctcagcctctcaaagtgctaggattacaggcatgagccaccacactgacttgaaaacattatttttgacagctacatgttattacattgcatagttgtgcaatagtgtaaccatggacctgatattcaccttggtttttaaaataattttaattttattattactactatttttgagataggatctcactctgttgcccaggctggagtggagtgcggtgatgtgatcctagctcactgcagcctcgctcctgggctcaagcagtccttccacctcagcctttcaactagctgggaccacaggtgtgggccaccactcctggctaatttaaaaaaaaaaaaaaatttacttttttaagagatggatcttgttatgctgttctggctggcctcaaactcctggcctcaagtgatctttccactttagcttcccaaagcacatactctttttgaaacattattttccaacaaacatttgtgtctactatgtggcaggcagtgaaattgtgttaaaatatgtaacattaagatggttccttaagctgcagaatttgttttctttttagacatgacggtggtccaaaacctttatttaaaaaaaaattatattaaatgagattataggctataagtaggactggactggtcactcaatatgtaaagtcctgtggtcttttccattcctgattccctcaggcctgtttggcactgttattttccaacagtttgtatctttgtgatatttaagaatactttaaagcatccttaaaatgttgcttttgtcttctttactttcagttgccttacttcaacttcatttacaaatggtctttgggacaactgttataatctttttatttccctagttaggctactggagttttgttgtagttgtttgtattagcattcatgtttatcattcattaaggaatactaaaaacgtttaaaggcagcattgacaagtatatatagtcatcataattagaattaattggtatttcttagcttttctacagcaaaaacaaaaaacagctctatttactgctatttttgaatactggagaaactaggtaacacatttaagtaatattttgtaccattctctcgagtatatttgtttcatcgtgtttgtttttattttctctccagtcttgtcaaaaaagcacttgtctgtttggtgatatcacttgctcatgttctttaagttactgttctaggattggggtgtaatgacagatgaatgaaaagcaggatgagaatgcatggaaagcaaatggtataatggaaagttggattttgagtcagatattgttgttccattttattttgctgcttactgcttatgatcttgggcagataacccatattcatctttaaatcttggtttccacattctttcaacatttcctgacttctccccacacgaccccatttaaattaaattttttctgtgtgaggctctcctaatacctttttcttcaaagcactttttatcacttgagatgatatatttctgtgtttatctatatttaatttgtttttcccacctgtattacaattcatgagagtagggtttatacctcttttattcctcactacatgtcttactttagcacaaagttgcatgcatgatgggcagtcaataaatatctgttgaataaataaactacttactacctgacatatgccaagttattttcttcacaggtaaaactctacaaccacatctcttttggaaagacttatatgaagaaatcaggacaagggaggttcccataccacctccttaaatatatataggactgctgagtttatgaaattgtgtattaacttttatctcatttatttctcacaacttgatgaaatgagagactgttattaaataatagtagactaaagggtcctactgttaagatcatatattttgacacatgtctagcacagtgcctggcacataatgaacaatgaacactcaagaaactgaagagattccaaatagttgatttttttgaattgacattataaaaacttggctttttttttttgagacggagtctcactctgttgcccaggctggagtgcagtggtgccatctcagctcactgtgacctccgcctcccgggttcaagtgattttactgcctcagtaaaatcccgagtagctgtaatcccgagtagctgggattacaggcgcctaccagcacacccagctaatttttgtattttagtagagacggggtttcaccatgttggtcaggctggtctctatctcctgacctcaggggatccacccgcctcagcctcccgaactgcagggattacaggtgtgagtcaccacacctggccaaaacttggcatattttatacagcattttgaaaattcattgttttattcagaatgatcatttgttaagttaaaaatattgagtttggctgggcgtggtggctcacgcctgtaatcccagcactttgggaggcctaggcgggcggatcatgaggtcaggagattgagaccatcctagctaacatggtgaaaccccatctccactaaaaatacaaaaaattagccgggtgtggtgccaggcgcctgtagtcccagctactcgggaggctgagtcaggagaatggcgtgaactggggaggcagagcttgcagtgagctgagatcgcgccactgcactccagcctgggcaacagagtgagactccgtctcaaaaaaaaaaaatcttgagtttaaggaataagttattatttgtattaagtcatttattcatgttctgatcagggtaagacatttgcttgagatccgaaccagttttgaaaggcaattatatatggacataatatctttccagtaaatcttgcaactatttctgtgactacatatgttaacatttttataattggcttccaaataacaaacacagatggctgtagtctgaattttcaccatgttttagaataaatgttttctcagaaatttaaagtgcatcatttcagtataagatgattacctaattgagtagaattttttccttatctgctagcttgccatttttcagattgagagtaaatagcttaaatatctattagtataagaaattggatatatatgatcttgttccctctctcacatttttaccaaacagaactcttgctaaaaagttattgtagatattatttttctgagaatttaaattttgttttgctttttgtcttttggtggaggagggagattataattttttgtgttttaattcatttaataagtaactagaaatttgttaattttgaaaccatgagtttttaatgtagtagaattaaatatgcccgttaaactgttttggttctcaagtcttgtgaagtggtgcttgaaatcattgcttagtggtgacttttctgtaaaagataaattatctttttttactctgaatattattttaggctttgtatatatagcagagaacaaaagaaagccctaaccctcagtgaacttaccttccggttaatctgaaaaataatatgacttcatataatcagtaacataggcctaaaacaatgccatggtaatttaatgtccttaaaagtgattcgttctaagcactataatagaaaaattcctattttgattccatatctatccattatctttttaatttgggttcatttagtaatgaatattattgtttcagatttttaatcgaactgtttatgatgcaaagttttagtttttctcatttattatgtgtttgcacatctgaataaatattaaatataaattatgtataccctaattacagttggaatctcaaaccaaattttcacctttgccctgatatattttgctgtctaaatgtattttctaatgcagacaatgtggaattttaagtttctgaaattgagcataaatatcaaaaatgctattaatttcttttggttttgcattctctctgagggatcttttctttttaaacaatgcacctagaattctgattccatttacagataatatatttagcagtattccagttggtttatttttaagaatgaatttgctaccctccaaagtagtttaagtgcattccagtttcttaatgtacaagtagaggcaactggtcttgcacctgttcctcaaggagacatgaggtggaataactgtgtagttgctgaataactgggaaaaaatttaaatataatttatttttatatcctactaggctagtgattagctatttctgatttataaattagatgtctttattaagtaaatagtacatatgctttccttcatccacagcagacaaaataagtataaaatatgttgtgtgttattctgtagataacatatttgtcacacacacacacacacacacacacacacacacacacacacacacatatttttgagacggagtcttgctctgtcgcccaggctagagtgcagtggcatgatctcggctcactgcaagctccgcctcccggattcacaccattctcctgcctcagccccctgagtagctgggactacaggcacccgccaccatgcccggctaatttttttgtatttttagtagagatgtggtttcgccgtgttaggcaggatggtcttgaactcctgaccttgtgatccgcccgcctcagcctcccaaagtgctgggattacaggcgtgagccaccgcgcccagccatttgtcacatattttgatagtaatatgagcatcattaaaaattgctttatttttatgataaattttctggccattgttgtaactggtctaattaatagttatattaatactagtagtatatttcctttttttaaagcacaacaaagcttacaccttttcttattctttggtttctctcctctcagaatgaccaaagagctcaaattcaatttaggaataggtggctaatagttgcttcttagaaaaattagaaaatctattgcataacaaaaggaaatttcacattagcaaaaggaaaaatacctgtaatctcaagtcagagatacaccaaagttctcagttatattcttccagagtttctctatgcctacaagtacaatgttattaaaattcaagctagatacgattgttgaaggatgtgagtttgagtcctgccttctctgttaaaagaagtgtacattatttttttcataaaaatagattatgcagcagtaatatacctactactgtgtcatgaacatctttgttagcaataatggtttacataaatattttaatatggcgtcatcatagttaacctaatgttgcctaaagcatgtaatacatacttctgatgttaggtggtgatattttaggtctatcctgatccagtattaaaaacattggataaatgggtacaatgtacactatttgggtaatgcctaccctaaaaactcagacttcaccactatgtaatatatcgatgtaacaaaactggatttgtaccccctaaatctataaaaataaaaaaatagaaagagaaaaacattagatagtattgtaagaaagttattatgtttgccagttttcttttagttcatctgcttgtgatagccaagagtctgtttgatactcatatatctttaacacccttttaacacttgcccatttctctcatacccttcaacaaaatctaactaaaattttaataattttttcattgtatttatttttgtttacttttctaaaaaagaaatgacagtgatactgacttttagtttgtgccaaggatagaaagtctccttttagaataaatttactttaaaatttttattgttatgtaatgtatatattttgggaatacatgtgataatttaatgcactcatatagtttgtaaggatcaaatcagtgtaattgggatgtccgttagctttaattagtgaaatattcaaatattttttagaaatattcaaattattttattctagctattttgaaatatttagtagttttttgtaaactatagtcaccctaccaatctatcaaacactaggttttatttcttctgttaaactgttctttgtatccattgtcagcccctcttcatcttctccaccttcctactcttcccagtctctggtaaccaccaatctactcactatttgcatctactttttcagctcccatatatgagtgagaacgtctgatatttgtctttctgtgcttagcttatttcacttaacatagtgccctccatttgtgtccatggtgctgcgaatgacaatttgttctttttttatggctgaataatattccattgtgtacataccacattttctttatccgtttatcaattgatgggcacttaagctaatttcatattttagctattgtaaatagtactacaaaaaaacatgggaatgcagctatctcctttgtatattgattttctttcttttgaatatgtcccagtaggggaattgctggatcctgtggtagttctatttttagttttttagaaatcctccatacagttttccatagtgtgtgctgatttacatttctgttaacagtatacaagggctcttctctctccacatcctccccagcatctgttattccctgtctttttgatgaaagtcagtttaactgcagtgagataatatatcgtggtggttttgatttgcaattctctgatgattagtaacattgagcattgtttcagatacttgttgaccatttgtatgtattctcttaagaaatgtctgttcagatattttgcccatgttttaatcagattatttgctcttttgctgtccagctgtttgaacttcttgtatattctggttgttgttaactccctgtcagatgaatagtttgtagctattttctcccattctgtgggttgtctcttcactttgttgattgtttcgtttgctgtacagaaactttttagctttaaaaacattttttaaattatttattttttgtagagatagatctatgtctcactatgttatccaggccagtctcaaactctcaggctcaagtgatcctcctgcctcggcctcccatggtgctgtgcttacaggtttgagccaccacactcttctgaaactttttagcctggttccatttgtctgtttttgtttttgttgcctctgcttttgagatcttagacaaaaaaaaactttccccagaccaatgtcctagagtatttctctactgttttctttttgtagtttcaggtcttagatttttaaatccattttgatgtgattttttttgtatgtggtaagagatacttatgtagtttcattcttctacatatggttatccagttttcccagcattatttattgaagagattgtccttttctcagaatatatggtctattctggagaatgttccatgtgctgaggaaaggaatgtgtattcttcagcagttggataaaatgttttgtaaatatcaatttagcctatttagtgtgtagtttaactctgatgtttattttctgtgtggatgttgtatattcttggcacctttgtagaaaatgagttgactgtaagtgtgtgaatttatatctgggttctctgtttcgttccattggtctgtgtgtctgtttttatgccaagaccatgctgatttgtttgtatggctttgtagtatattttgaagtcaggtaatgtgatgcttccagctttgttctttttgctttggctgtttgtgatcttttgtggttctatcaaaattttaagattgttttttctatttctgtgaataatggcattggtatttcaatagggattgtattgaatctgtaaattgctttggatagtatcatttttacaatattcttctaatccacaaacatggatttctttccatttttaatgtcctgttccatttctttcatcactcttttatagttttccttgtatagattttttacttctttagttaaattgatttctgggtattttatattctttgtagctatagtaaatgtgattactttcttgatttctttttcagattgtttgctgttggtatatataatttctattgatttttgtatgttgattgtgtatcctgctattttactgaatttgtttatcagttctaacagtttttggtggagtctgtaggtttttctaagtataagatcatattgtatgcaaataaggctaaattgaccttttcctttccaatttggttatcttttatttttttctcttgcttagttgctgtggccaggacttccagtatgttgcatgaaagtggacctccttgtcttgttccagacttagaggaaaggcttttaatttttccctattcagtgtgatattagctgtgggtttgccatatatggcctttattactttgaggtatgcatcttctgtatccagtttgttgagggtttctatcctaaaggcatgttgaattttaaattttttttcagcgttaattgaaatggtcatagggttttgttcttgattctttcaatgtgatgtatcatatttattgatttgcacatgtttaactatccttgtgtctttgggatgaatcccgcttgatcatggtgaatgatctttttaatgtgttgttgaattcagtttgctagtattttgttgaggatttttgcatctatgttcatcagtgatattggcctgtagttttcttttttgttgtgtccttgtctggttttggtatcaggctaatgttggtttcatagaatgagtttggaagtactcccttctcttaagttttttgaagagtttgagtataattgttattctttaaatgtttggtagaattcagaagtgaagccatcaagtcctgggcttttctttgatgggggattttttgtgtctgtgtgtgattgggtctcctgttgcctaggctggagtgcagtggtgtgttcatagatcactgcaacctctgcctcctgggctcaagccgtcttcccatgtcagcctcccaagtagctgggaccacaggcatgtgccaccatgcctggctaattttttgtattttggtagagacgaggttttgccatgttgcccaggctggtctcaaactcctgagctcaagctcaagcaatccacttgcttcggcctctgaaagtgctgagattacaggtgtgagccaccgctcccagcttgatgagagactttttattaaggctttgatttcattgttggtttgttgaggttttctatttcttcatggttcaattttggtaggttctatgtgtccaggaatttatttatctttttcttctaggtttttgaatttgttagcatatagttgttcataatagtctgtaatgatttttgtatttctgtggtctcagtttttacatcttctttttcatttctgattttatttgacctttctccttttatgaaaattagtatagctaaaggtttgttgattttgtttatgttttcagaaaagcaactttttgtttcattgacttctgtattgactgttttggcctcaatttcatttgtatctgctctgatttttgttatttcctttcttctactaattttgggtttggtttgttcttggttttctagtttcttgcagtgcgttgtttggttgtttatttgaagtctttctcatattgttttattggtataaacttccctctcagtactgcttttgctttatcacatagattttggtatgttgtatttccattttcatttctttcaagaaatttaaaattttctcttttaatttcatcattgacccatttgtccttcaggattatgttggttttttgtttgttttgttttttgagacagggcctttctctgttgcccaggctggagtgcagtggtgtgaacatggttcattgtagcctctacctcctgggctcaagcgatcctcctgcctcagcctctcaagtagctggcaccacaggcgtgggacaccatgcctagccaatgttttgaaattttgtaggtttgagaccaacctgggcaacaaagtgaaatcttgttgcccaggttggttttgaacttctgggctcaagcattcatcccacctcagccactcaaagtgctgggattacagacatgagccaccatgcccagcaggaacatacttaattattatttgtttgtgttttctgaggtacttcttgtgactgatttttagttttattccattatggtcagaaacgatacttgatatgatttctaccttttgaatttgttgagacttgttttatgacctaatatatggtctattctggagaatgctccatatactgatgaaaacaatactcttcaggagttgggtgaaatgttctgtagatgtcagtttggcctatttggcgtagtgtatagtttaattctgatgttttctttaattttctctttggatgatctgtccaatactgggattggggtatttaagttccctatattactgtattgcagtctatctctccctttagatctattaatacttgctttttatacttggggctctggtgctgggtgcatagatatttataatagttatatccgcttgctaaattgacacctttatcattatataatgaccttctttgtctctttttatagtcttgactggtagcctattttatctgatacaagtatagctactcctgttcttttttggtgtccagttgcacggaatatccttttccaccccttcactttcagtctgtgcgcattcttaataggcgaagtgggttttttgtgggcagcttatggttgggtcttacttctgtattcattcagccactctcgccattttaattgaagaattgagtgtatttaccttgagtattattattaataagtgaggtcttactaatgctattttgttgcttgttttctggttgttttgtaattcctctcttcttcctttcttactgtctttctttgaagttaagtgatttttttttctggtagtatgtttgaatttgttgattttttatttgtagtgaatttattatagtttttggcattgtggtcaccatgagacttaaaaagacataggttcaagcagttattttaatgatatgacaacttactttagatcacaaagaaaataatggaaacaaaagaaaaaaaaaccctctatactctaactccattccctccacattttgactttactttgtctcaatttacatgtttttatattgcctatttcttgataggatgctgtagctattaatgtttttggtaggtttgtcttttggacttcatcctagagttatgagtgggcgctacaccacaattacagtattagagtattgtgggtttgtccacgtacttaattttactagtgggttgtatacctttacatgttttgttttttcacattagtgtttttttctttcagattgaagaactctctttagcttttcttgtcagacaggtatgtgttagtgaattctctcagcttttgtttgtctgtgaaagactttgttcctcttctttgtatttgaaggatagctttgctggatacagtatccttgggtggctgtttttttccttcagcactttgaacatgttgtcccacatcctcctatatggtttcttcctcctgtatgacctgtatggtatctgttgagaagtctgttgccagacgaattgtagctcttttatacattgtttgcttcttttcttttgccacttttaggatcctctctttgtccttgaccattgagagtttgattattacatgctttggagtaatcttttttgggtcaaatctgctttgttctctaacgttcctatacctggatattttatctctttctcaagttttaaaaagtttttattatttcttgaataagatttctacccccttgcattaaagttaggcattatattatgtagtgctgaaaaacaggcggtgacatggtaccaaaaaaaagatacaaaaacaatacataaattgcaaagactctctaagtgaacacattcagtaaaaaacaagccagacagtgaagactagaactcccttttgaacactgataattcttagatttgatatttcgaggtaattttctgtgtcttctaggtgatctttgttccttttcattctttccttttctcctctgtatttttaaatagcccgtctttgagctcactgattcttttttctgtttgatccattctcctgttgagagcctctaatgattctttctgttcagcaaatctttctcagttccaaaatttctttttgatttataaaaaacttttaatctttgttaaatttttctaatacatttctgaattgtttttctgtgtaatggagatcactaatttcctttaaactgctgttttgaattcttgttcacagagttcacatatttctgtcttgttagggtcattcactgattcactggttctttgtgctttgtccatttgactaagtcaaggtttcccatttgctgttgtttcttgtggatatacatctatttctttttttttttttttttttttttttgagacggagtctcgctctgttgcccaggctggagtgcagtggcgcgatttcagctcactgcaagctctgcctcccgggttcacgccattctcctgcctcagcctcccgaatagctgggattacaggcgcctgccaccactgccgggctaatttttttgtatttttagtagagacagggtttcactgtgtcagccaggatggtctcgatctcctgacctcgtgatcctcccgcctcggcttcccaaagtgctgggattacaggtgtgagccaccgtgcccggcctacatctatttcttaaagtgaagattttgttatttattctagtcttctctgtctggcttgttttagcttttactggatatgtttgctcatagagtcttttatgttttgcctctcttttttttttttttttttttgcactatgtcactgcctctgtttcagtactacataatataatgtatatgatgtctttagccccagtttgcttcagttctagtaaacaatcagtgttatccatccttgatcggtaaggtcccaaaggcccctagtctggctaggggctcgtgcccagaggacctgtggcatgaacctcttacagtgtgatgctgctgaacagccagtctgatttggcgtctcctttggccaagttacaaagcagggtttttcagggctaggaatggtagtcttgccttcccgctttgtctctggctgttaggaatatttctcccttcagatattcccagtacttcctggttgtccctggttgagccagggacagatctcctgtcaaggagcccaagttgatggagaagctggttgtccaccttgatctcactttttccagtgtagaaactgtgagtcaggggaatattttccatgtttggtgatgggcagattaggagaatgggaatcatgaaaatcaaagtctaattcttttaacttctgctcagagttttttcacttctccatggtcttgaatactgtttcttcctcatatttgagttctgggatatcgccagtaataatctaagctctgtatatttgcttttggttttctgttaggggaagcgaaggcaacttgcttctgtgccaccattttggagctattaggttggtgcaaaagcaattgcagtttttgtaccgacctaatggaagcctctgttcttaaaataaatttaaataagaaaactacattggttaaaacatgttaagtaaatgatacataaaggtggctctaggataggacaaaaatcctgatgatgatatgtaaacgattaagggctggaaagcactgctgtttgatatttaagttatttccagttttttttcccattatgaataaggctgcagtgaccactttatatagctaaatctttttgcatgaactaaatctttttagtatatagtaatagaagacacagaaattccagaaagcaaattcatgtagtgctctgtgtgtgcatgtgtgtatgtgtgtgttttcatataatctaaaatccagagcttggccagcacactggctcacgtctgtaatcccagtattttggggaggctgaggcaggcgaattgcttgagcccaggagttgaagaccagcctgggcaacgtggcaaaaatctgtctgtacaaaaaaatacaagaattaaattagccaggtgtgatgacatgttcctgtagtcccagctacttgggggctgaagtgggaggatctgtggagcccagaaagttgaggtgagctgtgatggcgctactgcactccagcctggatgacagagtaagaccctgtctcaaaaaataaaataaaatcttggtgagattatattctcactaagcagtgaatgacagtgcctgatttcccttattctgcctaattctgggcttattttcttttatttagacatgacattttcagttcttacccctcaatatttcagtaggtttattcagaaatgtttctttgcattccagtagttacattaaagactgtaataattgttctttattttttcatttttatttagtgatagtttgatctttaaaagagagactcccaaagctgcttttttcttggtggcaataaagaaaaattatctttgacaataacggttattttcttttttcttagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaagtaagtattctcccagatttttaatcattatggttctcgatggaaagtagtcataacaacagtcattagcaactgtgcgcaatttgatcatgatttttatgtcctcttgaaagttttagtagtatggtaactaaacagtcataactaaaatatttgatcatctcagagagggagttttgtgagtttaatttaatatatgttgaacaactgcagtacaccaaagactgagcaccagagttacaaagatggatatgactatctctgccctttaggaaaattattctagtggagaaggcagacttaaaggtatgcagtgtgctatgattagacctttgctagtatgagagatagatgtccaacttcattttttttgtttgtggctatccagttgtaccaataccatttgttgaaaagactattcttttcccaatgaactgtcaatgaatataaaggtgagggtttatatttatcccctcaattatattctgtagatctgtatgtttagcctttgctactatgcccccaagtcttgattaatgtagctttataacaacttttgaaatcagtaagtgtgagtcttccaactttcttctcttttgggattgttttggctgttgccttgcatttccgtatcaattttagggtcaggtttttctgtttctgcattaaaaacaccacggattttgacagggattgcattgaatctgtagatgaatttggggagttttgtcatcttaacaatattaagttttcaacctatgaacacaggattttttatttatttaggtttttaatttttttaatgttaccttgttttcagtgtaaacgtctcacatttgttttgttaaatatactctcaagcattttatttttattttaattttcatttatttactttttgagatgggttctcactctgtcaccgagactggagtgcagtggcatgatcttggctcactgcaacctctgtcacccaggcccaagccatcctcccacctcagcctcctgagtagctgggaccacaggtgcatgctaccacacctggttaatgttttgtatttttggtagagatgggattttgccatgttgcccaggctggtctcaaactcctgagctcaggagatccacccaccttggcctcccaaagtcctgggagtacaggcatgagccaccgtgcttggccttgtttttgttattttattttattttagttttttgtagaaatgtggtctcactttgtgtccaggctggtctcgaattccaagacttaagtgatcctcccgctctggctcccaaagtgcttatgcctgtaaagttttatttacaggcatgaaccactatgcctggccaccaagcattttattgctattttatttctaagcattttactgctattctaaatataattgtattcttaactttattttctgattattcattatccatgtatacaaatacaactaaatttgtatattgatcttgtctcctgtacccttgcagagctaactcatctgtaagttctaataggttttttgttttgttttgttttgttttggtgaattccttcgatttttcctgtatgcaagaccatattatctgcaactaaactagaaatgttcaacttcttcctttccaatgtcgatgttcttttttcttttttgtaattgccatagctggaagatataagacaatgttgaaaagaagtgttgaaagcagacatccttgtattatttctcctaataaggggaaagcattcaggtttttttttaaccattgagttttatattagctgtttttgttttgttttgttttgtttttgtagctatcctttatcagattgaggaggttcccttttattcctggttcattaagtgttttcattataaagaaatgttgaggtttttttgttttgtttttattttttagtttattggtttgttttttgtttgtttgtttgttttttttttttttgagacaaagtctcgctttgactttgcactccactgctggagtgcagtggggtgatctcagctcactgcagtctccacctcccaggttcgagtgattctcctgcctcagcctcctgagtagttgggattgtgagccatcacgcccaactaatttttgtatttttagtagagatggggtttcaccatgttggccagggtggtctcgaactcctgaccccaagtgatacgtccacctcagcctcccaaagtgctgggactacgggcattagccactatgcccatccacttattttattgttttttgagacaggatctcactctcgtccaggatggcatgcagtggtgcaatcatggctcactgcagcctcaacctcccagacttcagtgatcctcccacctcagcccgacaagtagctgggactacaggcccatgccaccacacctagctaatttgtgtatttttttgtagagacggagttttgccatgttgcccaggcttgtcttgaactcctggattcaagtgatctgcctgccttagcctcccaaagtgctaggattacaggcatgagccactcactgctcccaacctgagtgttgagttttgttaaatgctttttttgtgtctatttgcaatgactttaatacaaaaaccatcactagggacaaaagatgttacagcacacattttacattatataaattcagccttttaaaatattttgggtatttaaatggtctaacatatagtcatctttctgttcttcagagtggataattgcaattcatctatcttgaagtttgctgattctctcttcctacttagatctactactgagtccttctagtggcttttcatttattttccttttcaattccagaatttttatttgattattttataatttcttcgttttattgatattcttcatttggtgaggtgttgttcttacaatttaaattttgttttgttttgtttttagattttatttcctttagttatttgactgtatttaaaatagctgagtcagaatctttgttggccaggcatggtggctcatatctgtaatcccagcactttgggaggcagaggcaaggggattacttgagccgaagagttcgagaccagcctgggcaaaaaagggatattctgtctttacaaaaagtaaaaaaaattagccgggcatggttgtgcacacctgtggtcccagctactccagaggctaaggtgggagaatcgcttgagcccaagaggtggaggctgcagcaagctgtgatcacaccagtgcactccagcctgggtgacagagtgagatcctgtctcaaaaaacaacacaagggccgggcgcggtggctcatgcctgtaatcccagcactttgggaggccaaggcgggcagatcacgaggtcaggagatcgagaccatcctggctaacacggtgaaaccctgtctgtactaaaaatacaaaaaattagcggggcatggtggtgggcaactgtagtcccagctactcgggaggctgaggcaggagaatggcatgaacccaggaggcggagcttgcagtgagccgagatcacgtcactacactccagcctgggcgacagagcgagactccgtctcaaaaaaagaaaaaaccaagacaaaaccaaaaataactttgtctgttaagtacaatatctgtgttcctcagggacggtttctattgaccattgtttttcttgtgcatagactatcctttcctttttttgtacatcttgtaatttttgttttattaaaactggaattttaaaaataatgcagtgtggcaactctactgcttgatttggctcaaaggtatattatttattttttaatataacaaaccaatatttgggttctctattctatagttttagcattttgaatgcaacaactgtcttattcaccatttaattctcagtactaccgtttctagtacacaatatgcacttaatgaatatgagggattgtatcatgaaagtatttcagatttaaaagataatctcggctgggtgcagtggctcacgcctgtaatcccagcattttgggaggctgaggtgggcagatcgctagaagttaggagttcaagaccagcctgggcaacatggtgaaaccttgtctctactaaaaatacaaaaattaactgggcatgttggtgcgtgactgtaatcctagctactcgggaggctgaggcaggagaattgcttgaacctgggaggcggaggttgcagtgagccaagatgatgccgctgcactccagcctgggcaacagagtgagactctgtctcaaaaaaaaaaaaaaaaaaaagagaatcttatgagttaggaaccactgttaataggattttagattacaggcaagtttatttttgttcttggcctcagttactacttcatggagaaggtagttttagaacttagacttgaatgttgaatagaatttccataggtgtagatgagaaaggagacagtgacagttaatatttgttgaatgaaagggtgaaactctctggagagggtcaacagtgagaatagtacttttggagtcagaaaatttggatttgttccttgactctttctactacttcttttagggaagcttgaaaaagctactcacttcatacccaaatccaggcatgtgatagtgaaacaagaatgactttaaaagtgcttttgtaaactgtaaaggtgttataacaaaagtggttattttttctttagttattactttttttagcatcatgatgatatgatttttctttcagagaaattgaacttttcttttttattgatttattttaattattattattattttttaaagacagggtctcactctgtcacccagaccagagtgcaatggcatgatcttggttcaccacaagctctcccttccaggcccaagcagttctcctgcctcagcctctcaggtagctgggattacaggcatgcaccactaccgcctggctagtttttgtatttttttttttttttttttttttttagtaaagacgagagttcaccattttggctaggcaggtctcgaactcctgaccttaaatgatccacccacctcagcctcccaaagtgctgggattacaggcatgagccaccacacctggccgaacttttctaacagtagcattttaggactttgtttcattttaaagaggtacggtagttcctccttatttgtggagagttgtatcattccattttcatgctgctgatacagacataccggagactaggtcatttataaagaaaaagaggtttaatggactcacagttccacgtggctggtgaggcctcacaatcatggtggaaggcagaaggcacatcttacatggcagcagacatgagaaaaatgagagccaagggaaaagggaaaccccttataaaaccatcatatctcgtgagacttactaccacaagaaccgtatgggggaaactgctctcatgatttacttatctcccaccaggtctctcccaaaacacatgggaattatgggagctacaattcaagatgagatttggatgggggaactcagccaaaccatatcaagagtatagtccaacacccccagtggagacctgaaaccacagatagtactgaactctgtatatactgtgttttttcctatactcatatacttatgataaagtttaattgataaattaggcactgtactcttgtgctttggggccattacttgaacacaagcactgcaatactgcatactgccataatgtatgatagtgcatctgataatggaggtggctaccaagtaactgttgggcaggtagcatatactgtgtggatatggtgtacaaagggacgattcatgtcctggatgggacagagtaagatttcatcatgccacttagaacagtgcacaatttaaaacttatgaattgtttatttttggaattttccattttaatattttctaaccacagttaaccatgggtaactgaaattataggaagcaatactgtggataaagagggggctactgtatgaggattggaggaatggtgtcttacttcatgcttttggcttacaaatgatatgtatataagaccctgtatgaaagtacctcttgatacttttatatttagaaaaatgcctactggtacattttggttgcattattttgccattgttatttataattaaatgaaaattttaaagatttgagtaatttttactagttttttagtggtattttatgtgacttttctatcatatgttaccaatagtaatggtttagtaaagtatgatatttagcacaaaaaagtcataattatatttggtttttatttttgttttagctggaaagtgaaatttcaaccacagcagatgactgcagttcagaggtaagactaaattatattgatttctaatatcataaatgtatatttatattattattgaaatcattgattgttgctacttgatttcttgtcactcatgcttctattttatttttataaatataatgttaagtgactagaacctgaggattatgtattactgactttttttttttttttttttttttcagattattagctaaggtcttaagtctggttaaatagcttggtctctgttttagtttctggaaagtatttgatattgggtttcttagacatgtgactgttacaaggcatccatatttagcacagtaaaaatatcaaaaattttttgagactttgaataggatatttcattttgagtaatgcttttttataaatgcttgaattctagttaatcatatgaacttgtttattgaaattaatgtttcaatagtagtttttactttaggtgataaaggtattgtccactttaggaaataccctctttgtgtgttggtaaaagtatatgtcattttgttatctttttcttattcttttagatgtgattgtcatttctttactccagaatttgaggagactataaactattctgtactctgaatggtttagcaactcagtgtattcagtaagtctcaatttattgtaggtttctaataggaaaaaaaaactccatgttcttaaatgaacgtattactgttttagattgctaatagcaataaaaactgctactttagaagttaatgtgcttaaaagttggaatatacttactagtaatctggccaggaaaataattagccaacattaaataaacacattggtgcctgatttaggctaaagttgcctctatgggaagtatcttgatttaaaatcactgcttaaaattcagagtctgcttttgtgacattaaatttggggcgcatacagttggccctccatatccctgggttctgcatttgagggtatgaccaaccacagatagaaaatattctgaaaaaataaaaaataacagtacaacaatagaaaatatataacatttaaaaatatagtataacaactaagtatatagtaatcttagagatgatttaaagtatatgggcagatgtccacaggttgtatacaaatactatgccattaagggtcttaggcatccgtgattttagtatccttaggggagttcctaaagctaattcacttgaagacaccaagggattattgcatttgaaaactttttttttctttataatgctctaatttttatatcttgtatttcttttttttttttttttttttcaccaagatggagtctcactctgttgcccagactggagtgcagtggtgcagtgttggctcactgaaacctctgcctcctggatctaagcaattctctgcctcagcttcccaagctgggactacaggcatgtgccaccacacccggctaatttttgtatttttagtagagacggggtttcaccatcttggccaggctggtcttgaactcctgacctcatgatctacccacctctgcctcccgaagtgctgggattacaggtgtaagccaccgcacctggctatagcttgtatttcttgactgaaagtcataaatgctttggtgcttaaactgcctgtatctctgggggcaccccagagttccacgaagtgcatttttctctttacactaaagtgaatattttttaatatgctagtggctgtaggtcagaccctcccatatatgcccatgaaatttggttacaatttgtatagctgttttctcacattgagataatagagcaaattttaatttaatttttttgtcattctaagtattttacgtacgtatgtatgtatgtatgtatgtatgtatgtatgtatgtatgatactttaagttctagggtacctgtgcacaatgtgcaggtttgttacataggtatacatgttccatgctggtttgctgcacccatcaactcgtcatttacattaggtatatctcctaatgctatccctcccccagcgccccacccctcgacaggcccccatgtgtgatgttccctgccctgtgtccaagtgttctcaatgttcaattcccacctatgagtgagaacttgcagtgtttggttttctgtcattgtgatagtttgctcagaatgatggtttccagcttcatccatgtccctgcagaggacatgaactcatccttttttatggctgcatagtattccatgatatgtatgtgccacattttctttatccagtctatcattgatggacatttgggttggttccaagtctttgctgttgtgaatagtgccacgataaacatacgtgtgcatatgtctttatagtagcatgatttataatactttgggtatatacccagtaatgggatcgctgggtcagatggtatttctagttctagatccttgaggaattgtcacactgtcttccacaatggttgaactaatttacactcccaacagtgtaaaagcattcctatttctccacatcctctccagcatctgttgtctcctgactttttaatgattgccattctaactggtatgagatggtatctcattgtggttttgatttgcatttctctgatgaccagtgttgatcattttttcatgtgtctgttggcttcataaatgtctgcttttgagaagtgtctgttcatatcctttgcctgttttttgatggggttgtttgctttttttttctttcttttattattattattatactttaagttctagggtacatgtgcacaacatgcaggtttgctacgtaggtatacatgtgccatgttggtttgctgcacccattaactcgtcatttcatttggtatacctcctaatgctatccctcctcctgcccgccaccccacgacaggcccccatgtgtgatgttccctgccctgtgtccaagtgttctcactgttcagttcccacctatgagtgagaacatgtggtgtttggttttctatccttgtgatagtttgctcagaatgatggtttccagcttcatccatgtccctgcaaaggacatgaactcatccttttctatggctgcatagtattccatggtgtatatgtgccacattttgttaatccagtctatcattgatggacatttgggttggttccaagtttttgctattgtgaatagtgccgcaataaacataggtgtgcatgtgtctttatagtagcatgatttataatcctttgggtatatacccagtaatgggatcactgggtcaaatggtatttctagttctagatccttgaggaattgcttctaaaatatctactaaaaataacaaaaattatctgaacatggtggcgcaagtatttttgtatttttgttagagatagggtttcaccaactgtcttccacaatggttgaactagtttacactcccacaaacagtgtaaaaccgttcttatttctccacatcctctccagcatctgttgtttcctgacttttaaatgatcgccattctaacttttgtgagatagtatctcattgtggttttcatttgcatttctctgatgaccagtgatgatgagcattttttcatgtgtctgttggctgcatgaatgtcttcttttgagaagtgtctgttcatatcatttgctcactttttgttggggtttttttcttgtaaatttgtttaagttctttatagattctggatattagccctttgtcagataagtagattgcaaaaattttctcccattctgtaggttgccttttcactctgatggtagtttcttttgctgtgcagaagctctttagtttaattacatcccatttgtctattttggcttttgttgctattgcttttggtgttttagtcatgaagtccttgcccatgcctgacctaaaggttattgcctaggttttcttctagggtttttatggttttatgtctaacatttaagtcttcaatccatcttgaattaatttttgtataaggtgtaaggaaggagtccagtttcagttttctgcatatggctagccagttttcccagcgccatgtattaaatagggaatcctttcgccatttcttgtttttgtcaggtttgtcaaagatcaaatggttggagatgtgtagtgttatttctgaggcctgtgttctgttccattggtctatatctctgttttggtaccagtatcatgctgttttggttactgtagccttgttgtatagtttgaagtcaggtagtgtgatgcccccagctttgttccttttgcttaggattgtcttggcaatgtgggctcttttttggttccatatgaactttaaagtcgtttttttccagttctgtgaagaaagtcattgatagcttgatggggatggcattcgatctataaattaccttgggcagtgtggccattttcacaatattgattattcctatccatgagcatggaatgcttttccatttgtttgtgtccttttttatttcgttgagcagtggtttgtagttctccttgaagaggtccttcacatcccttgtaagttggattcctaggtattttattctctttgtaggaattgtgaatgggaattcactcataatttggctctctgtttgtctgttaatggtgtataggaatgcttgtgatttttgcacattgattttgtatcctgagactttgcttaaggagattttgggctgagacaatgggttttctaaatatacaatcatgtcatctgcaaacagggacgatttgacttcctcttttcctaattgaataccctttatttctttctcttgtctgattgccctggccagaacttccaagactatgttgaataggagtggtgacagagggcatccttgtcttgtgtcagttttcaaagggaatgcttccagtttttgcccattcagtatgatattggctgtgggtttgtcataaatagctcttattattttgagatacctcccatcaatacctagtttattgagagtttttagcatgaaaggctgtggaattttgttaaaggccttttctgcatctattgagataatcatgtggtttttgtctttggttctgtttatgtgatggattatgtttattgatttgtgtgttttgaaccagccttgcagcctagtgatgaagctgacttgatcacggtggataagctttttgatgtgctgctgtatttggtttgccagtattttattgaggatttttgcattcatgttaatcagggatattggtctaaaattcttttttgttgtgtctctgccaggctttggtatcaggatgatgctggcctcatttaagttagggaggattcccccaccccctttcttttttctgtggcggagtctcactctttcgcccaggctggagtgcagtggcatgatctcagctcactgcaaccctcgcctgccgggttcacacaattctcctacctcagcctgctgagtacctgggactacaggcgcgtgccaccatatctggctaatttttcgtatttttattagagatggggtttcaccatactgttcaagctggtctcgaactcctgacctcttgatctccccacctcggcctcctaaagtactgggattacaggcatgagccacctcgcccagccaattccccctttttctatttattggaatagtttcaggaggaatgataccagctcctctttgtacctctggtagaatttggctttgaatctgtctggtcctggactttttttggttggtggtctattaattattgcctcaatttcagagcctgttattggtctattccgagattctacctggtttagtcttgggagggtgtatgtgtccaggaattcatccatttcctctagatgaaagaaatgggacctgctgagccaggcacgggagagaatctcctggtctgccagtttctgagaccattggaaaagcgcagtattgggcgggagtgtcccgtttttccaggtacagtctgtcacagcttctcttggctaggaaagggaaatcctccaaccccttactcttcctgggtgaggcgatgccctgccctgcttcggctcaccctccatgggctgcacccactgtccgaccagtcccagtgagatgaaccaggtacctcagttggaaatgcagaaatcacccgtcttctgtgtcgctcacgctgggagctgcagaccggagctgttcctatttggccttcttggaacggatcctcacaaattttaattttaaatattgatttgaaaagctaaagaggtcaaaagatggtgattttcaggttttctgtaggaaaatgttaattaatagtatgggaaattcttgttataataagacagtcttcagctaaattttttaaattaaaaaactggtggagattatcaggttccaaaaaatgtattgaacctatttatctgagatgcctagtaaatatatgttttaaggtaaggtacaaatagtatttaagtgtaagtactaccgataaaacttagaacagtatttatcatacttgttgaccatagctcatggtgagaaatatattttacatacgtttgtaatttcatatatatacatatatagttacatatatttatagttatatacatgaataattatatatgaataaatatatacatatgcatacttttttccaaacaagtttttggaaagatacttattcttacagtatgacatatcttgtgatgatacagtttcttgttaatgttggtcaaaaaaactaaattgatgagctatcttaccgtgtggaataaacagtgatttagaagattacattgaaaaaagataattatgagccaggcacggtggctcattcatgcctgtaatcccacactttgggaggccaaagtgggcggatcacctgaggttaggagttggagaccagtttgaccaacatgctgaaaccccatgtctactaaaaataacaaaaattacctgaacatggtggcgtatgcctgtaatcccagctacttgggaggctgaggcaggaaaattgtttgaatctgggaggtggaggttacagtgagccgagatagtgccattgcactccagcctgggcaacaagggtgaaattctatctcgaaaaaaaaaaagaagaaaaaagataattatgaaataatttttgacagatttgacctggtttgaattataaccctagtaatattttgtgtgttatgtatggattcacaacggattatactttgagaaatttatagattcactatgtctagagaaaacgtagaagtaaagttgatatttggtgaaatgtttgatatgtgtcatcaaaattgctaagatggatactagttggatctgtgatgctctaggctagttttgaggcttgaattcctccatttaatgatattagactggcttgactcaactagaattacaggagacttctaagccatatccacctattcaggaggcagaaaaatcatcagtggaccaaatttataacccgagaaataaactcatactgtaatagtttttatattggaacttttatggaattatctctcaataacacacctaaaaaatgagatttattggccgggcatagtagctcacacctgtaatctctgcactttgggaggccaaggtgggaagatcactggagctcaggagttcgagaccagccttggctacatagggagacatcatctctacaaattaaaataataaaataaaattagcaaggcatagtggcgggcacatgtagtcccagctacttgggaggctgaggttacatttttcaatgtaatcttctaagtcactgtttattccacacggtaagatagctcatcaatttagtttttttgaccaacattaacaagaaacagtatcatcacaagatatgtcatactgtaagaataagtatctttccaaaaacttgagcccaggagtatgatcacaccactggcactccagccttggtgacagagcaagaccccctctcaaaaaaaaaaaaaaaaaaaaaaaaaaaagctaggtgatagtgtgtgcctgtacttccagctgctcaagaggctgaagtaggaggatcccatgcacccaggagtttgagtttgcaatgacctaatgatcacaccactgcactccagcctgtgtgacagagtgagaccttgtctcaaaaagagaaagagagagagagatttctgggcagtatgtaacattataacttcactgcaatgccatatttgcaaagtttaataatcttggcagatctagattgtatttgagtattctaaaattttgaaatcaagtagttttaatcatagatcacataattatcttgtattttacctaaatatgactatcatttttctggtaaatagggcaataagatgtaagaaaagagcagggggactttggagccagaaagtcctgtttacatacttcatcacctttgaactgtatgaacctgggcacatcacttaaactctgaaatacagtttgtttttttattattattatactttaagttctagggtacatgtgcacaacattcaggtttgttacataggtacacatgtgccatgttggtttgttgcatccatcaactagtcatttacattaggtgaaatacagttatttaaactataaaatgggggacgatgatatctacctgatatatttgcatacctcacaaagtagttcacaaaataagcttgagaatgtttaatatgtgtttggcatacattagacgttcagcaaagtgtggttttttaaattgctcatcactagaaatacacttttctttacactacatttatatgaaatgagtgatgatgattcccttaataaattgttctcagaaggatttcaggttctgataatatttgattagaacttaatttgtaaattgtatttatttaggtatattgtgggtttaatgttcttgacttctgtgactagtacactcattgggttggaaaattggttccatcttagaattagtcaaataatattattccaagatctcttttgtagaaatatgtatcctattatgtacactagagaaatcggactaaatgaaaaatactcttcttacaaattaaattatatgcagtcatcttcaatcattaatgaagggacgtttcatgtccagaataccatatttacatgaattgtttttgataccctttgagcagggttatttggaggaagttgggaatacaggcaatatagagtcaagacaagtagataaatatactttgccatgtatagaaagatgaaatgatagtaatagggtattcactcttattatagatttcatctgattattgaatactttttaaccaagtgcttatatggtttatgacatttattttaacctcgttaattacttgactgcaactccataagtcatttaggcacattgaactcttataattttcatgaacttttatgagccatcagatttttattttttatgaaaatattcaatattaatgtttttaatttatatatttccaaattaagtacaagaataaggtattaatcataaataaggatgagttgttcttttatatttcatcaacctaatgttcaccacaaggatgagtttttatgtgaaggccattttatagtcacatagtgaaagttacctttcctctgattctttctgaatagcaatgttgttatgatgtgatacctctataaaacattttaaaatttaaaatgtacctcacttgtactttcccagatctttaagttatctgtacagatagagtaaatttttctgtgaatgcagaaagaatacattaacatagtctgtaggttaaataacttcaacaaatgccacaataaaaaaggacattgagagaagttgagcttttttcagttgaaggagtctgttaatctaatcttcatgtttcaagtcatttatttactttcatatgaaggtttacttagtgttagaagactaatgttagaagaggagataaatactctaccctttagttatcaataaaataattatctaaatttaaaaacagaataatttattgttaactattaatgatcctgatattctgttaagtgttcctgttctaactttggaatatagtgtgttttagtttagttctggtgaataatcttttatagccaatttgtatgatgttaaacttttcagatttattaatattgataagttttacatttattataacataaatatgttttgaaacagtcatgtattaatggtattttaagaattcaatacatatgagttcaagtataacatttgcttatctgaattagagaaaaattaaacagcagtggctaaataaagtactagatgaaactataaacataattattataaaatggtaactgataactgattcatgtaatactgacagttattacaaactgataactgataactgattcatgtaatactgacataatcactccttaaaggaatattcattgctttgtatcatatttgaagaagcagtagtcccccatccctgtttttactttctgtagtcaaccattatctgaaaatattaaatggaaaattccagaaataaacaattcataagttttaaattgtgccttgttctggtagcatggtgaaatcttgctccatcccattcatcccacccaagatgtggatcatccctttgaacatacagtggatctacaccatatactctgtccatctcatgttcatttagtagctgtctaccttatcagatcaaaaaaccatagtgtatatagggttcaatactatttatgatttcaggcatctactgggagtcttggaacatatcccctgtggattaaggaagactactgtattcataaacatccatttcgttacactgataggctacagtaaaatattttagaggacacatcagaatgcttcatttcaggatcaagaaaagctaattgcaatttagaagtatttaatttgaaagttattgcaaatgtcttgatattaatcttttaattaaaaaaattttttagagacatggttctcagtatgttgcccacagtggagtgtggtggcaattaataggtgtgccagttgtgcactatatcctcaaactcctgggctcaagcagtcctcctgcctcagcctcccttgtagctggaaaccagccaaatgggaagaactctttttttttttttttttgagacagagtcttgctctgtcgcccaggctgtagtgcagtggctcgatctcagctcactgcaagttccgcctcctgggttcacgccattctcctgcctcagcctcccaagtagctgggactacaggcacccgccaccacacccggctaattttttgtatttttagtagagacggggtttcaccgtgttagccaggatggtctcgatctcctgagctcatgatctgcccgcctcagcctcccaaagtgctgggattacaggcgtgagccaccacacccgacctaaattgttttacttgaaaatgaatagggcttaataaataattatttgaaccattttaaggaagcctttcatagaagagattttattgaggtttatacttctgaagagcaaacagaaactgcacttagaactttaattcacttaagtgaaaatgtatatatgtgtcttttgcattgtaagcactcagatttgtgaggaatgattggcatttgaaatggtcattatgtctcttagatattttaaattaatctctgtatctgttttcgccaatgatgcattttccctaggaataaaagacatacacgtgaatacagttaacagaaatattgttagctaaataaaattatgtctaagatcataatatatcaggaaattgtttttatacaggtaaatggttgcagttttgtgatgagaacaggaaagcctacaaatttattaagggtacagtatttaaaactacttgtgatactaatgttggatactatttaaaatcatctggcttactaacaaaactttttcctgcatgtacttctttctgtgtgtgatttcaaattaattttaatgtttactaaaacaaagttatctaccatttattataaaactcaattgtaggccaggcgtggtggcttacgtctgtaatcccagcactttgggaggccgaggcaggtggatcacctgagataaggagttcgagaccagcctgaccaacaaggtgaaaccgcatctctactataagtacaaaaattagccgggcatggtggcagccgcctgtagtcccagctacttgggaggctgagacaagagaattgcttgaacccgggaggcggaggttgcagtgagctgagattgcgccactgcactccaacctgggtgacagagcaagactctgtcaaaaaaaaaaaaaaaaaaaaaaaactcaattgtaacagaatttgcggataacctgtttatgttcttgaggtaaatatgttaacgaagtaggttgccataccataatcttccaggtggtgagtgatgttttaaagtggaccttgctatggatttcagtatttgaatctctctccctaaggaatattgctaatactgaattctttaaaatcttggattgatttaggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcaggtatgtttattttctgtggcttttgatttgctactcacaaaaacaaaaacaggaaatgtgaataatagtagtctttaaagatggggtttttaaaatttttttttaacttttttcttttcttttcttcttcttcttcttctttttttttttccatacagggtcttgctctgttgcccaggctggagtgtagtggtgcaatctcggcccactgcatcctctgcttcctgggctcaagcgatcctcccacctcagccttgtgagtaactgggactacaggcatgcactaccacacccagctaattttttgtagagacagggtgtcacctcagattcctggactctccttggcctcccaaagtgctaggattacaggcgtgagctactgtgcctggcctaaagaagggggttttaaaatggtaacttagtgggacacagtggcatgcacctgtagttctagttattcaggaggctgaggtgggaggatcacttgagcccacgagttcaagtccagcctgggcaacattgggagtccctgtctcttaaaaaatcaaacagaaaagtaaatgataatatcactcataatttttgtctttatacattgcataaacaaccctgtttaaaagtaggatttcattaacagggttaatataacacagactcttttttaactttatgatagctagcctgaaatcactttaataagacagatgtttttgtaatcagcctgagagaaaattatggtgcaaaccacatcaaaatattataacttaagtccattaagaatgtcagcaagttgggcatggtggcttatgcctgtaatcccagcacttcaagaggctgaggcaagaggatagcttgagtctggtagtttgagactggcagggtgaaaatagcaagaccccgcttctacaaaacatttaaaaattagccaggcatagtggtgtgtgcctgtagtcctagttacttgggaggctgagacaggaagatcactgcagcccaggagattgaggctgtagtgagccaaaatcacaccgctgcactctagcctgtacaacagagcgagaccctgtctcaaaaaaagaacagaaaaacgatgtcagtgggtccttgtaagtaacctcttgtggttagactaacatctgtggttagactgccataactgtctatggcagtcagttatgaaaacaagatgaagtaggacattgatgaggatgacaaaaatacatatcagtttcatcctcttcagaaacaagttggaattaaacatgtctagggtggtgttgcctgggaacagattaggggcacccctaaatataaaggcacttgtccttctataagtaaatatatggataagccagatcaattttttccttagttcagataaattttttgaagttgatttggaagcaccaatttctgtaagttaatagttttcaaatgtggaaaatactgattacaaagtgtaagaattatgccaatgtgttttgaattcttattttgaaaaagttacctgtaataatagtcaattaaaaaaaataaatctagcacttactattttctttcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaagtaagtattactaatgcaacaaaattcattatttttttagtaatgaattttaaaaattcactttcaagaacaaatctaaatttgttaaaaaagccatttcgtattatatcatgtatgaaaaattagtgaatatgtgttgctatattaaccaggaatttaattcatacttcttaaatggttctctactaatattttcttttcatttcctccctgtctctattttgaaatcttacaaattgtgtaaggttgattgagggtatttctgcagaaattaacctgtagtcacatcctacctttgccaattctggtatggtttattttagttaggttctaaatgataacaaaactaaatatattccattttcctttaattagagccacaggaatctaactgcattaatcagaatttctgatggcaagtagcaaaacaatttgaaatagtttaagcaaaagggaggtacttagtgtaaggattcaggctgtttccagaacccaagggcagaaatacaaccaggcctctgaaagggattggaactacaaactggaaagccatagggaattcgggaagtactgtctttgatgccccacttttcttcgtatatctgcctcagtctcaggagacctaggttctctgctgtatcatggaaaagataagtttattggctcggcttgggtatacctatctagtcagccaaggtagcatgtttgctagggtctcaagcctgcagagttcccagagagctattgcagggacaccccaaaggtgtctgttccctaatacagtcacttcagaatttaacgttttgaggtttctttctattttcagttacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggtatgtttattttaaggaagtcagctaacttgtagaagctttagagtttcaagttttttatgcaagtggtttttttttgttaggcacatgaatcacaaaatttcataattaagctctttgtgtaatttatttcaaaagcaaatgggaatctcagtaatgtagtttttaagataatagtcattactgagttccctaaaagtgatcagcctatgttaaactgaattagcaggaaaatacaaatttatagctatagttttttttgtcatttataattatttccacttattttagccatggttgtgaaattcagaaaatattttcacaacagagagaaattttatggattttaatgagaaaaaaattgaatgtagtcagttatctttatttacataagttatgttccataaacttaagtgtttctgggaacacttatttagcaaataagttctctggtgggggattgttgggaggaatatgtgtccgtgtatgggtgcgtatattttacatatatgtgtatcacattgattataatcttaaatcataaaactactcatcctggaagattctttttctttattttttaaaagggaaatcaaggttcagaagtgacttgcctgaggccaccccactaacaggtgtcagactgggattcagatcctgtcagttgccccagagctggagcttcctgtactacactgcactacctcgggtcctctccatccctctggtcctctctataagggatgaacaaggcagtgtggtcaccttgtttgacctcagctagaagtgtatgtccagcaactcaaattttttgtcgctctgtgcacacctacaaatgactaaaagcaccatgagcattgatttgggggttacaaataaattttagcaagaactcacaaatatggaatctacaaagaatgaggatggattgtacatgcaatataatactttttataaacttaggaggttcttctgcaagaggttgagaaattaccaagacaagaatattgcttggatgataataataatagtagtagtaattagcatttattaagtgcttactgtgtaacaggcagtattcaaagcatcttatattaactcattgaatcatcaccataggcctgtgcaatagaagtacaattatcactcctattttctaagtgaggacaccaacacaaagcaagatgaggtaaattgctcaggtatacacaggtagtaagttgatagagccagatttcaaatctaagttgtctgactccagagactgcttttaaataatagggaatgtacaaattgaagacaatgaaattatgaaaaatacatgctttaccactaaggtaatttaaaaattattaggtaaatatttacagaacacctatttttgtagcaggcccttgcaagaaatacagtgaggcttaaaatgtgcccttttcttcactggaactcagatgagtaggagagctgtggcatgtacaaaggacaccacaaaacagggataagtgtgggcaaaaagtgctttgaaagttctgaataggtctggcttcataagagaagagattcagggtaagctttagtggaagagtttccatttgaggtaagtttataaattgggacaactttttaattgtattttgtttccccaacaattggcctaatgcctggaacatagtagctactcaatactcactttgtaaacaagtgggtaaattaaggatctcaactgatagaaatggggaggactttttagatagagtgtggagtaggcataaagactcaggatgaaacatgttaaaaatcagtaaggagcaaaaaatggtgtaacttgtctagaaacagtaatctttgaaagttaatctttccaggaggtaagagtgggaggataatctaggactaggtgagaagagcctggagattggattgtattatatttactctgtgggcagtgtaaattgagattatttaaaattcaagtaattcattttgtagggggaataacctttgttatttgaatataacaagaatacttttatcaatctgtttttcactatatacatttttttaaatttttattcttaagaaaatgaatccccccaagtaataattctatcggcagctgagatattagggtcagctaaggcattggggtcacaaatgaaatggtcttggttccctagaccagtggtccccaacctttttggcaccagggccagtttcgtggaagacactttttccacagacatgagggaggaatggttttgggatgacatcaggcattagttagattcacataaggagcttgcagcctagatccttcacatgcacagttcacaataaggttcgagctcctagaagaatctagtgccgcagcagatctcacagagatctcgctggtaatgcttgcttacctcctgctgtgtggccccatctctaacaggccccaaccggtaccgggtctgcaacctggaggttggggaccccttccctacacaactgtgttgatgatcaaaagctcattctcattgtcctaatcctccaaacttcccattggtgccgtagcatagtatttccccccatctcaggtgtatttccaaaagatagtgtattcaaccacagggctctttttttttttttttttttttttttttttttttttttagaattcagagtaagtggtttaaaaccatgtactttgaaataagtgatactaagaaaaataaaccataaatttgtgttgtttaacggttgaaagaagaattattgttggttgttattatatcaggtgttggacaattttgaattaaatgattaaatgatactgttttatgaaggccccactcccctatataaatcaggaaacagaaaagttaaattttgtaacattaacatttttcaaacttagttacttatttaacagtttaactggaattgaccaccatgaactgattttactttctcatagattccaaatgtgttacagatttctttctagtatgtaaatatattacactcgtatatattaatagtacagtaagaataaaatgctttaataggtgatgttttattttagcatattctgtgagatagaggaaataataatatttatattgtatggatgaaaacactgggattaaaggagattaaactgatttattaatatcctattgtagtgcagagtttgaagtaagaaggctcaggacttggtaataacatggtaatattgggtgggatatgtgataccaaggcacaagctgatagaattttgcccaagaggctgcataggataacattcattgccttggttaatttatatagtacagaatctggccttcgacttgtaggttcagaagtctgatttttttttcccctgtcaactgagacgagctacctcagaagtgaactcagatttttcaaagttaacgaggctaattttttttgtttgttttgagacagagtctcgctctgtctcccaggctggagtgcaatggtgagatctcagctcactgcaacctctgccctctgggttcatgtgattctcctgcctcagcctcctgagtagctgggatcacgggcgcccagccccacgcccagctagtttttttatttttagtagagacagggtttcaccatgaggctaatgtttaaagcttgaataagattattaatttacaatgagaaatcattatcacagagacctaaatatttcaagttcattggattttatattatttccatgggcaaatgaattttaaaagccacataataattagaaagttatttagtgaccatgagattaaaaggttttagaggaatcagatgttcaggggcattaggctgagataacctgatctatctatctcacagtaggaatggtcatgcctatagatgggaattcttaaatgctgtttgctgcaacccctgacatttctttctacatttggtaatgttttttctagagcaaccaaaattctcaaaggctgtacttgaatgggcactgccaacatttccctctgaggcttttctttttctcagccttgacatttcttctttagttatgttcattcattcattcattcattcattcaaggcacctttaagtcctgtttgcctgggactcctgtctctttaaaatgattttacttacctacttatgtcctgatccattctgtagatttcatgtatttatttgtttttgagactatagccctctattacttacagaggcaagtaagttactgaagcaaaactttgacctagggcctctgcttgactttgtcatgctgaagtaatcaccataacagatatgccttggcctgtgtctgggcgtagccctatctccattccaaaatagaatcccaaataagaactgggggagagtatctgctttgctttgaaaattctgtttaaaccaaaagtcctaggaccaagttgttatgccataaatggtatagttgtcttagatgtcacttgaggttcagccttttaagcattgcatatctctaaatttctgactgacttaagagcccaggactgaagttaagacagaccgttaggagtctgtttttgttgtttttctttttccatagcccttgcccatgacacacattgaagtcaccagaatacatgtgaggaacttttatttatttttatctttctgaatgtgtctagagtatatgcagtactttagctatagagaatactaaatatttagaatgttgatcagttaataagaaaaatgaaaatgtaacagtttggagacatctaaaatcagactgggtttttaaactaaaaattttaatcacagaaatgttaagagaaatttcttctaagaaggccaaaactactgtagtgtttgctcacaagtagtgttggttacacgagttctaagtgtcattattgtggaaaaaattgaggggcaggaccaacatttactttttgtagaattttttaaaagagaaacttctgtcagtcttttggtaatgagatgaagcagtataatttgccagaagctaaaaatgccattcttacattttcattttttttcctaaaggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacaggtatgtttacttcttcatatatggtaaagcacaatgaaaaaaatgtacatttcacactaaggtttcaccttcatagaacataagttcatatccttacaagagaatgaaaatgaaccctctgatgtaattttaacttgagcctatcatttatttatcatttaagtacttttttttttaaaccattgttgcctttctttcagttaatctatcttgtatattctgctcaggaaataaaacactaatggattcagattttctttggaaagacaagagtttgtataactttatggagaatctcagcattagaaaagttattaatttcattttgtaatttttgttataatctcaaagattggtttcagcgtttttatttcatagtgatgttttcaagtctctacaactgaaaatgaactcctaagctttttaatagtctctatagttgttaggtggttatgaaattatattttcctgggagaaaaaaaaacctttgatttaagtcctagagttttttcagagtctttattatacctgaaggggaaaaaacagtattaactctaaatatagttaaagaattatatgtatataataatagatcactcctgataatttatatttgccagatactgatattaaaataacaggaaaattctgctatctacaatgtaatggtgctaactaaagttttatgtgtttcttcatttttctaacatatttattgactctcttggcaagtacgaatatagtggccaacaagagagaggtttctggtctcaaagagcatatattttagtgagggaggcagatgataaatgaaacaagtaggatagtgagaaatagtgataaattctctgaagaaataaaacaggataatgtgatagggaatgatggaattatttctgagggctctgttctgttccattggtctatatctctgttttggtaccagtaccatgctgttttggttactgtagccttgtagtatagtttgaagtcaggtagcgtgatgcctccagctttgttctcttggcttaggattgacttggcaatgtgggctcttttttggttccttatgaactttaaagtagttttttccaattctgtgaagaaagtcatttctgtgaagaaagtcattcctgatgggaatggcattgaatctataaattaccttgggcagtatggccattttcacaatattgattcttcctatccatgagcatggaatgttcttccatttgtttgtatcctcttttatttcgttgagcagtcgtttgtagttctccttgaagaggcccttcatatcccttgtaagttggattcctaggtattttattctcattgaagcaattgtgaatgggagttcactcatgatttggctctctgttcgtctgttgttggtgtataagaatgcttgtgatttttgcacattgattttgtatcctgagactttgctgaagttgcttatcagcttaaggagattttgggctgagacgatggggttttctagatatacaatcacgtcatctgcaaacagggacaatttgacttcctcttttcctaattgaataccctttatttctttctcctgcctgatttccctggccagaacttccaacactatgttgaataggagtggtgagagagggcatccctgtcttgtgccagttttcaaagggaatgcttccggtttttgtccattcagtatgatattggctgtgggtttgtcataaatagctcttactattttgagatatgccccatcagtacctaatttattgagagtttttagcatgaagtgctgttgaattttgtccaaggccttttctgcatctattgagataatcatgtggtttttgtctttggttctgtttatatgctggattacacttactgatttgcgtatgttgaaccagccttgcatcccagggatgaagcccacttgatcatggtggatgagctttctgatgtgctgctgcatttggtttgccagtattttattgaggatttttgcatcgatgttcatcaggatattgggaatgttggagagggtagtaacaacattaaatatggtggtcaggaaacatctctaggaggaattgacatttgagctgaaatctgaatgacattgaaattagagcaattgtaaagacacgggtaagtttaaagaacagaatgaaggcttgtgtagttgagtttgagagagcgggagagtggaagaagagtttgaaggaggaagagaccagaccttggagaatcttgcagactttggaagccattggaaagttttctctttttattcctaaatatatcatatttatgatcttatatcaaatgtcgagatattttatatttatgatttatatcaaatgtagagatattttatatatttacttgcctaaatagagtcaagaaattcgaattgcttaacgatttttttgtttgtttgtttttgagaccgagtctcactctgtcacccgggctggagtgcagtggcgtgatctcagctcactacaacctccgcctcccgggttcaatcaattctcctgcctcagcctcctgagtagctgggattacaggcatgcaccaccaccacgcctgggtaatttttgtatttttagtagagacaaggtttcaccatgttggccagtttggtctcaaactcctgaccttaggtgatccaacagcctcggcctcccaaagtgctgggattacaggcgtgagccaccatgcctggccaaattgcttaactgttaatgttctgttaaatgtctggaattgttttcaaaaccaaaatgtatggcagttacttgtgaaaatgtcacacatcttttaaaattttttaggaagcatttttgggagaagacctgaatttgaccctcagatggtcaaattttcttattaggaattctaattttctttttctttttcttttttttttgagacaggctctcactgccgtccaggctagagtctcatggcgcaatcacagcatcctgcagccttgacctcctggactcaggtgatcctctcacctcagcctcctgagtagctagtattacaggcatgcaccacacacccagctaggtttttgtattttttgtagagacagggatttgccatgttgcccaggctggtctcaaacttctgggcttaaatgatcttcttgccttggcctcctgaaatgctgggattacaggcatgagtctttgtcaccagccagaattctattttctgtactaaagagatactaaaaagatacttttgatggcattcagattccctctatttgacattgactacataaagtaaagcctgtaaacttcctgcccgttcatcattaccaagacaaacctttattgatgggaagggaagttcacagaagaaatcgagcagtgacttacacaatagtaacacctaagagcagcctaaatatgcttgaaataatgtggatgccacacagatatctctaatacacttaggtagtttgggcagaaggagaaaaataaaaacatcatagaagtcttttcagtgttgggatgcaaggaagaaggaagagtggcaggaattttttagatactgattaattattgatgctgggagaggtcatagattgaagtgtatgtgtttaaaattgaagatgattattagaatcaaaagagataccggagcttagaaactacaggaggaaccactagaatatcagctccttgagaacagggacccagtctcctgtatctctaatgcctagaataatgtctgacacatgataggcagttaataatttttttaaatgaatgaatgaattcatgaataaaagggggggaataaataaagcccacttaccaagaaccaacagtgaaatagcacaggccttcatgttagagtcaggaagaagatcagaatagcttttgtcacttgcttttctattgtgtaggtcctaaccattgcaaagacaaaaagatatatggtatgaatggagaaaaagatacttaattgtcataattcccatgtataattaaattaaaaattaagcatgagaactgaaattctttttttttttttttttttttttttttttgagacagagtctcactctgtcacccaggctagagtggatctcagctcactacaaactcagcctatcaagtaggtgggattacaggtggcctccgccatgcctggcaaatttttgtatttttagtagagatggggtttcaccatgttggccaggctggtcttgaactcctgacctcaagtgatttatatctttaatgtaaaataaatatgaataaaacaatgtaaataaaattataacactttaatgaaggataggaggcttgaataaatgaaaagtctcatttctgagtgggaaaatttgaatatcgtaaaaacccaggttatctctagattaatctgtaatccttatgtagttccattccaactcacaatgaaaagttactgaagttcaacttagtaattggtttatagtttatctggagaagaaatgcacaagaagagtcaataatatttttgaaaaacgcagaatagtaattggtgtatagtttatctggaagaagaaatgcacaagaacagtcaagaatatttttgaaaaatgcagaatgcatttaacatgatgtgttgaacaatgtttagccttaaatatattgattttataaatattgaaaacaagttaagctgttagttctagaggctagaatatcagagcatgtagacttaagaaaagtaaaaagaaggaaataataaagttaagaacaaaataagcaaagttagaataaccaaaacaggaggaaaagttttcaaggattttgaaagtttattatttgaaaacactagtggctggccgtggtggctcacacctgtaatcccagcactttgggaggccgaggtggacagatcacaaggtcaggagttcaagattgacctgatcaacatggtgaaaccccgtctctaccaaaaataaaaaattagccgggcatgggggcgcgtgcctgtaatcctagctactcaggaggctgaggcaggagaattgattgaacccgggaggcagaggttgcagtgagccgagatcgcgccactgcactccagcctaggcgacagaaaaaaagaaaagaaaagaaaacactaaaagtattagactttcaagaatatgggccagcgggcgtggtggctcatgcctgtaatcccagcactttggtaggccgaggtgggtggatcacgaggccaggagatcgagaccatcctggctaacacagtgaaaccccatctctactaaaaatacaaaaaatcagctaggcatggtggcatgcgcctgtaattccagctactcatgggggctgaggcaggagaatcccttgaacccaggaggtggagaatgcagtgagccaagatcgcatcactgcactccagcctgggtgacaaagtgagactctatctcaaaaaacaaagaatatgggccaggcgcggtggctcacacctgtaatcccagcactttgggaggccgaggcaggcagatcacgaggtcaggagatcaagaccatcctggccaacatggtgaaaccctgtctctactaaaaatatgaaaaattagctgggcatggtagcgtgcacctgtagtctcagctactctggaggctgaggcaggagaatagcttgaaccctggaggtggagtttgcagtgagctgaaatcacaccactgcactccagcctggcaacagagcgagactccatttaaaaaaaaaaaaaaaaagaaaatgatcgggaaaaaaagacataaaccaaatgaggcttgatgcagttgctcacacctataatcccagtgcttcggatggctgagacaggaggagtgcttgagcccaggagttcaagaccaacctgggcaatatagcaagatgcctgtctccacaaaaaattaaaaaatcagccagatgtctgcagtgagctatgattgcaccattgtacttcagcctgggtgacagagtgagaccctgtctctaaaacaaactaacaaaatcaaatgaatgaaaatcaaaacctacgtatagataccaaagagattcataaaagtcataaaagaatactataaataaacatccatcaacaaatttgaaaatagacataaactgatggttttctggaagaatataaactaccagaatcaactcaaatagaaatataaaacctgaataagccaataacaattaaagaatttgaaatcatagagattttccctctctcctctcctccaaccagaaatattagactgagaccatttcacaaatgggtcttaccaactctcaacgaatatataattgcttaataaaataggattaaagggagagaactagggggaagaaaagaaggaaagaagaaaggtaagctagacaaaagaaaaacccagttatctaatgagactggtacaatattgatacgaagacctgataagaacactacaaacaaataaaattatagatgaatcttacttatgagtggctgtagaaatcttaaataaaatattagcaaattattctaagaatggaagaatagttcaacatctgaaaaatccattaatgtaaacttcacattcatagatagcaggaaaaaaaatccatatgataaattttattttttattttgttttgtttttgagatgaggtcttgctctgtcacccaggctggagtgcagtcagacaatcacatttcactatggctgcaacctcccaggctcaagtgatcctcccaattcagcctcccaagtagctgggaccacaacaggcacatagcaccatgcctagctaagattttttaaaacatttttttacagacaggaggatctcgctgtgttgcccaggctggtcttaaatgtaggggattggtcagggtggtgggagataaagataaagttataggaaatagacacaaaccttcttgggaggccgggaggtttgcatagcttcagtgaaagatttggttgaaggcagctgaattctcttaaaagcttagggcttagctacataggaatataagggagtttatctaaagagcttgtttactcatgtggtcctaagaccaacctttgatcattcgcaggactgctctctggggagggtgaccagataattacccacaagtgtgttgactcaaagcctttgtcattaaatctatgctgaataaatgcccgcagggccagctagtcagggcgtgcactactgcaattcttttttgtgagcggcccagccccctagccactctttcactgaatactggtgtctgagtacgttattcatctgttatgcagcctgactctgcaggtcaaaccctggcacttaaactcctgggctcaagcagttattccacattggcttcccaaagtgctgggattacaggagtgagccatcatgcctggccttattttatttttttagagacaagtttttactcttgccaggctggagtacagtggcatgattatagctcactgcaaccttgaactcctggactcaggcaatctcctcatctcagcctcctaagtagctgggactacaggcacatattaccactcctggctaatttattattatttttttagagatggggtctttctgttgcccaggctggtcttgaattcctagactcaagcaatactcctacctgaacctcctgagcagctgggattataagtacaagttactgtgtccagcccatatagtcattttaatacatattggaaaagaatccataaaaaactaataactcataattttttttcaatggagaaaatccagaatagaagggaaatttcttaaccgcagtaattgttttcattaaaacatttagcagataacatttctaatagtgaaatttagaagcattcccattaatatcaagtatagaataaaatgtgatagaagcattcccattaaaatccagtatagaatcaagtataggatacccactttcaacatcactatttcaacattgctttgtagttcctagccaatgcaatttgacaagaataagaaatgagataaagaatatgaaaacttatttatgaataacaaaataaaccctacataagatgctttgaacttttgtcaagaaaattataaaacactgaagcatgtaaagacctcactatatgccaatatgtaccgtattcatagtggaaagatgtaaagaaaaatgtcagttctctccaaattaatctcagtattcagtgtacttccagtcataattacaaggaaatttttcatggatcttgaaaaactgattgtaaaattgatatagacaagtaaatactcaagaataatcaagagaaccctagaaaaatgtattgcatctgacagcaagatttactacaaaatcataatagacagtatggtttgatgctaggatggacaattaggtcagtggagcgtaatggaaagcccagaaacacattgagatccttgtgaaattttaatatataggaaagagaccctacaaatcaacatttatttaataatactgagtgagcctctactgcattctatgcactgttttagtccctggtgacataacagtgaataaaagcaagtagtaggcagggtgcggtggctcatacctgtaatcccagcactttgggaggattgcatgagcccaggagtttcaggccagcctgggcaacagagtgagaccccatctttacctaaaaataaaaagttagctgggcatggtggcatgcaccagtagtcctaactacttgggaagctgaggtgggaggatcgcttgaacccaggaggtcaaggctgcagcgagccatgattgcaccactgtactccagcctgggtgacagagtgagtatttgttaatttgggttgtgagtacataaatgtttattacttcattatttccatgtctgtacgtttaaaatcttttagaacaaaaaatcaaagatgagtcatgctagctataccaaatatcacaatttagtataaaactgaggtaatgaaaacattgtgctactttccttgaaaaagaaaggtagatcaatgcaacagcacgaagatagaaaaaaaattagacttcagttctcatgaatttttaaactcttgtagtcagtatatgcaaaaaaaagaagttaaattatttgatttgtcatttaagaatattataatgtttacatatgtttactttaagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtaaaatggtttctgacttataagtaccatgatccaaataagtattggatagagcccaccattctataattttttccttgtcatagaacccacagaggaaggtgatttgtttaccagttgttgatataatcactagacattcatttaagtgcttgagaaagctaaaatcattttcccataggaagtcacaatccattgcgaaagcatatataaaataaacaatttctccaacagaagaatgaatagaaagaatgggaggagaaaggagaaacatctagtacttcctggcaggatgagtagggtgaggtggtagacagtggtggggttggaattttttttttttttttttttttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggggttggaattttaaggcaggctctggagtctttagaattgaggtgtaagggtacacccattttggaaaattgagagttcaaggtgtgtgagaaagtagttggggttatagctggagagattggcaacagtttgattagaaaaagttttattctgaaagaagcatatataagccttatgctgttggtgataagacctactgcaggattttaagtagagtaacacaatatggtttttattttatgatgacaccactgcggtgagttgggggaggtaagagtagtgattagaacaccagttaagcaactaaagctgtcctttccataaacagtaagtattaactaaatgttaatgaggatggaaaagaagtttgcattcaaaagtagaaatttgagagtggcttaaataacagtaccaaacttttaaatttcaggagtgctttgggtttgaatttaataagattttaagcatgtgatatttttaatgatgtcctcttcaaacaggctagtgtttttcaaactagaggctaatgaataggtccattaatgggtggtgaagtcagtttagtgagtaatgatcaacatttttaaaaaaaaaaacaaagtagaacagaagacattggagtacatggcactacagtagaagaataaatattgatttctgagatttttatttcagttttacatagatgtatgtaataggttatgatatatgatgcatttttttgtgttgggttgtagtaaaaagaagtcactgctttgtaccattttgtggatagaaatggaaaatctcacaaagtttctgagacaatgttgagcaatggaaaataactcaaagaaataaagaatttaaaatgattcttattgcaggggagcttccagttgaaacataagttaaatatgatcatagttcttaagtatgtaaattgaatttcttaatccattatctgttctattaggtgatgaaggaaagcctttacatctgctcattggaaaacttcaaaaggcagtgtctgaagaatgttcttattttttacaggtaaaatgtttaaaagtacttttatggccagatgtggtggctgacacttataatcccagcactttgggaggctgaggtggtcagatcacttgagttcgagaccagcctggccaacgtggtgaaaccccgtctctaccaaaaaatacaaaaatcagtccggcattgtggtgtgtgcctatagtcccagctacttgggagactgaggcattggaattgcttgggcatgggaggcagaggttgcagtgagtggagatcatgctactgcactccagcctgggtaacagagtgggactctgtctcaaaaaaataataataaattttaaaaaataaataaaaggtacttttacacaaggagtgctaaattgtaagttgctactaatttaatgatcacccagcctagttttcttcactaccttcagaactgtgcctagaaagtattcctgagtttttaacttaaaatgagcattaaaaattttcctgataatcggtttgaaacaaaagaaattcaggtaaattatctcgcctgtagaacagacactaattgttgatgttgccatagatgagttataaggacaagatggagacatcctgggagacggtgtagagtgagccaaaacactaagatggcacccatctttctgggtcccagtttctttgtctgtaaattgggtgattgtttaaggtttctaaaatcaactctaatgtgagaaaactgcatcttaggggctatgctgaaaatttaataaacttaattattaattgacagtatagtttaagcaaatctcaagaaatctgaagaaatagcaataaacaatttgatttttaagtctagaagttggtggtggtaattttttagttatatgaggaacaaaggtaaaagttatttgagagcttatcaaatgataatgggacatgtattgttttaaatgatgatagaagtgtctgttgctcaggagaagaaccggaacaacgcgtcaaatattttcaatttttgtgtgtgcatataaactacataaaactattctcatgtgttaggaattttttttttttttttttgagacagtcttgctctgtcgcccaggctggagtgcagtggcacaatctcggttcactgtgacctctgcctcctaggttcaagctattcttgtacctcacctcccgagtagctgggatgacagatgcacaccaccacgcccagctaatttttgtatttttagtagagatggggttttgccatgttggccaggctggtcttgaactcctgacctcaggtgatccaccttcctcgacctcccaaagtgctgggattacaggcatgagccaccacgcctggcctcttgtgttatgaatgttaagtatatgaatgttactcttttgcttgatatgatttctttagaatttatagatttctttctgatcagcatttctgaacgtccatccttgtcctgtgatgttttttcaaaggtatttgagattacagagataacatcagaaataggatccaagctaggaagtggttgattaaagtataagataaattttattattataaggaagcagaaaaaattatagttttgtgcaatgaagtttattatcttcctgatataagaagatttcatgccagagagatagatttagacttgtttcttttgcagattgataagggtatggagagaatgttttcttaattatttttgtgtgccattttgaccgccttgcatctaggagaattatgtttaatctttagaagcagaaatcaaaatttaaattccttaaaatacacaattttgttgttaacagactttatgcagtgtccttggtgaatattatactcctgctttaaaatgtgaagtaaatgcagaagacaaagagaattctggtgattacatttctgaaaatgaagatccagaattacaagattatagatatgaagttcaaggtaataaaagcttaccatactattaaacagtatttaatcctcttaaattaattgatgacagatttttacttttgattatgatttaatcacccagccaagttgtttttcatcttaacattttatcctcctttcagattcatgaaatctcatatttaatacacattttaaatttttataatgcgataatggtgatatgaatataattggagctgtccactattgtctgtcctctgtctctctactcctatctttttccttatcctaattcttttaactttttataccatagatccaaatttttaaagttattgtatttattgaataagttcatatcaatggtttttgctttaaaatgagtaagataaacattaagaaataaaaaatatattagtatctttcttaatatagatctgctataagtttgttttaacaaatagtaacatcaccacttttttgatgttctttcacagagaaaatgtttcctagccctgtccatttgtataatgaacaaaatgtatataaattaatgactaccaaaagaaattaacatattttaatatgaaattttcaagttatctttgtagcaggcatttcacatgaatgagatttcaattttcagttactaaatatctgaggtttacttctagcaggcaatttttttaagttataaataggtgaataatatttattgaaagatgcagacttttactgtgaagtgaaattattgtaattgtttgtttaccatccagactttcaagaaaatatgcacactcttctcaacaaagtaacagaagaatacaacaaactcttggtacttcaaacacgactaagcaaggtctgtgagatggaaaatatattgtaatatttgcatttattgtattgtctgcttttttgtaagctgcttttatcaaccaagaatttctaaagtaagagaacatgaaaaaggagattgggaaaagtgacatatatttgtagtagataatttatattggtaagctgaaagaatttctgcaagtcgaataataacccctttagagagtttttagaattatgataagttaaaatatatatatcaacttgtaaactgtgtgaaacaattgcatttaattttacatataatgtaaaattaaagcagtgggccttctgttttagagaaaactggtaatgagtttagttgcttagcatatagctaattagtttcacacagcattatacatgtcaattttattttcaagcaattttttaaaagtctgtagaaaactaggtaagatagtatacatggcacagtgtaatttattaactcttatcagtaaaacaacttaaggcacatattggcaaggataagtgtaattctcatgtagaaggaaatccagaaagatgtctgtgtctatttatttggggtgctttttgatgttcagttaatattaaaatgtttaggcagatttgaaagatttaattgatagtgaaagttataatgttgatgatttatgttttggctgaaattcttcctctccatctctctccccttctttctttccctcctgtttcttcttgcctactctgtttctgtgcaattaagtacaaccttatctagcctttccaaaaatctataaacctactccagtagatttatatgagtagaatctcttttggtttcatctcttattttcttgttcattatggatttatgccttttaaatattctttatcattttaattgagtaatggaaagggaggaggtttatgtcagtaatcacaaatgtaaatgcctacattaacttagctaataaaataaatgaagaaggccaagtgaaacctggagaaaacatgcctcatccaaaaggagcggcggctgcccagcttgtgcatcgtgttgccattaagtaggaatcagggcccagtgttgctagtacttttaatctattaattttatatgatttttttttcttttaaaaatattaggaagtataaaccaggcatggtggtacatgcctgtcgtcccagctacttgagaagctgaggtgggaggatcacttgaacctaggagtttgaggctgcatgagctatgattgtgccactgtactcctgcctgggcaacagagctcaagacctcatttctaaaaatataacacacacacacacacacacacacacacacacacacacacacacacagagaaatattcaaaactaaatgttctgttttaaggttgggaaacagaaagcagccagacaacaacaaaaactgttttgtccccaaaagagcacttttatagactggatttaaagttcaagccttcactttgtaacctcagatataaacacatgctcagtgtactatcttgaactagttttctttttactttattatttctcgactgtagtatttgctgctttctgataacattttcttcccttagcttctgtagcttttcaagcctccattttggactttacctaccctgtttatattaccagggatctttatttgatcctcgtaatctgaatgcttttttcatctactttcattgcttctagatctctatgtttaggtcagtccttctgagctgcagagtcatatatctcatcagatatctctactcaaaaatcttttaggtatatctcaatcagcatattgaaatttgaatttattaactactgctgcttaaaccagcttctcctctcatatcagtttcaaaggaacaacattcaaccagaaacttggggattgtcttagatagtcttctcttttcactcctggtcttctaccatactgaaatatacactgaagggagtacaaagaatatgaaagaaaaatttatactttgttctcattcagttatacagtcaacaatttttatttttattttactttcctttttttttttctccaagacagagtcttactctgttgcccaggctggagtacagtggcgtgatctcggctcactgcaacctctgcctcccaggttcaagcgattctcctgcctcagcctcctgagtagctgggattacaggcacactccaccacacccggctaatttttgtattcttaatagagaagggctttcaccatgttgaccaggctggtctcgaactcttgaccttgtgatccgcccaccttggcctccctaagtgctgggattacaggcatgagccaccacacccgacctacttatttatttatttatttatttattccttagatctgaggacagactggtcagccaatatttattatttgctaattaaatgccaggttgttctgtgtactgagaataaagtaatgaagtcactagactgaagaaatgtgtaaattaatgggatttatgaactagtttaaggaatgtcatatacatatatactattttacatatatatatataatatatacatatgcatatataaaatagttttccttggcaacattttagtaggtgtttagaagagaaatgtaaggccgggcatggtggctcatacctgcaatcccagcactttagttggccaaggtgggccgatcacctgaggtcaggatttggagaccagcctggccaacatggtgaaaccccatctctactaaaaaaaaatacaaaaaaattagctgggtgtggtgacacgggcctataatcccagctactctggaggctgatgcaagagaattgcttgaacccagaaggtggaggttgcagtgagccaagattgcaccactgcactccagcctgggcaacagagtgagactccatctcaaaaaaaaaaatagaaaagaaatgtagataaatacgtttacttaacaggtagatgaatacagcaaacaggtagatgtcttttctgcacaaggggtaataagaggatatatatttgaatgcagtaaattagctgcaattacagaggcatttcagagttactttgggatcaggatcaggactgcaatacatcactgtgtaaccttttggcttcatcttctaatattcctcctcatttcagccatactgaaatacttagtttcccaaatgcaccctgatctttggcaccctgggcttctttgcatgctgccctttctgcataatactgcccatcccctcccagcctttttggtttgttcctgcttgttccagttggttcaaatgtttactccctctgtgtcatcttctttacctgtctttctaggcttaggcatttcttcctctgttcccttagcaacagtacaggccttgcttatcgcgtttctcttttttcgttactttaaatacttgattacccttctgtccttcttccatgttcctgtagctccttatacacatttgcatttgtatcacattacttttcatgttatataattgtttaccattctgcctctttcactattattctaaacccttcagaataagagaatcttctgtttatttttatttccttctcttaacacagtgttagcatacagtaaaggcttaataaatgtttgctgaatgagttagaaaggttggactggaaacttaataatttacctgatgatctttattttccctgggaactaagaggcaagatcctctgttgaaattactcatggggtaggaattgggtagaggatgtataagagtagtgaacagttaaaacagccttcttagcaaatagctgttttttcttttgctcagctgcttctacagtatcctttgttcatctggtcttgcaagtccatagtctttccccttgcttttaaagtcttctgttatttggatctatcttatttaactagctttatttccccctccgtatccaaattaaaccctcctcaagaagatcattgtcaattatggcatacgtcattctttcacaaatactcttactctttcttccttatagccttcccaaatcattaccagaaatatatgagcctaaatcaaaactgacttccataattactcagatccacatcagtcttctgtatcattgttgttatagtcaaattttatagtttagccgttctctaattgtttattttcccatctgattgatgaattctgtgcaggcagatatattgttattttttaaacggattttatatttttactcttgtcacagtgctggtcacattgattattaagtatttgatgaataaataaattagtacacacaggtatctgacatattgctgcttagttttatgtatttatttatttacttatttttttgaggcagagtcttgctctgtctcccaggctagagtgcaatggctcaatcttggctcactgcaacttccccttcccaggttcaagaaattcacccgcctcagcccctcaagtaactgggattacaggtgtgtgccaccacacctggctaatttttgtatttttagtagagatggggtttcactatgttggccaggctgatcctgaactcctgaccttaggtgatccagccatctcagcctcccacagtgctaggattacaggcttgctgctttttaatagttaaggaaataagctgagatttatctattttcattattttcttttctttttgtttactgtacagagcaccataccatttgtcagttacctggttgtacataggatatatctagagataaacaagctgtattaatcaagtattgctaatataaaatttattatgtatgaattgaaatttcaaagaccaaggtatactataaatattgttatcagctttctaccaaaattctcagaagcacttgtttttgtagtaaaatgaacttcctttcagatatcaaagaacattactaatataatttcagtgctatgaaaggtatggaatattaattactgttacagaagagaacagggaataacttagaagggaaaatgcttgtattagagtgccacaattttgggtggttttaaaaaagcatcttaaatgcagagttgctttaatacagctttctaattgctggattatgtatttatgttactgcttttattctgtggttttcaatagatctggggacagcagacagatggtatgaaacttgaatttggagaagaaaaccttccaaaagaggaaacagagtttttatcaatccattctcagatgaccaatttggaagacattggtaaattttgatcatataccacaatgtggtgtttttatagcaaatattgagtaatttgcttttttactttaaaatgtgagctaacgtagtgacctttggcatttcactgtagcctctctgatctcaattttttcatccttaaaatgaaagatttggactactttctatttggtcctttcccccttcttatgttctgtgattctgaattgttttaaattttaaagatataaaattttggatttaggagtactacagcatgaggatcaaaaagatgatcttgaattgtactatttatgttttcttgttttcatcagaatgagtttaaattgaaaccagagttattaccactaaaaacatactttttcaaaaaagaattaatattttctgtacacagtgattgtgctatttcactaagaaacttatattgaaatgtgcattttttgtctctttatataacatagatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaaggtattcatctgcttatagcttcattcaacagtatttgtagctttgtaacaattatagtatcatccagaatggttatttaaaaaagtaacttaagcaaagttgctggaaagagataggatgtagcattttttagaaagaagagcaagagatcattctatatctttgaaatgcctgaaaaaaatgttgatgtaaaccaaagacattataggaattttacttaaatttttacattataaagatgttggttgttgttaatctgcttaattaaatcggcagtgtgcacatatttgcagtttattctgtacctagtctttgctactttgatatggtgaatacttaaggaatataaggtaggatcattccagtcatggcagggtttcctccactttgttgtctcatgttcaaattcaccacgtccaaagtagaactctggctcttctcaaaatttgctccttctgcagctatatccatctgtcgttactcctctttctcttatacctctcttctagtctatcaagacgtcctattttctccaccttcaaaaatatatccaaactgtaccactccttaaaaccttgctggtctctgccatccttttgtctcaactggattaccctaactcccccctaaagtctgttctcaacacagttaaagcaggtgccagaatcttgcttttaaaatttaaaatagattgtatcattccaaagctcttctgtcctacatgatgagtacccattacttttctgatttttaatctcctactgacttgtctgtcactgtcttctgaccccaagatactggtgacagcatcttggggtccttaaacaagcattatcagtatgcttctgctttagggacttctcattggctgttccttctacctagaatggtcttcctccagatacatgcctggccaacaccctcaccttctttggatcattactcaagtgtcatgttctcgtgaggcttttcttaaccattctgtgtaaattaaaattgtctcctagaatgctgattcctatttctctactttattttttctatattacttaatattgtctatttatatgtatgtatacattatgcacattttatataatatatatcatatatataactaggctggtcgtggtggctcatgcctgtaattccagcattttgggaagctgaggcaggcagattacctgaggttaggagttcgagaccagcctggccaatatggcaaacctccatctctactaaaaatataaaaattagccgggcatggtggcatgcacctgtaatcccagctactcaggaggctgaggcacgagaatcacttgaacataggaagcggaggttgcagtgagctgaatttgcaccactgcactccagcctggatgacagagcaagactctgcctaaaaaatatatatatattatgtgtgtgtgtatatatatatatattatatatataaccaaatatgtgtaaatttggagggggtagattcatttttattttgtttattgttcgtctctggtgaaagactttaagctttataagggtggggctctttttccatttaggtcagtgatatatcacaaacacctaagataattccctgcacataataggtactcaataaattatttgtttaatgaatgaacagtttataatttagttgggaagtatgctatagtatataactagctctataaaaccctcagagatttcttctaactgtggctggctctgctattgtagcgcggatgtcttcctagacacttgctagtaaaacctcaacacagtttttttgtatagtggacgaaatactgaatgtctgcttgtttggaactagtcgttactcttttttatttgaaacctacatatgggctttggaattatttgctttagccttataaagcttccattttctttgagattggtggtttctaaacatgaccatacatcagaaatagtggaggtttttgaactttaatataatttttttaattacttacaatgaaagatcactgaattataatttggagagtcatactcaatagctttgagatggaacttggaaatttgtgtttttaacaatataattcagaggcacggaacccatagattgacatttggaaaccactgctttctgatatgaaacaaaataggtaattaggaagaactttctaataaacagtatttcaagcagtcttcctttaattagtgatgctttctgtccaaagcatgaagaaaagagaggcttctggaaacataggcttacattgttattcctgcatttgggcttctgcaagctcaccaccctctctcagagtttctataatactccatggaaatgtgttgacaaggcctttgaatgaaaatcattcgtttgctccctgcacccctaccaaaaagagttttactcaccaccgtcctcattcttactaatagtaatgagtcaaaattattttgtgtaaatagcatcacatattttggacatgactgtaacacattttgaatagagtatactgttccctgtgggtagacttgaaatagttaagaaaaataattgaatcattcttttaacaaatatttggtgatttcatactagaaacctctaagagaaacactaaggttggaaagatcatgggttttagtcagacggatctgcatttgaccctgatttgaccttttactggctatatgatcttggacagattatttaaacatttctaaatagtaatagggataataataattacccttaagattgtgaggattaaatgaaacagtaactgagaagagccttagctagataccctggaggtagaattagatgtttatgtaaagtggctgtttccttccagggacttcagtgtaatcactgaaataataattacttgcaaaataatttttcgaaggtaatggttggggaatataacatagtgatataactaaaatgctggaatttaaacccatgtctttgtggcgtttttcactgcacatctgtaatactgcctattagagtaataacagcaaaatggaaatgaaggatgaatatttagacattgcaatggaaggaatgttggaaacaaagcagaggggaaaaaacaaagataactctgtgttgcttgagcctagggaatatggaaaatgaaggtacatcatataaataggaaaatcaacaggggttgcagatagtaggagcttaattgcaagaggggaacaatgaattaagtttacgccagactgtttttttcagtttggagtaataaacactttcaaatactgtaaagcttaaagaatgaagtcgctctccctctccctctccctctccctctcttctctcttctctctctttccacggtctccctctgttgccgaggctggactgtactgccgtgatctcggctcgctgcaacctccctgcctcgggctcccgtgattctcctgcctcggcctgcctagtgcctgggattgcagtcacgcgccgccacgcctgactggtttttgtgtttttggtggagatggggtttcgccatgttggctgggctggtctccagctcctgacctcgagtgatctgcccgcctcggcctcccgaggtgctgggattgcagacggagtctcgctcactcagtgctcaatgttgcccaggctggagtgcgtggcgtgatctcagctcgctacaacctccacctcccagccgcctgccttggcctcccaaagtgctgagattacagcctctgcccggccaccaccccgtctaggaagtgaggagcatctctgcctggccgcccatcatctgggatgtgaggagcccctctgcccggccgccccgtctgggaagtgaggagtgcctctgcccggccgccacgccgtctaggaagtgaggagcatctctgcctggccgcccatcgtctgggatgtggggagcgcctctgcccggccgccctgtctgggatgtggggagcgcctctgcccggccgcccattgtctgggatgtggggagcgcctctgcccggctgccctgtctgggatgtgaggagcgtctctgcccggccgccccgtctgggaggtgaggagcttctctgcccggctgccaccccatctaggaagtgaggagcatctctgcctggccgccccatctaggaagtgaggagcgcctctgcccagctgccccgtctgggaagtgaggagtgcctctgcccggctgccgcgtctgggaggtgagcgcctctgcccggctgcccatcgtctgggaagtgaggagcacttctgcccagccgccccgtctgggatgtgaggagcacctctgcccggccgccaccccgtctaggaagtgaggagcgcctctgcccggccgcctcgtctgggatgtgaggagcgcctctgcccggccgccctgtctggaaagtgaggagcgcctctgcccggccgccctgtctgggaagtgaggagagcctctgcccggccgcccatcgtctgggaggtgaggagcccctctgcccagccgcccttcgtctgggaggtgaggaacgcctctgcccggctgcaccgtctgggaggtgaggagcacctctgcccggctgccccgtctgggaagtgaggagcgcctctgcctggccgccccgtctgggatgtgaggagcgcctctgcctggccgccccgtctgggatgtgaggagcgcctctgcctggccgccccgtctgggatgtgaggagcgcctctgcctggccgctgtgcaatcttccaagtgtgaagtgacagcctttctgcaggtgtacccaacagctccgaagagacagcaaccattgagaacaggccataatgacgatggcggttttgttgaaaagaaaagggggaaatatggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctgtgtcaactcagggttaaatggattaagggtggtgcaagatgtgctttgttaaacagatgcttgaagacagcatgctcgttaagagtcatcaccactccctaatctcaagtacccagggacacaaacactgcggaaggccgcagggtcctctgcctaggaaaaccagagacctttgttcacgtgtttatctgctgaccttctctccactattatcctatgaccctgccacatccccctctctgagaaacacccaagaatgatcaataaatactaaaaaaaaaaaaaaaaaaaaaaaaaaaagaatgaagtcattgtggactaagtagtactttttggagtttagatcataatgaccggatagataatcaggaggattttctaggctgtgaaagtaagatccaggacataaagccaaggatcagagcagtatatacaagggacaatgaggaaaacagagacaaaatagtaataaagaaaaagcaggaaagggcagagaagaaagacaagggaatgagtttttagaagcatgggatggtcatagaacatgagaaggcagttcacagcaggaaaaacctaaacggccaataacatttgaaagaaaatgtcttctcaaaaataaagacatacatgttctagcaaagttttacaattgttataacccccgattgctgaagttttaagaaaatacttaaatgatactattatgagaataaaattaataaaactttttggaatatgaccctgtattaaaacattaaatattaagcttaacaattacttataagattttattatgtagaaacatccatggaagtgtgccaagatatgtttgtggagatctgtattatagcattgtttgtaacagtgaacagttggaagtaatcaaatggccatcattaggggtttagttatataagttatgaaatgggatgatgacaactttggccaattttggacagaatttagggtagaaaagaataggagaaagaaggttatgtggacaagaggaaggtcaaactaagaaagcagcatagttacacatgaaaatgggtatggaaaattatatttgccagaaatgaaaattataatttgctccttttttttttcccatggatcctaaatgctgatcttaccttagtttttatgacctaagttaagcgttttaagaaaaaaaaaatttttaatcatgtaaaaactacacaatacagatgtgaataccaaaagataaaacaaaaaagtccgaaagtgaatatttgtaaattaagattcttctctttaccaccactgctcctgactgagttccactagaggtaaacattgttactttcgatgtgtatacataggaagataatcaaactttttgtatccaaatatacatatgtatgttaaaagaagtttctcataaaagtgagattttacaaacttttttaaagtcattaatatatcttagataactttaaaaaaaatgttagtactggccaagcacagtggctcatgcctgtaatcccagcacatttggaggctgaggcgggaggatcacttgaggccaggagtttgagatcaacctatgtaacgtagtgagaccccatctttccaaaaaaacagtcggtacttatggttccatatcatacatttgtagtgtaaaatgacataaaattcagttgatcacctggtaaaatactgttattcaattgtgttcttttaagtggaaatattagtcaaaaatatgatttaacttgcaatacctataaccctagactcatttttgtctcccatgccccagtacacattttatgtgtggtgtagattttgcatgaacactaaagcacatatacaactctaattctttaaccttttttatttatattcagcttacctgttgattcggtggtaattacagaatctgatgcacagagaacaatgtaccctggaagttgtgtgaaaaagaatattgatggtacaatagaggtattatatttttaatttttatcttttaactgttatatacactgatttttctatcatttttatgtctggtttactatctaataaatagttgctgagaagtaagcataataaatatgaggataatgccttatatagaaaactcagaatacacatgtaaagaaatttaatctatttttatagcataggtaacacacagaggaagttaagtttgggggttatatttcccttaaatatgttatagtttaagatttatcttgttttttgtaacatgtgggctatgtacaaattagtttcagtgccctggtcaacaaagctttgtcttcccagcatgggaagttggacaaggccatctctagaaaagtgtttaggggccaggtgtgatggctcatgcctgtaatcccagcacttcagaaggccgaggtgtgtggatcacgaggtcaggagatcaagaccagcctggctaacatggtgaaaccccatctctactaaaaatacaaaaaattagctgagcgtggtggcactcgcctgtagtcccagctgctcaggaggctgaggcaggagagtcgcttgaacctgggaggcagaggttgcagtgagctgcgattgcaccactgcactccagcctgggcgacagaacaagactgtcgccaaaaaaaaaaaaaaaaagggtttaggaatccccagaatccaagacaatagggctgggataatagaattaggcctattccaataaggtccgtatggtatataaaaaagttccacatcttttaaagtgcatgccatctaactaaaccaccccctgcctctgctcaacattgtattattctaaatttctcacacctgcaactttctcaaactggcaactgccaaaccctggtcttcactcagtagatttttagctcttaagtcttagaaaaaagtaagatcatcgttcttcctcgctcagtatacagaggaaagatgttagacacatccttgattctgctatactcatcccatgtcatgatgattggtaaataaagaaatactttcatactgagaacatatttatgttttttaaaagtttatggttttttctattgataaaagtaatttgtatttgtagaaagttagatagtattaataaataccaagaagaaaacaaaatttgcttgtaagtttatgagcaaagatagccactgtttaacattttacttaaaaggaaatctgtacacacatatatattttattagttatatttaagtatccttttcccactctagaactgtatgttggcatttataaatatgtaaacatatttctctttgcatctttaagttcacggtagtgagtataattatttggtagaattatttactagaattatttttaattgagagaattaaaatttattttttgctgaaagtatgtagaacttttctaaaaatactgatactttggggagattttgaggtagaagtttaaaaataagtggtgtataattaatgtaaataaatgtcatattttgcttttaaatgtagttttctggtgaatttggagtgaaagaggaaacaaatatcgttaagttgcttgaaaaacaataccaagaacaattagaagaagaagtagctaaggtaggcttatagcttatctggaagattatcttggtttatattccctttgagccttcaaaaagaacatagattttatcgatggtatgtactttataagtttcatatatagttcatctttaagtgattggataatatcaattatagttgcctttaaacaaaatatcttgtgaatttttatttgagaagagcattgttcttgatgtagactagtaattagaagcttttcagaatgccaaaacaagtctatgtatttgttgccttgtgaagaagtttggtcttccttaaaagttgggaagaagataggaaaagaaagagaaagtggttggtcctctgtatatattatctgtatctatttccaatcagagaagttttgttaggtaatgactacagatactaagggaggattatcactgagtattaattagctcctggctaagtgaaggagtttatcaatgtgagttttgctcatctctgtatgcttatccactgtgtccagagtcattctttaatattagccatataccctagtgtaacattatggttccatttgttttgtctttgtattccttttcaaaacgtgtatacctgattggcttttaatattggaactggccgggtgcagtggctcacgcctgtaatcccaccgctttgggaggccgaggcgggcaggtcacctgaggtcaggagtttgagaccagcttgaccaacgtggagaaaccctggctctactaaaaatacaaaattagccgggcgtggtgacgcatgtctgtaatcccagctgttcaggaggctgaggcaggagaattgcttgaacccgggaggcagaggttgtggtgagctgagatcgcaccattgtactccagcttggccaacaaaagcgaaactccgtctcaaaaaaaaaaaaaaaaagatatatgtatatatgaactattgaattatgagtttgctttttttgtataatatttcagctgtcttaatataacaatcccaatggaatatgtgcattttaaagggttaggattgattggtaggatataaaggaaatatataaggaattaggaaaaacataaattcgatgaggaagtcaagacctaaggaaatatctgggccataaggacttattcacttatgcctaaagtgaaaagtgaaacactatcattttttttttatagctttcaatgtctagttcttggaggaatgcaaattttctcttgcatgtagctcttacacaaatttatcaaatggaatggtgtatcagggtatagtaattaacatgaggtttggtattggatataccatcctttaaattcttgttcttttggtttactagatttgtgaccttaggaaagttacttaacttgtgaatctcagcgttttatatgttgaaagaggaaattggcttagtagcaatttttataaggattcaatgagctaatgcatatagaacacttagcaaatgagttgatacatagtaaagactcataaatactattttaaaagtagtcattactgtgataatggtggtaacatgatgatgttttataaagcattactcactcaagctgatagcagagcaccaaagtactggtcagtgatgtaacagacctgcacgttgtgcacatgtaccctaaaacttaaagtatttaaaaaaaaaagactcttctaaatgcagccaagatactgtggtccaagagattatgtttgatggcccagcttggtcctagaataatatagattgttgatattagtcaccagtaccgatgggattatgctgtactctgtacccctcagatatgatagaagaagactgagagccatttttcttttcttttcttttctttttttttttttttttttttgagacagggtctggctctgtcgcccaggctggagtacagtggcgcaatctctgctcaccgcaacctccaactcctgggctcaagccatcctcccacctgagcctcccaagtagctggtactacaggtgtgcaccaccaccccagctaatttttttgtagagacagggttttgccatgttggccaggctggtcttgaactcctgatctcaagcaatctactcaccttggcctaccaaagtgctggaatagcaggcgtgagccaccatgcctggctgagaatcatttttctaaaagcacaaggctatatagaagaagcccaatagtagtgatttccagtatatatcatattagagtcctcctgtgatttgagcacatactactgaaagtagacattcatttacatttcactgttaagcaatgttctgggtgctgaagtataacagagaataaaagaggatgaaatctttgtttccatagaccttacattccagttggtacagatagacaacatacagatgatgataagtactatgaagaaaaaaagcaggactaggaaaatccatggggagtgagatggtgttattttatatagggttgtcatggaaggcctgacttatgaagtgacattagaggaaaatcctaaaggaagtgagggagtgaatcaggaagatatcaggttgaggaccttttaaagaaatatgaaagggaaagtcaagagagcaagagaaaaagaaaggtcaaaaattactctaacaggtgtctttaagacacggtcaggagacttgactagagtttgtggaggctgcttgcccagctgctacctctggtgagttggaggacaattcagtttaatcctgcaactcccatattcatggtgaaatattgtgaaatcctggcacagatttgtcttttctgcagatgtaactggatacaggaggaagaaatcagggaaagacagcaagggctcacacttccggtgaatttatataggtagagttgtattgtagtgtatatatctatatatatatatatatatttttttttttttttttttttgagatggagtttcactcttgtcgccaggctggagtgcagtggcacaatctcagctcactgcaacctctgcctctggattcaagtgattctcctgcctcagcctctcaagtagctgggattgcaggcacgcaccaccacacccagctaatttttgtgggtttttttttttagtagagatggggtttcatcatgttggctgtaactcctgacctcaagtgatccacccacctcggcctcccaaagtactgggattacaggtgttagccaccatgccctgcctgtagtattcttttatcatttaatgtctgtggcatctgtagtgttatccctatttctcacctttttgtcagattggctagaggtttattgattgtattgataatattaaggattcagctttttgtttcattgttgtttttattgtttttgtttttattttcaattgctacccatatctttttgatatcctttttctgcgtgctttggacttaatttgctcttcttctgcttttctaaaaggaatttcttttctaatgtatgcatttaatgctatactcgaaagcatagcgttacagctttaaacattatagcttgtaagtatagcaatgcttcctcgtaagcaatgtttaaagctgcattctgcaaattttcattcaatccaaatatattatttcccccgtgacttcctctttgattcatgggttatttagaaatgtactgatttccacatttttatgattttcagatagcttcccatggttaacttaattaatttttaagtttctttgtggtctggcaaaatacctcatataatttcagttcttttaaatttgatgcccaaaatatggtcttttctgggtgaaagctccatgtgtacttgaaaagagtatgtgttttgctgttatttaaatttcagatttccctctggtgccatttttctttagcctaaaaaccttcctttagcatttcttttagaacaggtatgctgacaatgagttcaacatacaacgaattttatgttgtctaattttgaattgtatattaaatgttttgtgttttgtatgctctggatgtcattataattctttgaagaatgtgaattttttaaaaaaataggcagtccacccagttaggttcagactaaaaatcctgtttcttctttcccatacaaatcacctaagttttgacttccctctgcagtctcctagccattgtttactcttcagaattctttagttgttttgtattgtgctcagagtttttaggtaatcagtgggagaagcaggctgtagtgggcttattttatgttgcctggaagcacagtctttgtgttttcttattccacaattcagatgcaattattgccttatagcatcagtatttcaatttacccacattttttttttaaaaaggatgtttacgctctaatcctttttgcatcttaggccatccttttagaatcttatttctttttgaagaaaattctttagaagtttttttttttttaactgattatctattgggagtaaactatgttttttagttgtctttattttatgtctttattgtgtttttatccataaaagtttgttttgtttactgtttgaacctggttagcagttatttttatgccagaactttgaaggtaacattccagtgttttctgatttcttgtttctgtcgacaaggtccttgtcactttgttgttccctcgtaggtaatacgtcttttttctttagcaacatttaagatcttctttttgattttggtgttctcttttctcctttttttttaattttttttattttaagagatgggtctgtcagccaggctggagtgcagtggtgtgatcatagctcactgtagccttgcactcctgagctcacacaatcctctcacctcagtccctggagtagctcaccacacccagctacaaatgtttttgtagagatgaggtatttgtttttattataattcattgatcatcttgaatcttggcagtggtatcttctgtaaatattctcagccattatctcgtgaaatagttcctttccattgttctctattatatcctcctggaactctaattagatgttggttgaccattctctatccttcatatctctgttcttctctttcatatttttaatccttttgttccatgttacattcttaatatattcagtatgaagagacagaggcagatcaggttcaagacaggaaattaaagcaaaactcagtcataaggttttgatcactagttacagaaggttaaaaatatgttttgttaagttgtattctatggttaattatttttaattatctttgtcttttgacattttgccgtaatgggtatatgttccagatgacatcgttgttaccaaaccctggttctttctgagctagcataggcacccagaggtccaatttggtaggtgagatatggtaccaggattatctgggaagaaacagaatggcatataatgtttaaggtgcttgagctctgtatagacacattttgattcaaatttctgccgtaatatttattaaatatgtgacctttgatgtggttcctaatgttgcagcacttgaattttctctgcattggctactggtattataattattcctcaagtcagttttagcattatacttctagacagattcatttagttgtggaatagtataatgttaccttttagaaagtgagcttaggcaagattataggattttgaaccccagcttcaatgatttatttgctttgtgtttttgagtcaaattactccaaaggaggctagcacaggaaccaggtgggaatcaggaccccagataggtgaatcacattcaggacaggaaattaaaactaaagttcagttatatgacctggaccagcaaggaaaataatgctgcagatcagtaaatacaaatatttctaatcccaggcatactttattctgggtttattacagccagccttctttcattataaattatctatggaaaaaggacttaaagttattgatacggttggttctcaaaggtgtagggacttgtcagagccaaaactgctagtcagaattcctaagtacctgtgctggggtgggatgggaggctagaataagcagggattcaggatcatagttgtagtgaaaggtcaaattggattataatgaaatgtctactcatatttaccagtcatacaaactaagtgttccgcttctgggaatttgttttgaggaaataagaaaagatatgcacaattatataattacaaatatttcatcacactggtgtttaaaatagtaaaagactggaatcactctaaatgtccaatatagagaattgatttaataaacttatactacatctatgtaatatgaaactttgaacccattggaaattacatagaaatgtatttctatttcttaacttgaagaggtatttactatagttaagctacaaaaactggttacagtattagaatatgatcacgtttttataggaaaattatatctgtatctattcatatctatctctgcaaagaagaataagaagatttgggaaagtattcactaaaatgtttacattgatttttcttggaagagagaaatataagggcttttattttctaatttttactgaacatttatgtctgttataataagaaaacattttactttttatttaaagtggcaggcagtaaaataaatactttgacattagatttattgtaaaaagagaatccatctcggtattactttattataggatttctttttgtttagaaccgtgaggccatgcttttttctgtttatacaattttgagtactaatttactttttaaattcctgctgatatttctaaatctaatcctttattgtttgcttttatttctttaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctgtaagtatgcctccttgaatataaaaaacttatttaaaaattgtgaattctttcactttaaaaatattagcaatagtgctgcttaatgtttggaggaggaaaatatcaaattcagtcttatgactcacgttgttttgttttgttttgtttttgaggctgagtctcactctgtcgccagggtggagtgcagtggcatgatctcggctcactgcaacctccatctcccaggttcaggcgattctcctgcctcagcctcctgagtaactgggactccatgcgcgtgccaccacatccagctaatttttgtatttttagtagagacaggattttaccatgttggacaggatggtctcgatctcttgaccttgtgatctaccctcctcagcctcccaaagtgctgggattacaggcatgagccaccgtgcccagccagttcacactgttaatgtgttttattaattgtaagatatatggataagtgacttaatattagtatcaaataaaacaagtctggttcatagtattcttgtttatcttaaagatgttgtacctggtaaaatcccattgtaagttgtacgtacattaattctgtttcaaccaattcaagattaattatactacaatttggtaatatctgtgaataaaagatttgcttaattaaatataacaacattagaaggaaatagctacctatttaggaagactaaaagattttactatctatatcctaattcttgatttatgtacttatttattaatagaagatccattctgtgtctgtacctcaactgttcactgcctttaacagaaagtaataaatcctacttcttttaacattatctgaattaaaattttttattaatattcaggataggttatgttttgttcagactaatattcaagtaaaattgccaactccaggccgagtgtggtggctcatgcctgtaatcccagcactttgggaggccgaggcaggtggatcacttgaggtcaggagttcgagaccagcttagccaacatggtaaaaccccctctctactaaaaatacaaaaattagctgggcatggcagtacatgcctgtaatcccagctacttgggaggctgaggcagaggaatcacttgaactggggagatgaaggttgcagtgagccaaggtggtgccactgcactccagcctgggtgacaccaagactccctctcaaaaataaataaaataaaattgccaactctttatggaatgcaaaacttgttaggtgttcttcaagacctctttaatttaccagcaactgttcaaagcaaaattatttgtataagtaacattcctccaggaaatgatgtactcgtagaacatattaaggagttgacttcttatgagtgtgagactctggaatgtaaagcttttatcttcaaataaaatgtattgaaaattattttttatcagtagttctctgtagtactgtgataaccactgtgtaaattaaatgggtagtttctcatgtttcatacatttaattttaaaatataaatattccatggatattattttcccttcataaaatgtcaagaggaataatggcattatagcttcgttaagagtagaaggaatcttaagtatcttagttcttttttttctattagaattagattaagtctaaactaattgataaatagctgttttgcttttggaaaataatgataaagtagctttatgttgttttagagttgtaattaagaaaaacaccattttaaaaattatgtttttgtttaataataaaatatcacatgctttatgggataaggaatagaattgctttcgtatttgtttacaatattaatgctgacagatttttacaaaatgtgttatggttgaattgtttttttttttttttttactattaaagattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccaggtaagggtcttgtagtcccctttctctccccagttatttttttttccaaacaccaacttgaaccagatccccaattaaaacaacagtattttttatgtagccataatttttttttttttttgccgaaatctgaataaactacatatatttagcatcaggaacacactctatactaagacagcagctttagatcttgttagggacacctatctcaaccttggagtgggcattgtctttctgtcattttatttaactcctttttcaagcactggaaaagtggctacacggttttgtttttttcttttaaatcattccattagccatatatagcaaactcactttgacattttggaaataacattgtgctgaggtgctccattatgcagttactatcattcagttttactatcttcatttatagttttgtgagtccaccaattagcatctcgaaggtttacctttatctgtctttaatccatctttttaatcatgaatggaaatcggaagtagtatgcttctgaaactctttccagggaaacatctcttcttgatttgagaaatgcaaatttatttaacattcttatccctttcttgactaaatttaaatacttcttggtatttgggagctggattcttgtcaactgctgtataaaatatactcacaaaaccattgcagaaaagcaagaaatatttatgtagaagttcttatgaaaacttattgaatttaattttgaaaactgaagctaagagagataataaatatctagagataactattaacagtattctttcaaacataaaataataagataattgggagctgagcataaaacattatttggaaaaattaactttgcttttcttcattgcattttgtgaattcaaacttcttaattttcaatgcaaaattgacaaaaattaattgaactgcacaaattcctgaatatatagacttaattggcttttaaaaaatattttaaattttgcattgatctttgtatatacttttaaccccttacgatggaatatgaatcataagtagaaccagggcctgttggtcccgggggttaaaagaaatctgcttaatatttctaccctttttctctatcacaaacagtattctttcatgaccttttttcttatttagagatcctccatagataatgaaaacctggtttcagagagagagagggtgcttttagaggagctggaagcactaaagcagctgtctttagctggaagagagaagctgtgttgtgagctgcgcaacagcagtacgcaaacacaggtagtatggactttgccccacctaggagcaatggatcaccaattcagtaggatttgtttgtctttgttgttggtatgagatgtattcttttataggtactgagcttaacatatttgtgactgcatgtgtgtaaggtaggtggagtcaaaatgccttacatttcatttaaggtaatttgaatctgacattctgttaacagcaagtattgtttcaccaaagagaacctaacaaactttattgttgcactacagcatggataatttgaacccattaaaattttttatttgtgtacgagaatgttttatcctcttttgataacactaatctcgagtgtagttaaatattataccaaccagtatcaattttgtgcacagaggtttctattttatctcataccaatatagaagaatgacatgctgtttccaagttgacaggttttctttctgtcttctcctctcttcctttacacaaacttaaacagaatggaaatgaaaaccaaggagaagttgaagaacaaacatttaaagaaaaggaattagacagaaaacctgaagatgtgcctcctgagattttgtctaatgaaaggtatacaaaatgtgtactttttcagtgcaaagtaaattaaaatggttgtttcaatgtaatagactttgtccttatttttatcttgtacattgatactttgtcttaaaaatcatcataccatctgtgtatgaaacatgtccatgtatgtgtagtatgtaaaggattttcagtttttcatcattaaatagataacattttaaaaaaatcttttctatataaattttgattggatattaatcacatacttaactgttaatcacctgatgttagcaaaacttttccttactttgattttgtagaggttaatataaaaatgtgaaatattaagtgagaatagttatcctacattagtattaaagactttaagcacaatattttaaactttgttttgttcaaatgaaaataatttctttaattttaaattaaaactaatatttacttcttaatttcctccttttccaatttctgtgactgtcaaccctcttgtgtcctcctaacctccttcctcagcttgcatggaggaatttggcccctaagattttggcttccccattggatcatcagtatggaacgcagtcagtatggaactcaaacaagaaagacagtgtatgaaaattagagttaccacggcaatataaaataaacactttgtttattttatattatttatctctaattggtaaattttgaaaactatgcagtatttaatttctaggaatttttatagtaagtgccaataaaatgagtatttttttttaaccaccatattaattttaatcatttctcttaagtagaaatattttcacattattctagttctggggtttggggcttaaacaaaacctcagaacaagttaaggaaataaaacccttggcttcctactaaattagtttagttttatttttagtattcttgattatataagcagagaacttgatctaggtgcaaaaatagaaccgtctctttcacttgacaaatactaacggaaaacttctccatttattatcttgtcttaaaatagatatgtcatgtgcctgtgaaacaggtatcctttagcctgatttttggcaagctcctacagtgtgaagctaaaagataaaactgtcttaaggcagaagacctttaccatgaaaatcttttattttgtctgcatgtataaagtgtgcctttgttgaactgagttgctaggacaagagagttgtttagtttttaagaaaattaatcaggcagtcttctgaatcaccatttatggaagtagctttctttgcatggtagaatgttcatgttaagcaaaaaagagagtgtacaaaaacactttgttcgggatgatctcatttttgtttttaaaatacgtatatatttataagagaggcaggaggaaaagtctagaaatacaggcattaaaattgtaatagtgattgctgaggttttttggtgagtggttagcagtattttccaaattttttaaaataaggattactttttaaaaagagagacacaccaaattcattctagttgaaaacaggtttcttctgccgacttaaatgagtgtggtgagtgtaacttgagaaatttctgtccctggagcagatgtaataaaaacggcctatgatactctctgtggtgttgacagatagtgaaatttcattacagacctttttaaaaacacatcgctgcctaactattactttttgtaatttaaacattcagctcattaccattaacttgtacaaatactaccacataattttttctggtgtgattttaaaattatgtttcaaaatatgtttttatgtttaacatatagaaagatttaaatgtgcaaaatacatatgtataaccatgggcagcaagctcaataacttgcatatgctttggcactaccatactttttaaaacttaaattttgtctcccaagattttctcttaacctagttactggcttaagactttagttatttttttcaagtcaattaaataccgtacattttaaaaaatggtatgattaagctaattggccaaaatttttcagacaaaaacaaatcattttataatatagttacaaataaaaaacaagaagcactttattgtagatgctattgggtattttaataaaaaggatcatctgttatttttcaaatcaaatattttgcagtgtactttttagtggacataagcaaagtgtttgcttcaaaaatattaaacattttaatcagtgcttctttatctatacaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagaggtactagttttctgtgttgtggaaacaatcatttcaacaaatctgctgagttcaaggcattttgccatgtgttgaaaatatagaagagaaaataagtattttccagcaaatggaccttcaaacagaaatacattagagcaactcttttcaaacaccattattgtatagcatttgcaagtgggtatcatagagttgtcattatatttacccagggttgccacagtgcctacataaaccagaatgctgttacatttctccaccgataaaagaaaatttatatatcagcacttagtactcttaccagtatctgtgaggtatggatgacatcctgaaaccatcctatagattaaggaaagattagaaataaagactttttaggaacccagcaccagcttcatgtacctgttgaaatggttagaagaaagtcttgataagaaacccaagatttggtgttacctttggactgtcctttgctagattctttcttccttttgaaaaagtgagttgaaatattacacaatgtgtatggatccagagattaggtcctgatatgccagagctgtcttcgtaactctgtcttccttcagctgtgtggattcagctcttctttccgtttctttttttttttttttttttttgagacagagtcttgctctgtcgcccaggctggagtgcagtggcgcagtctgggctcactgcaacctctgtctcccgggttcaagcaattctcctgcctcagcctctcaactagctgggactacaggtgcatgccaccatgcccagctaatttttgtatttttagtagagacaggattttaccctgttagccaggctggtcttgaattcctgacctcaggtgatctccctggtttggcctcccaaagtgctaggattacaggcgtgagccaccatgcccggcctcttctttctatttcttcccatcacattgctgaactccattgtctcttgttttttcaatttctttttccttgtaggagagggaaatgaggaaatcaaaagaggggaaaagttttgtgagatggagaaacataggatgtggactcctggctcacaagatcaagcccacagttcactaccattccacactcaagcacttctcccatagaggcagacctaaaatgccagtttttgtaatttttgagagaattctgtttgttaaatttcatgtggagaaatgaaaagaaattatcccatttatggaaggtttgcctaattataagttggccagtagtgtgtttctaggtacagagaaaagcttgatttggaattgcaaataaaactgatttttaaacaccttagctgagttcaaagatagttttaaaaattgtttttagtaaattaagagctgaaataatactgaattttaaaccttgctttcaaattcactcttttcaaacttggtggaaggatttttcaaattaacttcactcttggttaagctctcagtcacggctattttatttctgcatatggatctttatagagaagaattaggtaacattttcttggtctgataaaagtgtttatcaaattatgctttttaaaaaacaattatttcacaagcttgtttcacttaaccatttagggagggattttgctgttctgctggtaagacctagaccaggttgactgccatattcagaagagactctgagaatgttctgtgcattacagatgtattttgtgcttttgttgttgttgttagcagttctcttagatacttctcaacatggctgccaaagtattcagcagacaacataccttgaaagacagtgaacttacttccagagcactgtctccataaaagggaataaatggataatttaactcaagcacagaggattatatttatgttcattttccatgagaaagcagacctaaaaagacttctgatccactagcctattttcttgcataagtgtatctaaatcttccaacacacatgaaatatgtatatcctattttaagatacagtaatggttttctttccttttttttttccttttgagtctcgctctgtcacctaggctggagagcagtggcgcaatctctgcttactgcaacctccacctcctgggttcaagccattctcctgctgcagcctcccaagtagctgggattacaggtgcctgccaccatgcctggctaatatttttgtatttttagtagagacagggtttcactatgttagccaggctggtttcgaactcctgacctcaagtgatccaccaacctcggcctcccaaagtgctagaattacaggcgtgagccactgcgactgaccatagttttcaattataagcaattttatgagtttaattctgcagacatttactgagctatttctctatgctctcagctttacagcaattcatagtctaatgaagaagtcattgctattctgattcaaagcaaaatagagtcataatatttaatattttgcctaaaaccactacgtatatttgaatcaactaaaacctttaaaattttagttatttaactgttgaccgattctgaaagaataatattgagataagagaaaaagctaaatccacagttaagaaatatagtgtatagaatattgtagcagagataattttgctaggattagtatcattggttacatttactttccatttagttaactccatcttactgtttttatgtttagcagcagtgtgatcatcttactaataaaattggagcaaccactaatattactgggggacagttaatggatccatcttgcatctttaaggatatattgagttaatagaatttataatttaaaatttttaatttttatataaacctgaaagaaaatactggctttaaaatattaacactgtgttccatatgtaagaattttttctgacattccttcataaatataatgggagcattatttttaaaaatgaaaaacttttgacagttttatgttttttagtataacaaaaaaattaaaccagtctaattgcgaagcaacttttgcttttcagttttcatatatgactttttgttgtaacacttctgatgtgttttcagccttcaggtctgaacttgtttcgattttaaacatgtatggacttgttaacactcaaaaagtaaagaataaagttgctaatatttgcttcctcataagagtaacctagtttatgaaattgaagggaaattttgagctaacataaaatcacttaaacctgaatgaatattagatcagttcataaaaatgaattccccaggttgtgttgaaaaaaaaatttcctttaggtcttcactgtgatgattcagtggttttatgctcacctctcccataggaggccagggatggaatcttgtctgctgctgcctccttttggagaaatgctgtcttatagaaggaatgctaggggctgagagtcatggctcatgcctgtaatcccaacactttgggaggccaaggcgggcagatcacctgaagtcaggagttcaagaccagcctggccaacatggtgaaaccccgtctctactaaaaatatgaaaattagccaggtgtggcggcacatacctgtaatcccagctattcgtgaggctgaagcaagagaatgcttgaacccaggaggtggaggttgcagtgagccgagatcacaccactgcactaatcagaaggccttgttttctttttttctagttcattgtgatattgggcaaacctcttaagtctcccagggcttcagtacagttttctcaactgtcagatccagggtcagactaaagcctagtggtttccattggagccattagagattcagagagcctttggggcagagaaggctttatcacattgcctatcccacttaaacctgaggagtttatcgttacctgtcagggaatgaacatgatataatccataaagttaataactaaaggacttgaataaccatcatttactatgttttaagacataaatccaagaggttcaccaatttgaaatgattctatttaccaaactggatgttctaagattattattggcatcttgtgaagttcccctgctaatctatattatcctctgaatttttccctccaagactggttattaaaaataaagtttagggccaggcacagtggctcacacctgtaatcgcagcactttgggaggctgaggtgggtggatcacacggtcaggagatcgagaccgtcctggctaacatggtgaaaccccatctctactaaaaatacaaaaaattagccaggcgtggtggtgggcgcctgtagtcccagctacttgggaggctaaggcaagagaatgacgtgaaccccggaggcggagctttcagtgagcggagatccagctactgcactccagcctgggcgacagagtgagactccatctcaaaaaaaataataataataaaataaataaataaataaagtttaagcttgatgtctttctcatatttctattttataggatttttttaaatttggttttttcttggaacatattcagattatttcagattgtttatactttcaaaatgttattaagaaaataccttaagctaggtgacgtctttgccttttctaggtactttaatgtctatttttaaaaattagccatttggcttaaaaaagccagaggccttttataagtcactttcacgcaccctctttattttgtgcttgagatttgctcccatctaatacaccataccttcaatcttttcctcatgttgattccttctctatagcccaaaacattagactgtcttcatactgccttaaaaatttaagaagtgttgaattttctcacctttgttccctgctcaaggtaaatttcagcaaactttttttttttttttttttgagacggagttttgctctatcgcccaggcgggagtgcagtagtgcaatcttggctcactgcaacctccacctcctggattccagtgatcctcctgcctcagcctcccaagtagctggaactacaggcacgtgccaccatggccagctaatttttgtatttttgtaatttttttttttgtatttttgtattttttagtagagatggagtttcaccatattagccaggctggtcttgaactcctgacctcgtgatccacctgcctcggcctcccaaagtgctgggattacaggcatgagccaccgtgcccagctgatttgacaactgggaggtcagtgttgtcctctgagagagcagctttggtactgcaggaatagaaatcaaggctggtaaacacaggagtctccatagcatcttcccagtcgttgtcttgtttgtctttctagacaaataacattactaaagtgtcttgaagccgtctctttttgtctgttggaacatctctctcctgcctctctctgatattttttaacacaggttcttttgttagattatgatatacagagacttcaactttgtcttccttctctcactgagtattactcctaggacaaatgtatctacttccaaggtttcaactctcacctttctacaaatgactcctaagtcattgcagacccaaaattccaacagttgactcatcttcacaaatcccattaacacttcagactaatcatttttcatccctactctgtatactttttcctgattttttagtatttttcttaatgatttctctgtcacctaagaatcatctaagctggaagcccagagtcatcttacgcatatcttctttccttgtcttcttctacattgtcttctccaacctgtgctttctcaattttttctcctttaacttacctctgcattgctacaatttgcttcctgatgcacatatttgatattatcttcttattcaaaatatgatttactctttccatttgtttatagcaaaacccctaaggttcctataaaatttaagaccatttacaacttgaatccagcttactttccagctaccttcttttagctctctcacctacctcaccactatttctccatgtccctttgccctaaaaagcctagagttcccatcgtatcacactgttccctttgcgtcacatttctgtacccatgagaaagaaaatgttactagaatgcatttaatttctcacataaagatgctgtaaattccaagattatcttgcacttctaaatgttttcaaggcattcaattttgagcacatggagtaatataaataagtaccagtgtagctgatgtgttttttactttggagaataaggatacaaagtgaaagttgtatttactgttaccttaagaattagataaacctgtatataatgggaaacatttaaaatcatgccttaaaatgcaattttgggctctacagccagtgacttacaaagaggacatgcttagtgaatattgaattgtgctgaattcaggtcttgcgtctgaagctgtatctgatgtcattactacatagattaagaaaatgtggcaccagctactttagcaagacaagttctaataagtagctcttattttgagtgaatgtgtcaaactgaatgcttattccaagcacttggtacatgaagatttcctctgctttaattggttaactttgtacagttactgataacaaatatgtactacatgtaataaaagaataggtaatgcctcttcaggaaacttcactgttgagttgtaacatctgccacaaaggagtatttaatggcagtggtgaatagcctatgcttttattatagcttagagaaaatacttggaaagcttatcttctacccatgcaaactcatttttttttaacataagaaataagaatagtgtgggtaatgtggataacaatgtccaaagttaaattagacctgctcatcagtctaatcttatcccagtattcctcttaaaacagtagcaagcaacaaaatgatctcagttccttttactgtgtagccaaagcagatgatattgcccagtgttggatcaaaagttagtcatcaccagataaattcaagcacttatttctatcctgtactcccaatgtaggctcaaaagtcagtctgctcccgaaaaatccaagcacttatttctatccctctgtacaatttgaaatggcctactccacaatgcctttcttttcttgtgattgtttatgtgtttcctcattacattgtaaagtcgtcaagggttggagccagatcttgtcacctatatgtccctattacttagcaaactccacatagtggacatgtagtaaatttctgttgaaaggtatcttagaagtttttatcaaagaaaaaaatactgaattacccacatgatcaatttctgcaaattcctattagcataacatttctcattcttttgcttggttattgaataatattatatcctatatttgcatattttatttgtttggttgcaatattgttttaaaagaccttacaatttccatgatttccagtttagtttgatgttgttttataactttaaaaaattatgattattataattaatttatgcctttaaaacactgttattctagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcaggtaacctccttatattgctaatatgtactgagtttgaagtacaatatactatcccactctctcgactgagctaattttgatattttcatggatagctgtttggcattttcaaagcttgaatgcatatgcatcttaattatccctttggttgtatgaaagttgtatagtataaatgattctatactgaattcctacatgatcctgcttttgttttgttttggtttttgcttatttcaggtatattagtatttaatttttgtgatttgtactttcatatatgaaaacaactgttaatactttttgtttcttaaccgctattaagtacttttgacctggatctcagccagtgttaatgctgttgctactacttgataccattgtaaattataagcagtttagttaatgcaacatagtatttgtcttttgataagcaacgtgaaaaatgttaaataaatcagaagtggtcagtggttccaataggctacttgttcttaacaggctactagagagaaacttctccaaaatttgttaatgctgccaacagtcaagcatgtgggctcctcctgaaacattcatttccccaggccaagaccacagctcatagcagctgtctgcttatgtgaccaggtagtgaagtatagtaggagtctgaccatggcattttccagatttttcccaatttgttgaatactaactccacgctgtgttatttagcttcttctgtattgtggtaatttaaatatcactgaatggatcacaaaagctttgtgtagagcagtaaccctatggcagagacttctcaaagtgcagcccctaaccagcaatatcagcatcacctggtgatgtgttcaatatataaattcttaggccccaccccagacctactgaaactgagggcccagcaacctgtgtttttaataagtcctttatatgattctgattcacactaaagtttgagaaccactaatctgtggattattagtacaatgttcacattgttctctggcttaattttgaagcactctactaacatcttttatataaaatgttaaactagttgttggcattaggtataaaaagttataaaaatgaagtatttcttaagtgaataatatttttcagcattgggagtaggcgtttttaaaaactttcttttaaatgaatttcagctcagtttttaatcttccatggatagatgtttaaagccattgatttcttcagaatagtctcattgattaataactaaaattatcttgaacctgatgaatatttttaacagattgacacagaataatgtgtaatatctttgtgaaataacttatattccactttcctcttcaatgtgtcattatttggttctactttataatagtatacttccctttaaccttcattttttttttcacgtattataacaaaatgtaaaacagctgggaggcatgctgtaatatctttgcgttttcagtgaaagagaaattcaggaaaatagctttgtacaggatactctgagaccagagaagagagcaacatctgacatgttagagtgtggtggggaccaagtaaagtttacttgggagttgatgcttaagatgtttaagatgagttattcactggcaaaatttttgaatatcagggcactggacaagtatctgccttataggctgattgggtgatttcataacctgtattataggagttatttactttagatatttgatttgaggggtaacttgcccagtggtatgtccaagtccatattatagtacatttattacaacggttttacctctcttttgcttggacaggctaccatacaatcaggcctatattcactttattgttaggttcctactggttggggtagctttcatgatagtatgaaaaagaatgcttaagagactgtcataaggcccttagagaggtaatctctttaacacaatccttattcagtagtctctttgtggttctgcagaaatgttatctttgagagtgtggtttcacagattctaaactcctggatcaggtagaaatcaaaaccattctcttctttgggagtagtttttcagcaattaaagttttccagaatccagaagtattatttagagccataggaggttatttaccaagagattctgctaggccttggaataaattaatgaatatgtaatttattcccatggaattatttttactgtaagaaatttttacgggcttcctaatacttgtttttaagaattacagcatcaaagctacatgcttctatattttctcaaaaaaaggaatctgaggatgaagcagtagtataagttaagattttgttttgtcattgttgtgtttgaaacataactgcaatcaaaatactgaaacacattttgccttcaagtattgtccccagtatgcttagcattggtctaggctccgtcagggtaatgtttgcaggttataggccctctgtgaaataacttcaagaaatagatgaacaaatcaaagtccaaaagagagcaacaaaagtgttttacagtttgaagaaataatttatgaagaaaggtagttaaatggtttgacattatttgatttaagtaaagctattttgtttaggaaacaactctatgctgcaaattaatagccttcaaatatacattaaaatcttgattatctgaaacctggcgataataagctagtctggataattaaaagtgtgttcttctaagtcattttattataactatttttgattgcaagaagttttatgtgctttctaaaatagagggggaagcaagatagaatataatttgaattattctaattcagtcacctttctgaacatcaattaatatatcatcagttaatattactgttgttacaagggctgtatgccactatcctgaatcatctttatttaatactgctcttttgagtcttttttgccctaattttactttattttctttgtgtaagcttcttaccttgacctgtgttcctaatataactacttacctacagatttttgttttacatggatggaagcaagttttacatgcttccaaaaatgggtgaaacaatagacaataatttcagttattttaattcatggtcatctttctgaacatgaattaatatttaatataatactccatcagttaatatactgttatgagggctgtttgccctattctgaatcatctttatctgttacttttttgagtccatttttctcagtaatttttctctcttatctttgtagttagttcttatcctgaccgaaatgttaactgtttataaagggttgtttcttacttacagattttgtttttgcttcaaataagagaaactagatatcagattatcaaaacaaactgtagtttgcagagggagcagggaaagagtgttttaagaggtatttgataggctaagcatgggtccccacagttcataaagctgagcatctgggatattgacaacttctatctgccaaagccccactaaagtcacatttagctgcagcagtgataagattaggcctctatcttgtataggtgtttattagggtttcttatgcaaccctccagttaatctgtgaacgtgctttgttaagacaccttcacagactaactggagggttgcataagaaaccctaataaacaaaaaatttttattgcctagtccagacttgtaagaggcaactgcccctccacagctacaagccatctccctgtagattctggctttctatagaaaatgtcattttctctgccctaattattagtctacctactgtgaaatggtttgagtactggtttaaacaactttatagtgtgagtagctgtagaatggatttgtgttggtattacctaccttctttagcatgggtttttccatttaaataaaggctttgtggatttaggatatttagttactggaaagaataataccaaaatgagggttttttcctttctttaaaacaactttcattattgaaaatcttttaatattaaaaagtaagttgtttatcttctaaaattctgagtggcttatttattcactattgcccaggtttctggagctacccagaaggctattctatataacttgggcttttaaagtttagtcagggttcataagataccttaagtggtatagttttcaactgttacatacagtgtagctttaaaaagaattttttccttagcatgtactctgtaaacaatatgaaaataggttataactgaaatgtctatagttttagtggctgcttgaaagatgagtaatatttctaaggaaatagcaaaagtaagttttaattttccagaaataactttgattattttatatacttgaataacttattactaatgtggactcaagcataattaatttcacatttttaaattaaagcaattttttaatggaacggaaaaacaccagcttatcttacaaacattataaacttgtctaaatgccctttcaaagccctgacgtggaacttggatcctgtctggcaggcttttttgtgggcatattaattcacattccacctgtcagtgtacctataggtaaagacattaaaccacaccctctgttctgaccttttcctcaggggacactgactagaatcctttggctcagcatgagaggctatttgaatagctcagttcagaagagcttttccttttgaatagagtgaagcagcaagagcaagagaaataatgttacaactgcatttctcaagactgctgctatggagatttcaaacttgaccttccctgccaggttctgctttgaaggcttacttattactacagacatcgctgatattaaaagcagttttattgctcgtctaattagatgtttatatttttattcttctcttcaaggacttaattatgctagtttaaaaggtgtttttgtttgcttgcttttatttttgttttttgattttttttggtttttgttttggtttgggtttttttgagggggcatcaagattgatagagacctaagtttttttagatttgtagtttttttcctggactttccccttccttttattgtgcagttgtatgaattaattttataacatttatttgatagtgctaaaaaagaaactttttatactgctatggtagatcttgataaactaaaaagaactttttaatgtattagaaaattgataaagcaaattaggaatctcggcagctgtatcttctgggatggattcttatagcacctatttggcaactgtcaaagtcagtggctcgtggttagaagagcaagatgaagacatttatgaggttgaatctcgcgtgcctttaccacatccttttcctctttgtgaacatttggatgaaaataactcagtaattgttaatacttctattttccattttattcataaaagaaacgggcatatattaaagcttatttctaaaatttcactgcctacccctccttattcagtaagtataaaaaatattcatttagttaaacactataatgagaaattaaattttgagtgtctatattaaggctaaatgggatagaaccttgtttgatgcgttactactcattcattctagatgtatttaagggctaaatttggtctgagttccaacttggctatgtttacaattacagaaagcagaatgagataatattacatttctccaatgccaggcagtttgtttaaaaagatcccgcttttccttaagattcttgcttttgtatgtttatcatgccaatcctgaataagaatggaataattattatatttgagagactcggtattatgatacttataagacagctaagtgaattgtcattgagcaattaggaaatgtttacaatcatatgttatattggctgttccagtccaggaaaaaaggaagcttgggttctaattttaatattcttaacaacctaagaaacttactttttgtttttaatatgcctcgtaatcttgtggaacaagacccttttctgctttttatatgaaatatattttataaacattgttaaggataagtgtttagcataaagaggcttgaatatttagtatttcaggttcactacaggttattcagtataactaaaagttattcagcgctttttatgactttcatagctttatcctgtactagctaatatttaacaagccagatggttttcagaatagttttgttacctcttctgcaacttttatattaaagtgacagaatattaactgatactttacatgtacttttaatgtaataagtttcttaaatactttggaaatattgaatatgaaatcttacattcttcatattgttatagatattaggaataaacatactctaactgaatggaagaggattctttaaatattaagtatttaatgaacatttatttgaagggtgtctcatctcccgatgaagtgtggatctcatctgctataataaatgacatttttttttgctagatttactgtatttgattgttccaactttttcattttattttagaaaacaagtttttctcttgtggttttatgataaatatttaaatggattataaggctgattaaatcttgtcaggaagtagaacatagaagcaaaggcttatttaatttacttacctaaagcaagcatttattttgttgtaaattctttgttatatccttatagtaaatttaaaaaagacaaaaaaaagcatatcctttttagttacatgtatttactagatagtcattatgtaatgaacagaaaaaaatgacaaacgtgtaaaaacaattgatatgtttttaaaatatggattgtgactgtaaattcccatgtagttgtatataaattagttcatactttattgttatgtttctttgtaataaaaattaatgatattagttatccagactttaaaggaaaaactctttccagttaaaagtaaaaatattccttttgagataacaacatattatcatgggtattttaggaaataatttataatttaaaatgtatgattaattttctattatgagtcttatacgtgtattcatattaattgcaaataagttataagtgatatttgaaatatcctattaaaacaagaataattgcatactggatattttggaaattgatttagagtagccatcaaaagctgtagttactctaaaatccatttgctatgacaaatacctctcagatgtgaaaagtggaagtctttaacaataaagtatcctttagtattatcatgattttgtaatacattttcaatatgtgactataaattagaaaccactacatttgatcatattttaagcttaaaatgcactaatatctttttaatgcacaaagtactttatatgtaaatttacaaattcttatgactttactgtgagcctgttattaatatatgtgatgatttcttcttacaatttttggactaaatactagaaacatttgagttcaattttttcccatgtaattgtttcagtaataacagataagcaggtgctgatagtcaaaagctcagaaaactaaggcagagacagtacttttctgcaatttcacacagctcatttagtagcagtgatcaagagagctttggctttaagccttctatcatcttaaaaaattgtttaagaatgtagtcagtatgtgctattggtaatattttaaggaatctgtgtttatggttaatgtctctgtattctacggttttgaaaataagctgaatattcataggagctttaggtgtttcacaaatggacagaaatataaagcttttagttaagtacatggattataaatataatttcattttgttgtgctactatcattttgttaattgatgccattgtattaatcatgtattattggtcccccacagtatacagcagatactgtaggagtcacaatccgtaaatactaaatgtagaagaaagtttatcatagactgtatagttacataaaattctttggcaaatacaataaacgcctgtgcttcattaactttatatcttcttttatatgataaagtacacagccattgatttaaagtggtttgtatccaaaagaagcatattcttttgttcagtaaagctagaatacatcactttacagaaagtcgtgcacagccaatatacatgtctcctctgatttctcctacctgctaatcttagcatacactggcaatatctaaatgactacaattcagtagtatatctttattttaaaatcctccttttttccagctttaatagggaatgaaactagtatttccacactttattttcttttatgtattgtttccctctttgtttagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggtgagcaatttgccattgacaactaagggtagagaaatttcagtcttaaaatagagatttttgatgcacagccaggtttggaagccgtcaatccaatttagaatgaccattaaaaagtacttgtggtttatcttcagagttcctccaagcaatttttaaaactatatatatatatatatatatatatatatatatataaaattataaaaagaatttatagagttacagaaaataataatttcagaaaataccaaaaaggatagtggtgactcgttactgtaatcacaccatcttaagacaacccttgtaatttaaagatgagcaaactgaagcgaaaagatgttattaaattgttaaagggcacaaataccattacatagtgattccaggctttgaatctctaaagccctatgctctttttaattctcctctgctgttatgggtgttggccttctaaaattacttaaaataccaaccttctaattttcaaaatgtgattcagttcacaagcatctaatttgtattaagcttttcagaaacttactgtttatatctgtttaataaagtgacttacacctacataatgtggtactttggtatagcaaagtattagaaaattcagagaaatttcatgtttatgcacaatggtaaacaaggaaatgtctgcattgaccataccctattaaaggttgatagttgctgtgatgagcagcaaattcattcaagacttttaataggttggaatgatggaaagttttgctaacagtataccttttgttgtttatattaaaacctagtggttgaatttgaaatgaataatagttctattttctgttaattttgtattataggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacgtaagtattttcagaatttgtatgaaacagtcctctgattttatttgtattcttcaaaggcttaaggtggcttttttcctctttcagtgccattattcatatattttatagagagatttaaaaaattataagaaaatctaccttagagataaatgtcttattagccaatcatgtggaatcaggttttttttttctttttccttaggcagatgttaacaggaaaagatagttcttcatttatcctcaaacttctgcttcaagagaaagctgcaaataatgaggcaggatattttaaaaattgtgtaaggtttagttctaatagcagagaggcagcaaaaatgtatacttggattaaatatctaaaagcactgatctggcactagtaatgagcaggtggaggggttttttgacttgcaagcagagtagatttaaaaaggtcagtggctggtaggctgacatctagtttaatgtagtaggaattcaaataatacttaaatgtttaagtaacctttcatttttccttaaataagatattaagtaatatcttgaagtgaaagtttgtttagcagtaaatgtcagtcttggtaatgatggaactttaatcctgtttaccatgtcctctcacttttatattacacgtgcagttggatttttaaatgtgccgtttcactgatttcattttatcggtttagaaatacagcatacatttttgtaatatagtgaagtttcttccagctgctcaaattaattaaacaggtttagtttgggatttttaatatggaaagtatatgtcatatatgcaaaatattcaagaaatactggaacttctcaaaatgttaccagtgataatcagtgtcttcaactcttgtttttgatacgtgtgtgtgcatgtgcattatcccattttaggaagtagaagacatataaattatacttttgttgtgtctttttttttttttttctctattttcctaggactagtagatgctgcagtcgatgcagcaccaggagcaggtgtgtgtataccattgcatggccaatgtttgggtggtagactttaaactccaaaatgtgggtgacctggattttcagccaactaacatctctagttttgcagtgttgctgttgttccatacttacagtttttctctttaacaacaacaaataaacttttcttacaataaaagtacaaattttcatttgaaattaacatctgagattcatactgaccatcatcttatgatgtctatttttgcatagagcttaaaaccattttgatttttgtttgtttgtttgtctgtgtttgttttttgagatggagtcttgctcaatcacccaggctagagtgcagtggtctgatctcggctcactgcaacctccgcctcctgggttcaagcgattcttccacctcagcctcctgagtaactgagactacaggcgggagccaccatgcctggctaattttttgtacttttagtagagatggggtttcaccatgttggccaggctggtctcaatctcctggcctcaggtgatccgcccacctctgcctcccaaagtgctgggattacaggcataagccaccatacccagccattttgagttttttaagaaaccatttaacaaatgtattaaactctttcaatctatgagtttttaaaatgctccttctaaatcaggaagtatgtaagatgatggtagcaaaaggatcagtgaaatttaataagaggctctctggttgatttatttttatgttaacatctaatgttgttttaaaaggaaagctgttttctagagattcctagtcctgagtacaatgttggcatactagttaaagaccctagggatatgttctttccattttcttcattagaagattgttttatttttactatatacactttgttatattaataatattaatagctaacacatagtgcttaccatacctcagacactcttctttacatgtattaactcatttaatgccaaaataactctaagagatcagtaataatattattctcagtttacatataaggaaactaaaggacatcatcataactgtcacatgggagataagtggctgagctaggttgggcctacggtctgttcttaagcactacaccacactacctctcatacatgtcagttttcccttgattcacatacatgtgaccatgcaaaagcaactcaggaatatggatctaataaggagtaagactaacaggaaatttcaattatagctgtatttatatttctgtaactcttagacttgccttggttaaagatttacagtgtttgatcttcatgtttattgtgtatgcaaataaaattgactttatgggtttggaatgaattgctttttgcctgaggtgaagaaaacggtgagtttttttctgtgcttgaatttaattggactttgttctttgcccagtagtaaaaatagattttttttttttggtcatttgctatgttgttttcacaaaaatattattttcagtgacaggacatattttttgttaataattctgtataattttattaataattgcttgtttacttatatagaaatattttaatataattttgatactttcataagagaatatttactttcatgtgtatttaaaataattctcagcctttcatgaacgtaaaatttggacatagttatcagggatttcattatcataagatcattaattgtgatttaattcagtatattttgtattaataaacagaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgtaagtattctcaagttgaatactgatttttctcagtggaatgttctttgctagtatactaggctatgaattttaaattatgaaaagactgttgagttagtttttcagtgttttattaggtgtcgaatctactaatcgatcaaaaagtactattccaatttaagattccaataatttttattgtgcagcactcagaattaaaatcagtacattttattatgtattgaattatacatgataaaaattatgaataagccccactagttttccaaattcagatcaggagcttattctagttttttatttaaccacagactaagataggcaaagagataatgggccaccactgcttcacctgtaaaagatacacatagaacagtgtggccattggaaatgggcccggaacagtggtcatgctgccattactctcttccaaaaagatgttaaatctctaatttcacatttttttttcctttgagatttcacttaagcctgatactctcttcatagatcagagaatcagattcttactcattttataactttagacataaaacctagattaggattcaagaaactgatttaccaaacaatttgttttatggattttgtttaatggctaaactaacatggaattcctcctttgttccagaaaagtaaattcattttaaggtgaatattttttcatcctgtatttaatattacttgaataaaaaaagaaatgtacttgaaataatattttaatattaatacttgaatttttgttgaggaggccaaataggctatatggcatataaaaaataaaatgttatcttttaaaacttttgtgatttgggatgttccatgatcatcagtcctttgtcttcaaacaaaactaacatatctctaaaggagaagtaagaaataatagcttctctaaatactgtttcttcagctactatcattattgtcattaaactttaggagcaagccattgacagagaacatgagagagatgtattccaacaggaaatacagaaactagaacagcaacttaaggttgttcctcgattccagcctatcagtgaacatcaaactagagaggtaagaacttcactgatattgcccaacttacagtaatttgtatcaagtgtaaaataagatgcatatcattaaaaacttaaaagtggattctttcctttgtatgtaaatcttcaaaatcagaaaacttaatattacttaagcatgagaaggtaattaaccctgaaaattgttggtattgaaatttggaatcatttccatctgcatatgtcttctagtatttctcaattaaataaactctgtttatttctttattcccattcctaacaaaagtgatcaagagagttatctgtgttcactgtttactttcccatttccttttctcttactagtccactccagtgaagtatccagcccttgtttctcagtagggttataccttctactccatttaaattgttcttgtgaaggtgacccagagcctcatggctatggctaatatccaactctgtctccatcctcctcaaccattcagaggcatttattgcagccttctcccagaaatacttccttctcttgtttctgtgacacagctactccactggtctctctcctctagtctttgtttctccttttcctacccagcataaatgatggagtgccccaaaacttactcttgggcccctttttatttcctatttatagcctcttcccaggcagtcatatataaatgcctccacatttgtatttctatctgtgacatttctgttaagttccagcattggatatccagtgcctactctgtctctgcttagatgtctcaaaattaacatgtccaaaagaaaggtcttgattcctgattagccactaccagagaaagacaagcataaaacatttttcttcttcatctcagtaaattctgtaccttctaacctgccccattgctgagaactagaatcagccttgattctcctttctctcaacccctgattccaacccactgatgggtcagactgcactacatctttctgttatttgcacttttattcatcttcctaaatcccacttgtcacttgtttgcctggatcactgtggtagcctcttaaccagtctccctgcttctcctttttcaccccaactgcccattttcctcatagaaacatagtcaaaactccacatttaccaaatgaatgctacataaatgagagaggattcactgtatgaatacctaaagatggcttgtcatggtgataaagacattgtgcttagggtaaggcaatcccagtttgtatcatggctctgccatttactaggttatgacaataactaagtcagttaacctctcaaatctctgttaattcatttctaaaatagagattgtaatagcacccacatcataggagtgttgacctggcacatagtgaacactttaactagtattatttctgaaacaatttttatttcgaatgtaatttctaaacagttcagtggatttcatttctcttaaaagaaagccgaagaagtacagagtgccaataaactccttataataaaatgttgtatactagagtagtacaaaagttatcagtctccagggctgggcgtgatggctcaagcctgtaatcccagcactttgggaggccgaggtgggcagatcacgaggtcaggagatcgtgaccatcctggctaacacagtgaaaccccatctctactaaaaatacaaaaaaaaaaaattagccaggcgtggtggcgggcacctgtagtcctagctactcgggaggctgagacaggagaatggcatgaattcaggaggcagagcttgcagtgagctgagatcacgccactgcactccagccttggggacagagcaagactccgtctcaaaaaaaaaaaaaaaaaaaaaagaaaaaagttatccacagtttctagttattgccccatttctgacaaacatatttttggcttttaaaaagtagtcgtttgttgtacttcaaagaatatttaagctctagaacctaggctgtcatctcctattatgtagttttcttttatttgaaaaggttggcctgctttgctcatgaaactttaagaaactaacaaagatgtgcatgtttgattttttttttctactgttgcaccattttattgtacctacattgttgccttttttcttaaccttactccaaatcttagtcaacttattattattaaagtttctcctcagcagctttttttttccttttttttctttttccctttaaaactgactgcacatatcagtgactttattgctatcatccttgaacctgaaattatagttaagcttgcattcttttaatgttctgagaaataactgtcattttttagataatttcctcagaatatttcactgaaaagaaaaggtagaattactttatttcttaccatcacatgtcgctttttttaaagtaagctttccttcctcactttccatacagtacaactaatccttcctgtcacagaaccattcacttgaagggatctccatatcattcttagggaataggtcttggcatgcatcattattttggttaaaggagaaaccaagactagagacatttagggaaaccttcaaggtgcacagatccctctcacaccccttcatccttagctctttcctgggctgatggaatgtatagattgaaaaagctttcccaatgactgttttcaaaatatagtccataaaagatttatttaggtcattttatctcatacaagagtaaatcagtacctgcaaatttgtcatcttcattaggatttagtgtggttgtgccattagataattcagccttatgaaaaatccattttttcccctcttcctaggtggagaaagtcttagtcttaagagaaagattttttaaaggattacgtgaaagcaatattacttgtggtctactagtgttgcttaattttttcaacttgtaaaatgtcacctttgttggagacaacagttgctatctttatacaaagttaaattagcataacatttaaaaatactttttagaaaaaaatttttgaaatgaagatatgttttatatgcattgagtattctttaaaatgcttgagagaagtgtttcagatttcagatattttgaattttgtaatatttgcattatacttacctattcagcatcctaatttgaaatgtgaaatgctccaatgagcatttcctttgagcatgatgtcagtgcttaaaaagtttcagattttgacctgggcttgttggtgtgcatctgtagtcccagctactcaggaggctgatgcaggagaattgcttgagcccaggagtttgaggctgtagtgcatgacgatcgtgcctgtaaatagccactgcattccagcctgggtaacataatgagactccatttcttaaacagacaaacaaaaacgtttcagattttggagcattttggattgtagatatccaaaatgagggataactcaacctatactaactagcttgctgaaattttttttaaattaaattttttgcctcttatatttcaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtgtggcattttatttgggctaacttaataagtgttttaatgaagaatactcttaaattgtcaacttcttgtaggtattattacatattatgtttatatctctgttgacattgtaaccatttctgtttgttcttatttccaaatgttgcttgcatgtcttagtcctgagaagggaagagttttttgttgttgttgttgttttgttttgttttgttttgttttgttttgttttgttttgttttttggagacatagtttcgctcttcttgcccaggctggagtgcaatggtgcgacctcagcttaccacaacctccacctcccgagttcaagcgattcttctgcctcagcctcccaagtagctgggattataggcatgcgccaccacaaccagctgatttttgtatttttagtagaaacggggtttctgcatgttgatcagactggtctcaaaatcccaacctcaggtgatccacctacctcagcctcccaaagtgctgggattacaggcgtgagccatcatgcccggccaacttttttattattcactaattagaagtagactttctacttctaattggagaaacaggattgctgcttctcaaaaaaaaaaaaaaaaaaagcagaccaaaaaacaaaaaaaaactggataatcaggatttaatttatcaaattttgagaaaatttttatatatttaaaggtagaggaccgaaaacactttggagctgtagaagctaaaccagaattgtccctagaagtacaattgcaggctgaacgagatgccatagacagaaaggaaaaagaggtaaggagtttatttttaaatgacacagcgtggtttgaattattttaaatcagttaccttgaaaatattatttgaactgaatgtagtttatgatctaaaaccaaagttgaggctgtttctcagctcaatgccaaaattgaccttgaaggcagtaaacatatgagtaattaagctgacgggaaagaagagtgctccagatagagagaagagccagtgtaaaggccttgaagcaggacgaagttcggaggaacaggaagaaggccagtttagcaggagtgtagagggtggagagatatagtagtgttaggacaaaaggcaatatatcccttttctcctaaccgtagaatacatattgaattattgctgctttgctgtgtggttttttttttttttattgtattgccctgggagattatagtcctgttttacaatatacagaatatgttcttaaaacaaaaagattaatagtaaattgctttaatagtaaagcaattaagcaattatataaagttctcctttgtttctctgccccttcttccaaaaaactaaaaatctactttcagaacaatggtcacctcaacttcctaatttataacttatttaagcctttgtctactaatagtttttaaaaaacatatcctactctatctacattgtctagctatatcttatcatttaaaatgtttaaaatttttaaaattacatttttgtctctaatattctgagaagacttactatattttaacaaatagttatgaacttaagctgctttgaaaaatataagaatgatttagatatcagctaaaactatagttcagaaaacctgtagattagaggagaaaaaaggcatctatgtaagtgactgtagttgaaatcatttccatgagaaggattattttctcactatcacataatactgagtaatgtttacctgagaggctcttatttattttgacttttgattttttttattggaggtggggagcatttttgtttatatgtaactatttctgtgtttcaaagagctaacatttaaagatttcccttaaactgagtaaagtaatttatatgttgcctaaaaagacagaccttctcaactggacccaaagcaatgatagttgactgtggataattgattaaccttactgattttatatttttattatcttctgaatataatatagcactgctatcttgaattaagtatctaataactgtctaccttttactcagaatcatagttgttcaaaactatgagaaactttagagggcatctgtcaactgactgatgttttttatagataaggagagaaacggtaaatgagtaagaggttaaactgacagctgaccctaataacagtaacaagtactttatcaaaacccattcacctaccataactggagactgagaggcaggaacatagaattaaaatgtattttattgaaaataacttcttaagcattttttccccagaaactaggcaaatgctttcagatatctgatggagtataaatataagatgtccctatgtatcatggtatttgagatacttttctctcagagcctaaatttgtataaaacattttttaagcttattagaaatttagaaatgcaggatgaataaaaagagaactctaaaagaaaggagttttagaattataggaggaggtagaaaatggggaaaggaatagaaggattttagaaaaagatacgttccataggttttagctctctgtagagctaatgagatctagcttagagttagcaataataaataataatagttttgttgaggcctatctaattagacagtactaagtatttaaatgcccttttaccgttaacactttcttcccgaggacagactctgttatccccattttacagatgtgtaaactgagccttaagggaagttaaataacttgatcatggtcacaccttaagtggttgaaaaggagttcctctcagatttctgtgagtctgaagcccttgtgatactatactgccaaagcattggggcccattttgtcttgttggtgagaagtgttaaagactgccattcaacatttagtgagctcttaatgcacctgtagcaccagtacccaaatgtaaaactagcggtggacgtcaaggaatctactgtgtaattaaggagacatatgtacatttgaaagagataaaaacactttttaaaaaaggaaacaggccaggcgtggtgactcacgcctgtaatcccaacactttgggaggccgaggtgggtggattactaggtcaggagagcgagaccatcctggctaacatggtgaaaccccatctctactaaaaatacaaaaaaaaaaaaaaaattagccgggtgtggtggcgggcgcctgtagtcccagctactcgggaggctgaggcaggagaatgctgtgaacccgggaggcagagcttgcagtgagccaagatcacgccactgcactctagcgtgggcaacagagtgagactccatctcaaaaaaaaaagaaaacaaaaatagatgcaaattaatccaaacattaatttcaattattagataaattaaacaagattaaaacaaatatttaccagcctttgtttttaaatcttaataatgttcttctggttgtaggtggttacaggctcaataagaagagagcctagtactaaactagagcctgactgaataagaggaaagaatgtcccatagtgtcatttgggggaattgaagtgtctgatatgatgcctgaacttcagctacttagaataggaaagttagtgctttagaccagtgcatttcaaactttaatgcacatgcaaatcacccagggatcttgttaaaacacaagtcttacacaaaaattaactcaagatggattaaagactaagacctaaaaccataaaaaccctagaagaaaacctaggcaataccattcaggacataggcatgggcaaggacttcatgtctaaaacaccaaaagcaatggcaacaaaagccaaaattgacaaatggcatctaattaaatgaaagagcttctgcacagcaaaagaaactatcatcagaatgagcaggcaacctacagaatgggagaaaatttttgcaatctatccatctgacaaagggctaatatccagaatctacaaagaacttaaacaaatttacaagaaaaaacaaccccatcaaaaagtgggcaaaggatacgaacagacacttctcaaaagaagacatttatatggccaaaaaacatacgaagaaaagctcatcatcactggtcatcagagaagtgcaaaccaaaaccacaatgagataccatctcatgccagttagaaaggtaatcattaaagaggaaacaacagatgctggagaggatgtggagaaataggaacacctttacactgttgatgggagtgtaaattagttcaaccattatggaagacagtgtggcgattcctcaaggatctagaaccagaaataccttttgacccagcaatcccattactgggtatatacccaaaggattataaatcattctactataaagatacatgcacacataggtttattgcagcactattcacaatagcaaagacttggaaccaacccaaatgtccattaatgataaactggataaagaaaatgtggcacatatacaccatggaatactatgaagccacaaaaaaggatgagttcatgtcctttgcagggacacggatgaagctggaaaccatcattctcagcaaactatcacaaggatagaaaaccaaacaccacatgttctcactcataagtggaagctgaacaatgagaacacatggacacagggagggaaacatcacaaaccagggccttttagggggtgaggggtacaggagggatagcattgggagaaacacctaatgtagatgacggattgatgggtgcagcaaactacaatggcacgtgtgtacctgtgtaataaacctatgcattctgcacatgtatcccagaaaagtataattttttaaaaaagattaaaaaggaatatataatagagttcatttcctatctgattactgtaaaacaataaaatgagtcaaaaattaaaaaaaaaataaaacacaagtgtggggtgtgacatggcattttgcacacccagcatgctcccacatgatgccaactctactgctctcgagaccacactgaatagcaaggcttcatgtcacaaagttaagaaattgatcataaactgttgtataaaaaaaggaaatttcgtatgagatagggcagcaatttgaacttaaataactatttatgtgttgattttaaaataataccttgtcatcaaagtagttacagaaatgtagggatagttgtaaatactatgttaaatcactttgaagaagatataatcattgcagttttcagcaacctggtaattatttatgttcagtcattaaatgtatttcagtgtctactgagtttaataaccagtgttacagaaaaaattttaagtgtaagtcttagacattagttattagaagcaggataagtgatagtttagagtggaagattcagagataaactcctcaggttcaaaagctggcttctccacatactcgccatgtggcctgaaagcaaattactcctctctgtgacgtccatcctcatctctaaaatggggatactcagaacagatcttataaagttgtaacagggttttaagaaataatacatataaagcactttgtgcagtgcttagcggtaaactgttacaagtgatggctgttactactagtattgatactgtttaggaaatactaagctaactggtttttaaggatttgccagtgttcagatatggttctcagtatgtgatgtgttagtgtgtaatcagcgattccctctttcagtttctaaggcagtaaatgattcataagctgctttctgagccacttgtcactaagtgttgctgaggataggctctgttgccttagataacagagatgctcctgcatcttagtttgctttttgatcagcagttttgatcatgaggtaaatacacatttggaaatcattcattcactttgtattaagtagcaacaaaccagtgagctaaatgaatgttactgtcctcagtcaaaaccaattttcaaatataaaaataattcttaatattcatcattcgtttcagtctctaaccatcaaaaagcagttgctttaccattattcataatccatcctcaaaatgattaaataaatttctgttgtcctacctataggagctctctaattttctcctgaattgtataattcacttactctaaggtttttgtaattcagacctaaggatctcttggtcttagtttctatcttggcttccttctgcttaacaaaccacatggcagccaggccttttagtaagttaattagatatttttggactaaattgagttagtcttatatggtggctaacaaaacaaacagttctacaacttttctaggccttttgatagcaacttaatgtaacataaactaagatttaatatgtggactctttcccttcctcctatgactcttttctgcttcaggagaagagactaaggtaggaaatggctccttttatccttcctcaggaggtttcctctctgctttgtgtaggatagtttaaggatggccagtttgagcatgtctaggaaccacacaggtaacacagattatacctggcttagaaaaaccacattcctttattcttatgactcatgttttaagcatgcatactttgtaaagctaatatagcactcttcattttatcttgataaacgtttgtataaacattttttctcttttgataattttgttattaaagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggtaattagttaagaaaaacttttatctgtaaataagtcatagtttcagtcctatattgctttattattattattattattatttctttctttttttttttttttttgagacttagtctcactctgttgcccaggctggagtgcaatggtgtgatctcggctcattgcaagctccgcctccctggttcaagcaattctgcctcagcctcccgagtagctgggactataggcacgtaccaccacgcctggctaatttttgtatttttagtagagatggggtttcaccgtgttagccaggatgctctcgatctcctgacctcgtgatccgcctgtcttggcctcccaaagtgctgggattacaggcgtgagccaccacacctggcccctatattgctttattaagcattcgataaatccagctgttaaataatactcaacagaggaacattaacaggcagacacatttgcatacagcttattttcagcccaacctgaacatttgaattcatcataaatgaaaattttgggatcatttatcaaaatattttagaattattgatttacagtaaccatatggtgtctctgattttattcatttgtacgttataggctctgatttcttttgtaattatgttctgaaaatgataggtaatgatatatccaactgtgataattatttttgttcctaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggtatactcatttaaaattgattatgaaattaatatgaaccagagttttaaagggcaaaatggttataatgttgctccccattgaatttaaaaaacaaaccaattttattttattttattttattttatttattttttttgagacagaatctcgctctgtcgcccaggctggagtccaatggtgcaacctcggctcactgcaacctccacctcctaggttcaagtgattctcctgcctcagcctcccgagtagctgggattacaggcacccaccatcacacctggctaattttttgtatttttaatagagatggggtttcaccatgttgaccaggctggtctctatctcctgatgtcaggtgatccacccacctcagcctcccaaagtgctggtattactggcatgagccaccacgcctggcccaattctcttttattaattttaatttattaagacacattggtggccaggcacagaggctcacacctgtaatccttatactttaggaagcctaggtgggcggattgcttgggcccaggagttcaagaccagcctgggcaacatggtgaaactttgtctctacaaaaaatataaaaattaactggacatggtggcataccacctgtagtcccagctgcagtgagcctcatcatgccactgcactccagcttgggtgacagagtgagaccctgtctcaaaaagaaaaaaaaaaaaaagcaaagacacattggtttaataatttatatgtatttttctcccctcctaatattgtcataggattctaatgtttttcagaaaggctctgtgacttagattttatcatgttattctaaccaaatctattataaattataatatttaatatgagttaagtaaggtaattacctttggtgccatcggttgtagactttatttccgtacttcatccttttccattaagaagtattgatattgactattttcctaatagggaatcagcaactaaaagcttatattactttatacttaacagaactttctgagccttgtttgatatgatgggggagatattggtctataatgaaattaagtagtatgtctgagaagtagtgtattatttttgtgtgtgatcatctctttgaggtactgccctaaaataaagtaaaattttcaaaatgtaaatacatatatattatgtatgttacctttttcattaattattaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaaggttagttttgtattttattagtttcatttaaataccccaagaaactaagctgattgctaatttactaaatatggtgttctgtttacatctaacaatttatacaagaaggtttttataaaaatataccacttataaaaaataaactcttgttaaaagaaaaactaggacaggcgcggtggcccacgcctgtaatcccagcactttgggaggccgaggcgggtggatcttgaggtcaggagatcgagaccatcctgtctaacacggtgaaaccccgtctctactaaaaatacaaaaaattatccgggcgtggtggtgggtgcctgtagtcccagctactcgggaggctgaggcaggagaatgctgtgaacccgggaggcagagcttgcagtgagccaagatcgcgccactgcacactccaacctgggtgacagagcgagactccatctcaaaaaaaaaaaagaagaagaaaaactagacaaactaaatttacgagagtttatttgaacaaaaaaggattcacgtattgggtagcattcagaaccagaggagtttcacaaatctcttttgtgcaacagtggccagtgaatatttatagacagaactaccaaataaaatacagaaatagcttgattagttacagttaggtgtttgccttatttggacccagtctgctcagttgactgcttgtcattagctaagagttggctgtttattatactcctaagatacgttttcagtttgcttacgtactcctaagttagattgtagttccttacataggaactcaagatacagagacagcctcaggccaaatttaacttaacactgtgtagtcatattattatcactaaaataatggatacagactgtattttatggtctttaaatatgatatttatttcattaacatcatcattaaatggagcagtcagaagaaactaagaaacattaattttagcaaatgttctctaggatttatggggatttttttcttaatttgcttctaatatgcatgttatgttatcattccttttaagtaataataagtatgaaaatatgttaggattgacaaagaatgcagactttacagaaagaaatctattatttaatagcatctactgaattaattaatgtgtgggtgacatattttacaattttttttttttcttgagacagagtctcgctctgtcgcccaggctggagttcagtggtgtgatctcagctcactgcagcctccacctcctgggtttccagcaattctcctgcctcggcctcccaggcggctgggattacagacacgcaccaccacacccggctaatttatatatatatatatatatatatatttttttttttttagtagagacgaggtttctccatgttagccaagctggtctcaaactcctgacctcaagtgatccgcctgccttggcctcccaaagtgctaggattacaggtgttagccactgcgcctggccagcttttacaaattttatacctgataatagatttcatctgttttaagtaaaaatgcgtagttgacctctgtaagtttacttatgagaagatctgaaatcgcagttatttcttagcatatgacagataggacaagagcttttttttcctccaaattctcaccttataaatttataactttgagtagctgaacttcagtcttctccaaacaccagaagattaactgataaatcacaattctataattatatattttgcaaagaataataattccctggctttttcctccttcattggaactaagttacttaagttatagataattaaaatagtaatataactttctttttttcctggacacagagtcttgctttgttgcccaggctgaagtttagtggcgcagtcttggctcattgcaacctctccctcctgagcagctgggactacaggtgtgcaccacaacacctggctaatttttgtattttttgtagagacagggtttcgccacgttgcccagactggcctcaaactcctggcctcaaatgatctacctgtctcagcctctcaaagtgctgggattacaggcgtgagccaccgtgcctggcctaaaatagtaatgtaactttccattttaggatgtatatgaataacattacttaccttttattcccagaaaatcattcttttctcaagaagaaaatcattgtctcaagaatataagatgatggttctgaaaaagcttctctgtttttggaaagagcattgatttgttccaactccttatatctgtaggcagtcattccttggatggttttattagaatgtataagagccttgaatttagctatattttttttaaattatgtgtttcttgtgtttccgctgtcattcagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaagataagtaacatagctcctaattcactcatttctacctatcttaattacgtttcaaagtatatactcttttataacaaatgagctccataacttaaaagctagataaaaagtattttgtggatttgatgaaaactttcattgttataaatttctttaccaacatcttcttgcttggttttcctggaaatctttcttaggaggatactttttatttccattctgttaatgaaggagtagaaagttgttaaagagaactgtatatcccatgagaaccaaaaatagaagctaataaaattatttcatttctatagtaatctatgaccatacgtacatacaaatatatatatgtaaactgtgagcgtttctgaaatgtttttcctactactctgaggaaaatgaacgtataatcatgaattacattcctcccacaccctttaaattctacatttaatatgggaagattttaactgaatgccctactgttctattcattacgttttaggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagaggtatttggtttttataatatgtgtttttcaacattgtgtggttttttaaaaaaaaaaaatcagtttaattcattttgtagatgacaaaccaaaatgcaactcattaaggcacttgatctttctaagtaggtgtattatcaaggcaagttttaaactcctagtacaatattccttttttttcttttgttatactttaagttctgggatacacgtgcaggatgtgcaggtttgttacacaggtatacacgtgccatggtggtttgctgcacccatcaacccgtcatctacattaggtatttctcctaaagctgtccctcccctagcacctcacccccgacaggccccagtgtgtgatgttcccctccctgtgtccatgtgttctcattgtttaactcccacttatgagtgagaacatgcagtgtttggttttctgttcttgtgttagtccgctgagaatgatggtttccagcttcatctatgtccctgcaaatgacatgaacgcatccttttttatggctacatagtattccatggtgtatatgtgccacattttctttatccagtttatcattgatgggcatttgggttggttccaacactgtgtgcttttaagagaaaataaaaaaacgggggcagtctcttccttatgatcgcaattttaatggttttgaacttttttaaatttaaagagtttttagttttaaatttctttaaatctttccattgcatagagttaaataatatatgatgttcctgtatggatttggaacatgttatctttccttaattcatgagtatctcttcttatggtaatattcatgaagaaacagacttgttaaaaaaaaaaaccatgaataatttcatttattatgaaaggtgtgacagatttgattgattacagcacgggaaaccagcaaaataattcattgtattctatttttattaaagcaaaaaatatatgtactttttgttttctctaattagggatcctcaattcctgagctagcacattctgatgcttaccagactagagaaatatgctccagtggtaagttatataaatatttgtaatgtttgtagtagttgtttaagaaataatagttttttggggactggggtttgatttttttttttttaacagcaaattattttctttattttagattctggatcagactggggtcagggaatttatcttacacacagtcagggatttgacatagcatcagaaggccgaggagaagaaagtgaaagtgcaacagattcctttccaaagaaaataaaggtactaaaagatagataccttttattaactcagccagtgttgtttctatgttgaacatagcagttcattagaagttatatggtgggatcatttctgaagagagaattgcttagctagaaggaatctgagagatctattttatttccacatttcacagataataaagtaagagattaatgataatatgtatgaagactttttttcttaataattcttattcctgatgtattcgtttgccagaatttttaaagtagtctcaaagagtagaagttagagcccatgtatttattttggtcaaatcagtagcttatcagtaaacctaggaagagtacattagccaaacagaaggaacttagagatgagagctatggaaagtcataggccatctgctggggttggcttacccctccacaggaagaaggcattcagtaatgttgggctggagttttctctctgcaagctatcttgcttaaaatttatttctgtttgtaagtctaatttttcagtctgtgaagaagttgtcataattctggctcttgggttttggtttccagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtaaccaaagaatactatgcatttaaatcattttatgtattatttgaacaataataatacattataaattaaattatcttttatacatatttttgcatgaataactatatatatatattttcacacttgaaactcagccagaagcagtgcctcatgcctgtaatcccagcactttgggaggccgaggtgggtggatcacctgaagtcaggagttcaagaccagcctggccaacatgttgaaacccgtctctactaaaaatacaaaaattagccaggcgtggtggtgggtgcctgtaatcccagctactcaggagaatcgcttgaacctgggaggtggaggttgcagtgagctgagatcatgccactgcactccagcctgagcaacagagtgagactgtctcaaaaagaaaaaaataaataaataaaagaagtacacatgctcctaggcttttaattatttttctttgtagattaatatttttagaatgtttttaaaacatgcttatttgaaaactaactatcgttatatgtactttgctaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacaggtataatgaaacttcattttaaaaacactttaatagaaataaggaaatgactattgattttagagtcttaatttaagtatgaaggttaagattttaataggagccactatgaatattttaaaaaaattattgtaactattttaacgtattatgttagaaggtaagaaagactgaaagttaatgagcttattttctaacctaggaaattagaaaaagagcaacagaataatcccaaacaaatttgagagagtaaattctcattatttgcactggttatgttccataaagttgctctgaacattgagcggtcattgctcctaagggaaatacaaggttaggttcctgtaagcctttggtcacaacattttcatcagtcagcacataaccttgtctatatgtgattctattttaagacaccttatttactatatattattgattgattaaccttgaacaccaccaacagcactataactcatgcctgaaaaaaacttgtctgacacacatattttctccttaaggcacatcacagccttctcgtacttaggaacaccataaagcacttcagcactacttttgggggccattctaaacagtgaaatcacaaataaaaggcacaaaaatttgaaaagtcactaagtactctgtaaaaaggacatttgacttcagctggggacacccacattggaccatttaaattttttgctgctgtatgcatttctgtgaaagaccatgaaagcaacacaacaatggatttgggagttacaaatacattttagtgagaaggcaaatctgcaaatatggaatcagaataatgaggattccctttaacgaagaagacgacgtcaatagacacactggtacaataggataaaatgttaaaagttggacatttgaacttttctggagaattggttaagcaaaatgataaagcacacatttttaaagttaggaatgaactaaagatatacctgagatataaaaataatagaatattatgaataatttcatgagagtaaacttaaacacttgggtgaaatggacagattttctaaaaagaaattcacttatgaaaactctttcagtaagaaatagaagacctccaaagacctattactagtaacagaatcaaatcaatagttaaaaatctactcataatacttaacacccagatctttttttttaatatattctccactgaaaagaactaggacttcttgtagaactgatgattctagggatggaccagggaaagtataaggtgagcctggaacatcttgttttgctggcaagtaaggaattgttcaaagaatgaagggaacatgtcgaaaggtcatagaagccagcttgaaggagctccaattgaccaaattctagaaaaatttaaacattatattaaatgatagtgacaaattataagccaaagagtgaaataagaactcatgagaccatactgatataaataaataaatatatatataaataaataaatagtattaccatggaatgacagctagtaaatgtagaaggaacaatgaaattaggaaatcaccctttattaaacactgtagtgttaaatcaccctttattaaacactattcaggcaatagttcgcaacagatgctaaaactagtgtgaaaaggtttgttaagaaagtatatttacatagtctcaaagtaaatccccagaaaatcttctttaattaccagggaaaagcagtaactttacagtggagaaaccttgcagataccaccttaaccaagtgatcagaattactattaccagaaatggaatagacatcatacagttcctaatgtgaagggcacgatgccacttttgtagtgtttttgtcaaatgaatattcagagtctactcttggggaaatatcagaccaaaacaaattgagaacactacatctatcaaaataaaaaatagtgacagcaagtactggagaggatgaaaagaaactgtctcatagattgctggtagcaatgtgaaatgggagggcaatagccaaaaactggaatgttctttgacaggggaatggatggacaaaatgtggtacatccatacaatgaaatattactcagcaattaaaaagaaacaaactatttatgcctacaaccacttgtatgctatataatgctcttaaaatgacaaaattatagtaatagaaagcagatcagtggttgacaggggttagggttagggagagagtttgactacagaggagtttcttcgtggtgagaaaacagttggtactctgatggtagtggtggttacgtgaacctatccatacatgtgatcaaattttgtaggactacacaccaagaaaactaatgatcaaattttgtaggactacacaccaagaaaactaatgtgaaaactaatgaaatctgagtaagccctatagtttggtattgtactaataccattttcctggttttgataatatactatggtaatgcaagatggtatcattgggaaaagctggctaacagatacatgggaactttagctttaattaattcaaaataaaaagttttttaaaattgaggaacgtacaacaaaatagcctgtagtcttcaaaaattcaaggtcatgaaagacaaagaaagacttgggaatatcactttttttctttttgctgtgaagtacatttcacaaaatttgaataggctctgtatatcacataatagtattgtagtaatgttaattccacttttgctaattgtagttatgtaaaagaatgttcttgttttaaggaaatacactctggtatttagaggtaaatgagcatttgtctgcagcatatcctcatacattttggaaaggaaaaataagaaaattttttaaaaaagaaaattttagtatgtgtgttccattcattcttctttagatttcttggttgttaattgtattgcctttacattgctcttcacttgttttttaccttcctttgttacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaaggtatgttgtatgacaagctcatatggttacacaaacaggtgaaaagatttcactttgttttctttcttattattattaagttaaaacatattttcttggtcacattttcttctcattctcataatgttaaggatacaatctatattaattactctaggggttagaggattgtctaattggtttaaacagctacgttgactttaaaataaactgccattcccctgataaggttaagcccattggattcattctttttctttattttagagctgtatgttaagaaaacagtctttccaatcataaaacagaaaatactctttagaggaaaatccacaatgcatgtaactaattattttttaatccttttttaaaaaaattgtgagccataacatacagaaaattacaaattgcaaatatgcagtatgacgcatttttaaatgagtatctatggaaacatcacccatgtgaatatagccagtatcccaacagccccttctcccaagcacatgctcctctgagtaacttagaggtaatcattgttctgatttttctttagttttactatctatttatatattcctaaaacatttaagtttcaagtttttttctgtttttgaactttatcaatctgtatgtattttttatcttgtttctttcacctctctgtaacattcttccaacattcttccaagttactgcatttttcaagttactgcattcttccaaattagtagtagaacattcttccaagttactgcatttatctctagttcattcattcttgttactctataactctatgaccctgtgtagggccaggcacggtggcttacacctgtaatcccagcactttgggaggctgacgtgggtggatcacgaggtcagaagttcaagatgagcctagccaaaatggtgaaacccagtctctactaaaaatacaaaaattagccaggcgtggtggcgggtgcctgtaaggccagccactcaggagactgaagcagagaattacttgaacccagaaggtggaggttgcagtgagctgaaatcacaccactgcactctagcctgagcgacagagcaagactccatctcaaaaaaaaaaaaaaaaaaaagaatttcctgtatagatactccaaaattaatatatccattctattaatatgattgagcatttgggttgtttctactttttagctgtttagctatcaatgttattataaacattgttgtatagtgtttctgctacatatgtgcatgcatcttctgagtatatgactaagagcagaattgctgggtcatggaatgcctatcttagataaggtcaaatgattttcctacatagtcatattagtttatacacttagtagcagtatatgagagttacgttgcttcacatctttgccaacagttagtatagtcagacttctgttgccaatctgatgggtgtgcagtggattcttattgtggttttaattggctgttctctagttcctgaagggtttagtcctttttcatatggtaattggctagttggatttttatttttgtgatatgcttgtttaggtactttttgataacagtatctggtcttttaaattgagctacagatggaaatcattagaaagtaaagtgaaatctaattttcatcatgtccactgaggacacatacctgtgtgttcagtaattttgtgtcatgtactggtagaaacatgtatcctttggaaaattttgaaagtcacagcatggtctcacattggtcattataaagctgaagcaggctgggccctgtggttcacgcctgtaatcccagcactttgggaggccgaggtgggaggatcacgaggtcaggagtacgagaccagcctggccaacatggtgaaaccccatctctactaaaaatacaaaaattagcttggcgtgatgctcggtgcctgtaatcccagctactcgggaggctgaggcaggagaatcgtctgaacttaggaggcagaggttgcaatgagttgggatcgtgccattgtactccagcttggacgacagggcaagactctgtctcaaaaaaaaaaaacaaaaaaaaaaaacaaagcagaagcattcttaccactgagtttaagaaggaaaaaaaaaagcaggttaaaattacttcagaaaagagagtcataatgagataaacatatcactttaaacgtaggcgtaattgaagatgtcttttagagatagattaatattgttttacttaggttaaatagaacaccattgaaagcttaatgtcacagattcacatttatgtaaatccttaacctctaaagtttttagaagcctaaattaaacatgattgattatcatctaaagctaatgttatttctgtctcctaacgtcagtaatatgaattgtaatgtgaattgttgaactttgatagtattttttaagttaaaaatgtttttcttattagagtagtatagtattacatatttatggtagaatacagaaaagaatagagtgaaaatcatcccttgaatcacctaaatcctaaaataatgactacctaacacctgggtaaatatgtctccagaccttttcaatgtgcatgtgtacataagcttgtatttttcataaaaaaggaatcctgatacatattttataacatactttttttcatttaacatactgaggcatttaaaattttcagtttgtttttattgtagcaaacatgtagtaagggtttggttggctttcaatggataaaaggacggtatccaaaggggggtttgaatttcccacttctgggaacagactcctattaaagttccaggggactatctgcagtggggtgctgaacaaaagatatcagcagtgctcatcattgtagtaacttgggtaactcctccaaatactttgtgtgactatcagaaatctttggaattttttaatgtacattcttgaaattctgaatgtacaaatatgagttccatttaaagtttttttttttaattttaagtcttgcatccattaatgtattctcttaaacttttatccttatatatttatagctctgaaatcttggccactagcactatgaggaaaacatgcctgaaatttatttttatacgttaccaaccctttttgtttgtttttttgagacagggtctcactgtcactgaggctggagtacagtggcatggtctcaactcattgcaacctccacctcccgggctcaagcaatccccccacctcagcctcctgagtcgatgggactacaggcacatgccagcacgcccagctaatttttgtatttttagtagagacagagtttcaccatgttgcccaggctggtcttgaactcctggccttaagcagtcctccctcccacctcagcctcccaaagtgctgggattacaggtgtgagccaccatgcctggactgcattaccaactcttgggactataatttttcatgtttcctttgaagtaatctccttaactacaaatcagttcttatcaacaaatatttataaaccaaatatgagttgcttgattatgtttcaaatattaatcatgttctgtgtagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggtgtgccaggcttccttattaaaaacatgtaacaaggagtgggagtaattttgtcataaacactgtgcaaatatagagaaatgtaacatgcatgatatttaaatagcatgcaactgttttttttaggaaaaactataatagaaaaaactctaaatgtttccaaatgatgaacttatgatcgtgattatagcatattctctactgtgacttcagttctgtgtgagacttgtatgaaatagaattttgactttgacctttattttaccatcaaccaatttgaagtgatatttatgaacgcagtagaattcatgattgagtgagctaaaatatgcaaaatatttgaagagacaatgcttgttaaaagaatatatttcttggtataaatactgagatattctgttgccaaagacacattacaactagtcatttttatattgaacattagcttcacacacaaatagatatggtgattcccatgttcagtaaaagacaaaaattttatttactttttatttatttatttattttattttatttttatttaattgttttgagatggaatctcgctctgtcgcccagactggagtgcaatggcatgatattggctcactgcaacctccaccacccgggttcaagtgattctcctgcctcagccttctgagtagctgggattataggcacccgccaccatgcctggctaatttttgtattttcaatagagacagagtttcaccatgttgaccatgctggtctcgcactcctgacctcaggtgacccacccaccacggcctcccaaagtgccgggattacaggtgtgagccaccatgcccagccaaaatttttattaatactattttgtaacaataaattgcatagttgtttgcattgataattaataactagtaattgtactactagaaacagttaatttgaagccaggtgtggtgactaatgcctgtaatcccagcactttgggaggccaaggcaggtggatcacctgaggtcaggagttcaagaccagcctggccaacatggtgaaaccccatctctactaaaaatacaaaaaattagccgggcatgctggcattcacctgtaatcccagctacatgggagggtgaggcaggagaatcacttgaacccgggaggcggaggttacagtgagccaggatcgcgctattgcactccatcctgggtgacaagagggaaactccgtctcaaaaaaaaagaaaaaagagggccgggcgcggtggctcatgcctgtaatccgagcactttgggaggccaagacaggcggatcatgaggtcaggagattgaaaccatcctggccaaaatggtgaaactccatctctactgaaaatacaaaaattagctgggcgtggttgcgggcacctgtagtcccagctacccgggaggctgaggcaggagaattgctttaacccgggaggtggaggttgcagtgagccgagatggcgctactgcactccagcctggcgacagagcgagactccgtctcgaaacaaaacaacaaaaaaaagaaagagttaatttgaaatgaaccccagtcaagaatctttaatagtttatattttcctcttagctagtttattatatgcctcaacttatcagtagaagctgtttttctctctctcattatatgcttcgtcaacatagctttatggaaattcatttgtctttctgacttaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggtactgttatctttgtctttaaatgtctggaaaatccagaatgatagaagagggtcttaaggctttcctccatctaaaatgtcaaccttagacttcttaataagatatggtaagttgttcactgtgcattgaatactacataaaccgtattatgaggaaatgctaatggagtggtgattggttttttttgtttgtttgtttgttttgctacatccaaagatgcatatagactgctctgctgcaacatgttttgggcatgtgaattggtacacacagataaatatggcaatcctgtcagtttaatacagaggtagttttggttcctgttttctcctagggaagaggaacagggatacttttctggagccctcactgcttaagaacatttaaagtgaacattggcccctttcagagagacacacccctgctttgcaaggctctcagctcaaggcaggctgctttgagtatctgcttttaatagaggtggagtatacatgaagtatctgcttttaatagaggtgttgttgtctcactggctcagagctcttctagccacgtaatcctaattctcactaactctgtgctgaaaaacaatgtgttgctggcatttttgcccgattttttatttttaatgtccactgtgttagcctccaggcaaagagaactctctgcccggcagggacatgatatctccctaggtaccaattatagttttttaaccattaaaagtttatgtatattttgagttatttgcccctaaccttgctttcgttataagccctattatttttagcatgtgatactgcaaaacacaaggtttttcaggaactcctatcacattatatcaggaacatttattttttaaacaaatttattaatgtgcacaggaatcttatcaaaacgtaagatctccaggaacagttatatttttaaaggttgttattcttataagaaatgtaccctgcttcatattacttagtgagattaagattttttgagaaaagtattatcttacccttcttttatttatatttcatgattatgcactaactactgaacatttaagttaataaactaaataatcagttctattttctaataaagatactaccaacatagtattaataaaggcatggttgtatacttctgaagttttttttgtttttttttttttttttgagtcaaaagtctcactctgttgctcacgctggagggcagtggtgcaatctaggctcactgcaacctccacctcccgggttcaagcaattcgcctgcctcagcctcccaagtagctgggactacaggcacgtgccattgcacccagctaatttttttgtatttttagtagagacagggtttcaccatgttggccaggctgggcttgaactcttgacctcaggtgatctgcccgcctcggcctcccaaagtgctgggattacaggcgtgagccaccacgcccggccaagtatttttaataatattaacaagttcttaaatttgattttctcgtaccaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgaggtaaactgacagtttctttttagatatttttaaggaaagcactgcagccctttgatcattaaattttgatattggattaaattacttaaatagctatatgtaaatcacttaaaaatgaaatctatagaagtttattggatataaacaataattgtgttcccttaagatagactgtgatatgctgttcacttataattattgttttcttattctgtccaaaattgccagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagaggttagacttttctgcctgatctttgggaaagtagtattcttaggctgggtagaccccatgcctctgggacagctagccaagggtggggaattgaaattttaaaggtaatgcgtgtttacattaggaggtgatattctttaacagaactcaaatgtctgaaaacaactatctaacactttgacccagggaagaaagcatgggatataagggagaagtgataggtgaagtagaacgtcgcctgctctgtaatgtttgtggtagtaaacacccccaattgagaaggtatgttttgactttttgtctttttcttgaagactacagtttgaaacagcagatgatgaagatttcatttgggttcaggaaaatattgatgaaattattttacaactacagaaattaactggccagcaaggtgaagaggtaatactttttaaaagttatttctgaagcattgagagcaaagatttaatagaaactggataatttgaaacttgcagcatattctttatactctttatagagttttatttgtatctttttatttattttaaatatgaataataatgcttgctttcccccaagagaagataatgaaagcttagggggggaattagctttcattattgtcattgaataattatgttgaccttttactgtatggagacaagcttcctgaaagagtgatctggcttctatcctgtctactccatgaaacacccttagactcctacagtgtctaaacaattgactagtctggtgaatcttttcagtttatctcttgacttctttgtagcatttgatacttttgacctgttttattttcttaaaaccctctctttccttgcctgtcatgtcagtattctagcatttcttctgcttctttcatcagttgcctttatgattcctcttcctaccctcttccttcttttctctaacctataactatgaaagctcacacagtccgacaccctgagctctcactagacttatttattaaacaaatacttatattgaacacttattctgtgccagataggttctggagatacagtgaacaaatctgactaaaacctcacccttatggagcttatctttagtggactgtggttctagtctagacttctgtcctgtgttccaggtttatattttcaattagttactaaacatttttccctggggaaatgtaccccatagtgaccccttaggaacctcacaggcacattccaaactgaacaccatcttccctttctacttcctgctccagaccctcatttctagtcatgatattgcccagtttagaaagctgaaagtcaccatagaccactttccttcacccttatctgcacatctagacagtcactaaatcctgtccctcttaccttctaaatacctctcccacacaccctttactttctgtcccttagtcgttgcctccattcaggctttcagcatttcttacctggctgttgaaacaacttcctgataggtctacctgactcgaagattatatcttccctaatttcccctgctttgtacattactaccaaaggaattttcccaacacataaattttgtgtcatatttttgcatcaagcctttcgtgactctccattgcctacatttaggtctgttattcataaagtgaagcaatctagacttaccaggcaacctacaacaccccgaaaacaatacacactcgctcaagccttcgtgccttttgcttaatatgcccttccttatcttttctgcctggtaaatatctacctattactgaatactcaactcaagcaccaattcatgaattctgttgttctcggtgcctattcacactttatatgcattattcacatccatttgtgcttaagtgaccttacaccattttatttttccagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataatgtatgtccatttttagcatctccatatatgagaattagtgcatgcttatcatttctgctgtctagttcaagttttaatcctgttaatgtaaaactatcacacacctgattcttaggatctgtagaaaattttatagggatgacaataataatattattactaagttataataattactgttatttattggaaaccatctctgtactcgactctgggttgtatacatacagaatctctaatccacatccaccttatacctgagaaaactgaattgaagtcgtagtcaaaccaagatacttgtatctccaaagccagatactttgctacctagggaccaacaacagatacacgagatgttcaaatgtgaatcctgactgttctcttcatttaattattagttattgtgttgatgactcaattaaaaggttctgttaaattacgtctttcagtctgaaattactctgagaatttacttaaaatttttccatttaaaaacaggtataaaattaattgctagtttccataatcacccagtataaagatagaaaagacctgtaagacaactgtgtggttaaatacatgataacacatttacgtgccttttatagaaatccacttattatgtacatactggcttgtttttttcccacttctccagtacactatttcaggcacaggctcaaaatttgaacccaaatggtctgttaggtctcttgactttttcagttcaaagctctgctaatctgctaaaccttccctgtggccaggctttctcaaggacttttagttgtaaaactaatgtacttagcaaaggaccatgtacttaagagttagtgtatatgcgtaatgtcaattgagattggctttgaactttgtctgggtggggttagaaagttgagactgcatcatcatgcagatatctttttaatatgtttagctcagacttttcttcagagacttgtgtaagtaggctgtggtctttgcagtcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaaggtaggagacatctcccatctaaacatcacagctggttctatgtttttgccttctttcatctctcactgaccttaaataaacagtctaaagaaatttagggcctggcacagtggttcacgcctatagtcccagcactttgggaggccgagatgggcagatcacgaggtcaggagatcaagaccatcctggctaacacggtgaaaccccgtctctactaaaaatacaaaaacaaaaaattagctgggcgtggtggcgggtgcctgtagtcccagctactgtcccaggcaggagaatcgcttgaacccaggaagcggaggttgcagtgagccgagatcgcgccactgcactccagcctgggccacagagtgagactccgtctcaaaaaaaaaaaaaaaatgtagatagtattcaggttttgtctctaggtctttttattcagtctttgtcatgaatgcaggtcacagaggtttctggaaaggcatgcccaggactgggaccagattaacctttattaatggtcacagtggcagcctgggctcatggttccactttccctggtttcatccctaatagaccaaaagaatggtatcttttcaactcctaacaaaagctctactattgtcaatgtaagaacatcatactctgtaaaatggtaagccctctgaaaagcctctccggtgactaataatgaatgttgttaaaactaccttaatcagtcaacataaaattcaaaacaaaaagaaaaacttttggaacatttattccagtttatgactctgaagggatagaaaacattaacatttaaaaagttagattaggccaggcactggtggctcacacctgtaatcccagcacttcgggaggccaaggtgggtggatcactgaggtcaggagttcgagatcagcctggccaacatggtgaaatcccatctctactagaaatacaaaaattagccaggcatggtggtgggcgcctgtaatcccagccacttggaaggctgaggcaggagaattgcttgaatctgggagacggaggttgcagtgagccgagatcacgccactaaactccagtatgggtgacagagtgagactccgtctcataaatttaaaaaaaaaataaataaataaataaataaataaataaatagatagattagtgaccctaataaaaatagctctgtacaattaaaaaaaaaattgggatgacaaaaatatttgcaattaatatgattaatgagggctaaaacctaaaagaaacaagaagcctaactataatattagtattcagactccattgactaatagaggcaaaagtgtaaaggttaatttatctgaaatttcaactttgctgataaagtagaaaacagtgataggaacctgccgttttactattactactactactactactactactactactactactactaccaccaccaccaccactacttgttaaaatctaggttattttcccctagagagcagggtgaatgttttcttaatgtctttacattcttctcttccctaaatatagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccaggtaaagacttgaaggaaaatgcattttactagtagactctctaaaaggattagttatttttaattctccctctattctctgctggttatactctatatttatatagtaggaggtatgtgccatcactgaagcatgtctgctttttttttctaggttttcattcatttagcaggaatactggcagggtatgtgtaaactatgaaaagggccttcctaggtccaggcagctggtgactcagagctggcctatccaatcacggctgccttttagaaaacaatctgggccaggcgtggtgcctcatgcctgtaatcccagcactttgggaggccaaggcaggcgaatcacaaggtcaggagatcgagaccagcctggccaacatggtgaaaccctatctctactaaaaaaacaaaaaattagctgggcgtagtggcaggcacctgtagtcccagctacttgggagtctgaggcaggagaatcacttgaacctgggcggcggaggttgcggtgagccgagatcggcgccactacactccagccatgtgacagagtgagactctgtcaaaaaaaaaaaaaaaaaaaaaaaaaaggccgggcatggtggctcacacctgtaatcccagcactttgggaggctgaggccggcagatcgtgaggtcaggagattgagaccatcctggctatgctgaaaccccatctctgctaaaagtgtacaaaaaaattagccaggcgtggtggcgggtgcctgtagtcccagctacttgggaggctgaggcaggacaatggcatgaacctgggaggtggagcttgcagtgagctgagatcgcgccactgcactccagcctcggtgacagagcaagactctgtctcaaaaaaaaaaaaaaaatctgaataagcccatgaacaagctcacacatgtaaataaataaaagattataaaatttaaaaatgtggttgacaaattacttcttaggctggcgtacattcattttcttcattgctaagataacccacttttggtgcccagttatggaaggtcctttcctaactgcattcaaatcagaggttagcctttaaggcattggatttttgctttttgctagtgcttttattgttctttctctagtaattccaagcaaagaactctggtattcattctgtctgtgattgacatggagccaagactcaaactactttgaggacctggcccactacagtcttctgacctggttatacgcatacaaacaccaaggcttctccatgcatccccctcccttttaggaggcagacagaatcttaaaggaattttgctttttaaagttatttctatcaggtcacatctgatgctgctttatttatttatttattttttttttttttttttgagacagagtcttgctctgtcgcccaggctggagtgcagtggtgctatctcagctcactgcaagctccgcctcccgggttcatgccattctcctgcctcagcctcctgagtagctgggactacaggcgcccaccaccacacccggctaatttttttgtatttttagtagagactgggtttcactgtgttaaccaggatggtctcgatctcctgacctcatgatccgcccgcctcggcctccgaaagtgctgggattacaggcgtgagccactgcaccggcctatttttctctaaaaatatggcacagttttttaattggaagctgtctgagatcacctagtccagaatctcatttcacacttgaggaaactgaggcagggagcggttacaaagccagtagtgatagagctaggacaaccagcccagtctcccaagtctcattcatgctggctctggaaacaggagcacaagttttatcttaactgtgggccttagaccctccttgcttctgatattccatattgtagtctcctggtttcatttactcttcctcacctttcatttccttcatcaccttgtatagagtaaaccagggtaagtgctggtagatgcattgatgaaaaaatatataatcctgcctaaatacctaaaggcagctcactttctagtggggaagactaatatgcacagaacttagaatataataagtaaatgggaggtcacaggagttagctagtaattttgattagagggatctagagaggcttcatgagagcggtgtagaagttgttattgacatacttcactctgccccactttttcttatccaagattatgtttatcatattttgaccctcctaagatggagccttggaactgattcaaagtaaatcaaaactggtgctccaaaagctccttgggccaagatggggaagaaggtcgtaacttgctgcacctgggtcatgaagctaacactcccattccttttgaaaccaacgtttttttgtccctgatcaaagggacaagagcttcacccaccttgcagcattcccagcacattcttattgccaatttaagggtctttttgttctcttcttatctcatctgccctttattctctgttcttttctcttttcattacttctcaccctttctttgcctatctgcttttcccatctacttttgccttccatctccttataccccatttatccctcaagctggaacctgatgctggcaatataagagacctctaatgcctcttgggaaggggatgaggggattttgagtccctattcttccgttccagttgattttgtcacaacaggcattgacatagtttaactgggcaattgtgaaatttgacatttgttctatgttcatatttaaacgtgtgatgtgatttttgtaggaaatgtatatactgtttatagatgggctgtgaaattttatcttggaatcttttttagaatgaaatttttggttcgacggtggcatcgagtcacaggttctgtttccatcaatattaacagagatggctttggactgaatcaaggtgaagtcaaaatagcatattttcttatgtttatgactctctaaatcagaggtcccccacccccagactatggaccatacttgtctgtggcctgttaggaaccaggccgcacagcagcaggtgagcagcgggcattactgcccgagctccacctcctgtcagatcagccgtggcattagattctcataggagcacaaatcctattgtgaactgcacatgtgaggaatctaggttgtgtgctccttatgagaatctaactaatgcctgattatctggggtggaacagtttcatccagaaaccattctggcccctttgggtccatggaaaaattgtcttccatgaaatgtgtccctggtgccaaaaaggttggggactgctgctctgaattactgcatgtgtaatacttaccaagtaatgaattctggaagcaatgttttccaaagacaaagcccttataactgccaaaactaggtaacttcactgttttaaagagggtaataataactgattttcatggagaacttagtctgcacctggccatgctcttttcatgtattctcccaatcctatgatataagtacagttttactactctcacttttagatgaaaaatcgaggcatggaaaacacaagtcatttgccccagaatggccagtagggaagtgatggaaccaggaccaaacactggcagtctgggtccagagcccacactcttcataactgcatttaaggcacggttcaagacaggattgctgttagtcatatggaagaattaggaagttttcataatttaacaatattcaaacaagtttctgagtttaccaacaggttgtataataatggtaacagctaaaattccttctgtctacacctagaagtggaaacaaactagggcttgaacatttctggcaataaagatgaggtccgaatctggggagcacacagaggacacagcatccctgtgctgtgtattcatagtaaaccacctttacatactctaccaggagctgagcatcctacagaggggaaatagatttggtaccctacacaaagtattttgaaatatcattacactgaaacagctgaaatttgtaccataataagttgtgttttattaaaagttagcaaatcttggtttcaagtcagtagattggaatggttacattggtctaatattttttatccacatcatttcccacaagccacacccactcagacacccctcacctctcatctacttagagctaaggtctttaaagaagaaaatatgccaattaaataattttctttgagacataattccagatatcagaaatactcatattcaaaagtaaacaaaataacatttgaaagccgaatttttgtttgtactgttttctcctttatcaagaataatagaaaatgactataaataggagattgtataatatagtataatagtcttttgagcagttacctattttgtagaaattttttaaggtcttgggattttatttttctttacaaggaatattttgggttactttaggtgcagaaaagactgactcattttatcattcttctggtgggctggagttatatggagaaccaagacatactacgtatcgctcaagatcagatctggactatattaggtcccctttaccatttcagaataggtaagaatatgagaaaacctgcctggaattgttaaatgtattaatatttaacagagataaatggacatttttagggctttgacttctttgcattgagatagacatctttgttatatataatttacataatatgaccaagtgcggtggctcacacctataatcccagcactttgggaggctgaggcgggcagatcatgaggtcaggagttcaagaccagctagttggagactagcctggccaacatggtgaaaccctgtctctactaaaaatacaaaaaattagccaggcgtggtggcaggcgcctgtggtcccagctacttgggaggctgaggcaggagaatggtgtgaacccgggaggcggagctggcagtgagctgagattgtgccactgcactctggcctgggcaacggagcgagactctgtctcaaaaaaaaatacaaaaaaattagccaggcatggtggtgggtgcctgtaatcccagctactcaggaggctgaggcaggagaatcgcttgaactcaggaggtggaggttgcagtgagccgaggtcacgccactgcactctagcctgggcaacaaagcaagatttggtctccaaaaaaaaaaaaaaagaaaaaaaatatacataacctaaggcttaatgtaaaaatgtaaaaaccagtgtttaaatttgtaactgatttccaagggtatagcaaacaagctgaccaagtgttatttagtgtatgctatggttagatattgggaaaagtattgactaaaattgatactctgatcattatgaaaagcttaacagtcttcatgacaagatacatttatacatacccaatttattgagacctctgccacaagcattgtattggacattcttatgttgacttagtagcatctttgaattcattggagagttgtctctttctcatcccaagctccaaagctgaagcttggaggagatacattatgtgtgtacaagtgacccacctttttggggaagggagtggaggcaggttggtaacttatatgcatatttctggataacttgattcatgtacatatttttaatcctttaggtacccaggcactccagctgatttcaatcctggttctttagcatgttctcagcttcagaattacgatcctgacagagccctaacagattatatcactcggctagaggcactgcaaagacgacttggaactatacagtcaggtgctctgagtttaaccacatcttggcagcaccacagtgcgagacccacagctcccctttctttgaaattctttcacactcattaggataatcaaagcttccagtttagtgcatgagctaattattaagttagccaaagcttaaactcttgtaaccagcagagaaactgactttaaataatttaagtgaaaatatgatttatcaccccagatcccactcctcccaaaaatgatttcctactatgttcattcagcggactgatgacacaaaatgcacaatgagcaccagtgtgcaaggtactctgagtctacagagcctaactggagaacgtattcctaagtagcgcatggcagaaagtggtaaggccgtgccgcagcactccagcctgggcagcagagcgagaccctgtctcaaagaaaaaaaaaaaaaaaagaaagtggtaaggcatgcaaatcgggtggagttaaggaggaagcacttactttaagcacttaatgtaaccattatccctgctactatattgtgcttttatgtatcatcgaaaaaaactatcccatttaaaatactttgtaaggattattttttctttgttcaaaaacaaaaaacaagtcatactttaaaataaaggtggattccctgttcatggaaggaaaacctcttttccctatctcacttcagttcactcctgattcagagactttgaatcattgagtagtttatctcttccttcaagaaatcatttgtttacacccaagcatcttgtagtaataggaaacttttattatcatagctgagtttgttggtttgcctaggcttgttttgttttgagcatccaaatttcacaagacccagattttgaagaccaaaagatttttcaaaaatgtatgaggtatagaacatccaactttgagagcactttaaaaaaactctaaatattagtctcacctaccttgccatagagccagtcatggtgatttttacatatatattcaaaatctcttaaaagtcagcttaagtatatgggctgggcgcggtggctcatgcctgtaatcccagcactttgggcggccgaggcaggcggatcactaggtcaggagttcaagaccaaccagttcgagactagcctggccaacatggtgaaaccccgtctccactaaaaatacaaaaatttgctggacatggtggcatgtgtggatagtcccagctactcaggaggctgaggcaggagaatcacttgaacccaggaggcgggggttgcagtgagccaagatcacaccactgaattccagcctgggcaacagagtaacactccaccttgggggtagtggggagagactcagtttaagtatgaagaggacattttaaggaaaaaaagggctttaaaaaaatggagaataataataatttcctttgtgtgaactctggtgggtctgatacaggtagcaatgtaatttgaaatcagttgaatttcctgtttttctctcataggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaca

SEQ ID NO: 2118 - DNA, 20394 bp, Homo sapiens
actggttagaatttaattgcacgcgtaaaaagatttaaagctgttattttgtccataatttcatatgctcctatcatagttagtgctcgaattagttgatctcttaaagcagcagcagttagtgataacttgttactttgtgttttccatataacaagtgcttggtgggctctctcacttaatgaaacagtgctgaaaaacattattaataatattaatagttaaatatttattaacgtttaatatatttaaattactgataattatctgaattgtcaattaagaacattgctttaaactcctgtaatattgtatatctaggttttcaaaccaattttatcagactgaagtgaggatgaaattaattggtgaagagaatctctataaaaatttggcatggagcttgggacatagaaagtgaatgttagctccagcccatcccttgtacccttatagaaaatcagcaattcaatttacattcagttctcaagacctcaaaatcataattgtgggttatttctaataaaccagtatattactgctactatactatatgctttttttttttttttttttttagacagagtcttgctgtctcccaggctggagtgcagtagcacgatctcaactcactgcaagctccgcctcccgggttcacgccattctcctgcctcagcctcccgagtagctgggactacaggtgcccaccaccacaccgggctaattttttgtatttttagtagaggcggggtttcaccgtgttagccaggctggtctcaatctcctaacctcgtgatccacccgcctcagcttccctaaatgctgggattacaggtgtgagccactgcacccagctactatatgctttatagcttgatctcacttgattctcatgacaattctcttatatgagtatattcattttaccagtgaagaaaccaagtcatcaagaagttaaaggacttgcccaaggtcacaaagccagttgtgagtaaaagtcagtctgtcctcatagcctttgttctttattatgttatatggccttccaacatggatcacaaacatgtaataaactaaaatcagctttctacagcaaagtagagattgtgttaatacgaatgtttcaaaaccatgcaatatcaacatgatatacatcagaatgagaataaatttgtactaaatgctgtcatttatacatacctctttgtaggcatatcagtttctgagtttgccaggtttagtttttgacataaaaattcaaaattggtttcagtgatgttgttggcaactatcttgaatatcttctctaaaattttctctacgtttgaacataaaataaaatgtatatcttttgaaaaagataatctattttgagttcatattatatctagttttcttatttctgtgcttctatgaaatatatatgttaagtaaaactgaaaatgacaatgctggccgggcacagtggctcacgcctgtaatcccagcactttgggaggccgaggcaggtggatcacctgagatcaggagttcaagaccagcctggccaacatgcaaaaccccatctctaataacaatataaaaattagccaggcatggttgtgtgttcctgtagtcccagctactcgggaggctgaggcaggagactcacttgaaccggggaggcggaggttgcagtgagctgagactacaccactgtactccagcctgggcaacagagcaagactgtctcaaaaaaaaaaaaaatgacaatgacagccatgcgcggtggctcatgcctgtaatcccagcactttgggaggccaaggcgggtggatcacctgaggtcgggagttcgagatcagcctgaccaacatgaagaaaccccgtctctactaaaaatacaaaaaattagccgggcgtggtcgcacatgcctgtaatcccagctactcgggaggctgaggtaggagaatcgcttgaatccaggaggcagaggttgcagtgagccaagattgcaccattgtactccagcctgggcaacaagagtgaaactccgtctcataaaaaaaaaaaaaaatgacaatgacaatgcagatctaaattatgaactgaaatttgaaacatttgacatttgttccatttttttctaaaatttgaaaaatccaacacttaaaatggctgttgaaaagaatatttataagcaacttttttttttttttgagacagagtttcactcttgttgcccaggctggagtgcaatggcatgtgatctggtctcaccgcaacctctgcctcccgggttcaagtgattctcctgcctcagcctcccgagtagctgggattacaggcatgcgccaccacacccagctaattttttgtacttttaatcgagatggggtttctccatgttggtcaggctggtctcgaactcctgacctcaggtgatccgccctcctcggcctcccaaagtgctgggattaaaggcatgagtcaccacactgggcctatttataagcaactttaaagtgacttccaagccctttaatttctccaggatttgaaatgcatttgactgcttccttcaattctggcttttttatgtgcgtgggtgtgttttgttttgttttgttttgttttgttttgttttgtttggtggagaatatgggcaaaaattgtacgtgcttctttatgtgccaacttgagaaactaagttcacatctactataaatatggtgtataagtgcatattttatattcaagtcaattatttaataagttggctgagcaattagtgattttagtttttttaattaaaacttccagctaatttgaacaagatccattttttcttgacaaaggtactgtgagttttttcttttctttcttttagacagggtctcactctgttgctcagactggagtgcagtagcataatcacaggtcaccacagcctcgacctcccaggctcaagcgactctcccacttcacccccgcaagtagctgggaccacaagcatgtgccgccatgcctggctaatttattatttttaatttttatttatttacttattttgagacagagtctggctctgtcacccaggctagagtacagtggcgggatctcatctcactacaatctccgcctcctgattagctggaactacaggtgcctccagattagcaattctcctgcctcagcctcccgagtagctggaactacaggcacgtgccaccatgcccagctaatttttgtatttttagtagagatgggtttttggcatgttggccaggccagtctcaaacttctggcctcaagttatctgcccacctcagtttttaaaattttttgtagagacagggtctcactatacttgatcttagccaaaaggccgagaagcaatagtctcactatattgcccaagctggtctcgaactcctgggctcaagcaatcctcctgccttggcctcccaaagtcctggaactacaggcatgagccactgcccccagcctgtgagaattttcagaactcgagatgtaccatcccgcgtgatcaaatatgttctattttaaaaagttttatatatactctctcaggctatatttcatgctatgatatatatatatatataaaattccaatcttctaagtaaaagtttaagaaaaaggctccatttgttaattgcagataaatacatctcccatactgatttctttctgccctcactggatgccaagcctgcaatatgaaggctccttgggtgtagggaaaggagataaatggctgagattctaagcccttctctaaagtactgtatctaacagaaatactttatggatcctagaaaaccccgaaaatctttattctatagaaatagaattaccataaaagatcctttcattttttagacggagtctcgcactgtcacccgggctggagtgcagtggtgtgatctcggctcactgcaacctctgcctcccgagttcaagcgattctcctgcttcagcctcctgagtaactgggattacaggtgcccaccaccatgcccagctaattttttgtatttctagtagagatggggtttcaccatgttggccaggctgctcttgaactcgtgacctcgtgattcacccaccttggcctcccaaagtgccgggattacaggtgtgagccaccacacctggccaaaaatccctttttatagtaacaattaagacaatcaacttgcacagtaagttaaagaagacagctactgtggcttttaattttgtattttaggttcctttatcaataaagcccaagtcttgcaaaagcctctaaatgatagccatgtatatggatgtatattgtgactttaaagactaagcaatttttcatgactgtctcactatgaaattacattagtacaagctcctgattatgtagacaagatacatgatagaatgatctgaagggatagtttttggtattccatttccccaaatctggatcataactgattgttctcttgcattaaattagaggaccaaaatctggattcattctgactagtgatgaaaagtggcaaatcagagtcctagggaaaagcctaactgttgcgaacccagccccagggaaagaattggacagtgaagattccctcccagacacttgaagccagtcttcatctagtcccttttaaagaaaatgggcctgttctcagaaataatcagacacacaacagagagctcaaggacggatgggataaagactatcaaaatatttcagacagatggtcatagtgggactgactgccatcagtggaatggctccatggttttccctcaaggccgaatgtattttatttatttatttatttatttatctttaaaatagagacaaggtcacacactatgttgcccaggctggtctcgaacttctgagctcaagtgattgtcctgccttggcctcccaaagtgttaggattacaggcatgagccaccacacgcaactccaaatgtcttttagaacaactacatttggtagaacagattggaactgacagatttatgtgtggattttgagtctggccacaatctcaatgaaacacctattgaagggcattaaggtcaatagggtaggaaacagcccacccctcctccacttggatttgcctattttcagtgcctcaatttgtgtggacctggattacgtaatctgaattatcaaaacaaactcctaaacttaagaaaagaaagatcatcaatattttcatatctctgccagattgaaagcctccaattaaagcaaaccatcttttaattcatatcagatagtgtcttgtggcttggtgtggtggctcacgcccgtaatcccaacactgagagaccaagacaggaggattgcttgagctcgggagttcaagactagcctgggcaacacagtgagaccctgtctctactaaaagattaaaaaattagccaggtgcggtgacacatgcctgcagtccctgctactcaggaggctgaggtgggaggatcacttgagcccaggagtccgaggctgcagtgagtcgtgatcatgccactgcagtccagcctgggtgtcagagtgagaccctgtctccaaaaatattaaaataaaataaaataaaaaagaaatgacttgttagatagtcaatcactcatcacctaccatctctttcatctgccctctgtagatagcgtgcaatagtatacaactgttttcctttacagatttccactggaggtctcagcaaagggttgtcatcaaaatttatctccttcagtgaaaaaatattgtagatagcactaggtagagctgtcagattatttcctagtagaaaaaaattagaattgaattacatctttctataaaagaaaactatggagacaaataacatctgttatgtcttgctggcaaagtaccagaggaccctcacaatgcagcaggtcataaattatttctgatgtccacatgctaagagcaaaaaagagtgtttatagaaagacagctgtggttcctttctctcctaggggtggcaaaatgagacagagactatcctcttttaatacagcaaagaactttatagagtggatgtgatggtaatttttaaactaaactgtttatttagcataatttttgattcatagaaatgttgcagagattgtagcaagttcttctgcattcctcatctagctttagtttctcctaatgttatcacattatcatattacatttgtttaatctaagaaaccagtattggtatgttactactaaatacacttcagatttttttggattcattagtttttccatcagtgtcctttttctgtttcaggaaatctcattgcatacttttatgtctcattagtcgcctctggtttgtgatagtttctcagtctttccttgtttttcatgaccttgacagttttaagaagtactggttatgaattttgtagaatgtaccataacttgaatttgtctgatatgttctcattattagactggggttatgggtttttggaaagaataccacagaggtgaagtgcacttatcacattatatcagagatacctcatatccgcatgacatcactaatgatgttaaattttatcgcttggataacacagtctctgctagcattctccaagataatgttataatttttttcctttccatactctattctttggaagtaagtcactaaatctaggctaccctcaagggggagtgggaattaaactctaccttcctaaatgtaattttttcaataccatcctaatccaatgtaaacctaagataaaaagtaaaaccagtggttcacgcctgtaatcccagcactttgggaggccgaggtgggtggatcacctgaggtcaggggttcaagaccagcctggccaacatggcaaaaccccatctctactaaagatacaaaaattagctgggcatggtggtgggcacctgtaatcccagctactcaggaggctgagacaggagaattgcatgaacccgggaggcagaggttgcagggagccgagataatgccattgcactccagcctgggagacaagagcggaactccatctcaaaaaaaaaaaaaaagaagtaaaactgtggtaaaaatgaatttgtagtcatttagagaggcctaaaatttgcctttatattatttatatattttatagttatattatttataaatatagttaaaggaaactggttccttttagtgaataatcatatttagaaaccaagatctggatacgatgcttctgggagtgtgtgtgtgtgtgtgtgtgtgtgtgtgtaaaatatatttattataaacctagaattttatatatgtatatatacacacacatacatgtataacatatatgttataaatcatagcacatagtctttagggtctgacttctttcacttagcattacaacaatatcagtgttgtgtgtatcaatagtttttttctttttaataatgagaagtattccattatatagatgtaaataatttatccatttaatacataaatgacatttgaagagcttccagttttggcaattacaaaggaagcttctctatacatttgtactcagttttttgttgaataagttttcatttcatgtaaaagagtagttgaagtgagattgatggtttgtatggttaagtgtatgtacaactatataagaaactaccaaacttttctaaagggttgtaccattttgtatttctttcatcagtgtatcagagtttcagttacttgtattttgatagcttttggtattatcagattttaattttaactattctttttttttttttttggatggagtctcgctctgttgcccacgctggagtgcagtggcgtcacctcagctcactgcaacctccacctcccgggttcaagcaattcttctgcctcactctcctgagtagctgggactataggtgcgtgccaccacaccagctgatttttgtatttttagtagagacgaggtttcaccatattggtcaggctggtctcaaactcctgacctcgtgatctgcccgcctgggcctcccaaagtgctgggattacaggcgtgagccaccgcgcccagcctaattttaactattctaatagcaatatttcattgtatagttaatttgcatttctctaatatgactaataagcataatattttcatatgcttctttctttctttcttttttattttgagacagagtctagctctgtcacccaggctgtagtgcagtggtgtgatttcagctcacctcagcctctgcctccagggttcatgcaattcttgtgcctcagcctcccgagtagctgggaccataggcacaagccaccatgcccagctaatttttgtatttttagtagagatggggtttcactatgttggctaggctgatcttgaactactgacctcaagcgatccacctgcctcagcctctcaaagtgctgggattataggcgtgagccaccacgcccggcctcttatgcttatttttcattcatatagcttcttagtaaattatctgttcaaaatttataccaatttttattaagttgtttgacttcttaattttgtttttagtttttttttttttaagtattaagcaaatattttcttccaatccatggctttgcttttcattcttttaaaaaatgtcttttgggctgggcacagtggctcatgcctataatctcagcactttgggaggccaaggcgggtggataacttgaggtcaggaatttgagagaagcctgggcaacatagtgaaaccccatctctactaaaagtatacaaaaattagctgggcatggtggcaggcgcctgtaatcccagctactcaggaggctgaggcaggaaaccccagaggcagaagctgcagtgagcctagatcgtgccactgcactccaggctggatgacacagcaagactctgctgtaaaaaaaaaataaaaataaaaaaattttaaaaagcctttagtcttgctcttgtcagccaagctggagtgcagtggcagcatcttggctcactgtaacctccgcttcctgggttcaagcgattctcctgcctcagcctcccaagtagctgggattacaggcgcctgccaccacgcctggctaattttttgtatttttagtagagacagggtttcaccatgttggctaggctggtctcgaactcctgacctcaggagatccacctgcctcggttttccaaggtgctgggattacaggcatgagccaccacgcccagcagagaagtttccaattttgatgaaaaccaatttatcaattatgtttatttgtggattgtaatttcagtgttgtatataagaaatccttgccaaagttttgatttttttcacctttttttttgagacagggtctggctttgtcacccaggctggagtgcagtggcacgatcttggctcattgcagcctcagcctcatgggttcaagtgatcctcccacctcagcctctcaagcagctgggactacaggagtgcaccaccatgcccagctcatttttttgtattttgtttgtagagatggggtttccccatgttgcccaggctggtcccaaactcctgagtctcaagcaatcctcacatctcagcctcccaaagttctgggactacaggcatgagccatgacacccagccttttaatattttttcacttttttttttttgcaaaacaatatttttctatgttcttatctagaagttttgtagttttagcttttacatttaggtctgtgattcattttgaggtaatatttttatatagtgtgtaggatcaaaattatattgtggttatttatttgtttttgttttattttgttttgttttggcttttggacatccagttgatccagcaatatttgttgaaaataatgttctttctctgttggattacagtagttcctccttatccatgggagataccttccaagaccccccagctgatgcctacaaaccaaatacagtatcaaacatgattgctgtcaatcagatcacatctgttcatgtctttcacccacaaatttaatgccttttccttcttaactgagcacttatcatgcactgtggctgtaattttgtagtttgaggtgcaacagcaaaattagcacaaatttctttttctgtcttcacaatttcatcgatagaatattcgtccttagcgtagatcttagcaacctcatcatatgattcttttctttccaagttgagaactctcaccttttcacttaaaggaagcactttaaggcttctctatggtgtatccaaattgccagcatcactactcttgtgctttagggccattaataagtaaaataagggttacatgaacacaagcactgtgatactgtgacagtggatctgataactgagactgctactaagtgactgacaggcagggagcacatgcagtgaatggattcacaacccaggtaggacagtgcaagatttcatcacactgctcagaaaagtgcacaattttaaatttatgaattgtttatttctggaatttcccagttaatattttcagaccactgttgatcatgagtaaaaccatggaagtgaaactgtgaataagggggaactaccatggcaaaaatcagttgaccacatagtggtcagtcagggttctctagagggacaggactaccatatagtgggtgtattagtcagggttctccagagggacaggactaataggatagatatatatatataaaagggagtttattaaggagtattgactcacataaccacaaggtgaagtcctgcaatgggccatctgcaagctgaggcacaaggaagcaagtccaagtcccgaaacctcaaaagtagggaagccaatagtgcagccttcagtctgtggccaaaggcccaaaggccctagagcccctggcaaaccagtggtgtaagtccaagagtgcaaaagctgaagaacttggagtccagtgtttgagggcaggaagcatccagcatgggagatagatggaggccagaagacacagccagtctagtccttccacgtacttctgcctgctttattctagccaaggtggcagctgattagattgtgcccacccagattgagggtgggtctgcctctcccagtccactgactcagatgttaatctcctttgggaacaccctcacagacacatgcaggaacaatactttgcatcctgcaatccaatcaagttgacactcaatattaaccataattgtggatctatttctagactctctattctgtcccattgatccttatgtctgttgttttgccaatactatcactgtcttcatgactatagttttgcataagtcttgaaatcaggttgtgtgaatcatccaactttgtttttcttcttcaaaattgtttcagctattctagttcctttgactttttatatacattttagaattacctcattgttttctgaaacaaaaaactctgctaggattttgttggaattgagttgaatttaaagataagttttgggaaaactgacatattaacaatattgtcttccaatttataaacactatatatctctctacttatttaggtttatttagttttatctatgttacagttttcagcatatagatcttatatgtaatttgttagatttatttatggttttggtaccattttaaattgtacttttaaagaaatcaatttccaatcatttcttgctagtctgtagacatatgattgatttttgtatattaactctgtatacggcaatcttgctaaacttacttgttctgtagatcctttgggatttttgacctagacaacgtgtctctgttatcagaaataattttttcttcttccttcacaatctatttactttttatttctttttcttgtgttgttgtgctagttgggattccagttataacgtcaaaaagaagtggtgagaaaggagaactttactttaatcctgatcatagtggaaaataaatcgtttaccatggagtgtgatattagctataggagttttgcagatgtattttttcaagttgaggaaattctcttctatttctagcttgctgagagtttttttgttgttgtttgtttttgaaaatcttgaatggaaattgtattttttcatatgatatttgctttttttttttttttttttgagatgaggtcttgttttgttgcccaggctggaatgcagtggcacaatcataacttactgcagcctcaaactcctgggctcaagcaatcctcctgcctatgtctcccaagtagctgggattacaagcataaaccaccacatctgcttgctttgctttttatacttacagtgagaagttcacatggcttttcataagcctgttcagatggtgaattacatggattagtttttgaatattgactcaaccttgcattcccagggtaaatcccacttggtcacaatatgatatcattttttatattgatggatttaatttgctttaattcattaaggaattttgcatcgatgttcaagcaggatgttattctgtaagtttccaagtaatgtctttgtcttattatggtattaggataatgctggcctcagaatgaactgagacatgttgtatcctcaattttatgacagaattttttaaattggcattgtttctccttccttccttccttcctttcttctttcttttctttccttcattctttcagacagagtctcactctgtcgcccaggctggagtgcagtggcacaatctcagctcattgcaacccccgcctcctgggtctaagcgattctcctgcctcagcctcctgagtagttttgattttgattacaggtgtgccccaccacacctgactaatttttttttttttaagtagagccggggtttcaccatattggccaggctggcatcaaactcctgacctcaagcaatccgcccccctcggcctcccaaagtgctggaattacaggcatgagccaccatgcccggcctaacttaatgatttcttctttgaaatacttgaaagaattcaccagtgaatcctttttgaaattggcattgtttcttctataaaatactttatagaattcaccagtgaagttatctgagctagaaattttctttgtatgagagcttttaactacaaattcaattactcaaatagaattagggctatctgttagcccacaatgatatctacctcctgttacccccttgtgtagtcccctcccacattataccaaggttggtctgtgtgatcaatagaatagagcagaagtgatgttatgtcacttccaagattaggcatttaaagacactgctggctgggcatggtggctcacccctataatcccagcactttgggaggctgaggcaggtggatcacctgagcctagagaggtcaaggctgcagtgagccatgatcttgccactgtgctccagcttgggcaacagagtgagaccctgtctcaaaataaataaataaataaacaaacagataaatatatatgtgtatatatgtgtatatatgtatatatgtgtacatatatgtgcatatatatgtgtgtatgtgtgtatatatatatataatcaacgcagtatttgttgtactttgggaaatcttttctgatatctttagagtgagtggtttattttcttatctacaatgtcatttttattttgttttggttattgtaatgctttaccttgtaaatgactccatgtaaggtattagagtattatagggtataggagaagtatcaggggagccaacagagaaggaaacgcagaaaaaatgctgacctgaggttgtgtaggtgtgtgtagaggaagaggtgaggttgggttcagaaagggaagaaatactaaatgactgggtataggcagagaagagagaaaataaatgaaaatatgttcaggctctcctactctttcaaggcaggaactggaccttatactttgctttcattttctgtacctaggacagtcatttccttctaatggtgacttaataccttatgttgactctttgccattctgtatcttgtcagcaaaatttgcaactcagacattaatactctacttattgattatgcttactgattatgcttgacactcaccactcaggtttagttgctgcagatcatttaaagatagcaaagatggtggaagataacttatttgattattgtatgcatgtaaactaaccaaatttctcaattctcctatatttcttggaatctctctgattgcattatttgagatatcaagttctttaagttgagtcatattagatagctctcctggaagtcttgttagctgtaacaaagattacacaattatacatttataaatacatacatatttgcatgactaaaacttcttctaaaatcaaatgaaagagttttgtctgtttttgtttttgtcttaaaaaggagattttttattatgtcacaaattctttgtgactgactctcccttctgactaaaacccacaagatattgtgcgacatccaagtacctccccaatctgaccaatgcttctaattcaaccctgtggcttgcaacccactttgctcacattcccatcactcagtgttcattacctccttatcccattctcttctccctaaatctgaccctgttttggcttctttcccgcccccctcccagaagtcttttccaactactccatcccacatttgatctccttattactagtcctatcaacattgcttttttttttttttttttgagacggagatctcggtctgtcacccaggctggagggcaatggcatgatctcagctcactgcaacctctgcctaccgggttcaagcaattctcctgcctcagccttttgagtacctgggatcacaggtgcccagcaccacgcccagctaatttttgtatttttagtagaatggggttttgccatgttggccaagctggtttcgaactcctgacatcaggcgatcctcccaccttggcctcccaaagtgctgggattaagggcatgagctacctcaccaggccccattgctttttattcatcatttgtgtgcgtttttttagattttctaaatgacatgatacacatgttttatactttttgtatgtgtttccaagcacaaaatgcattttgaccaaatgtttaataatggagtcacagtttggcaatgtgaccttaaataaaaattcctactataaaaagtgttgcaaaattgcaggaattaaaatattctgttaagatgaagaagaaatatgcatatttagagaaaatagggccattatgagtggcttttgaaataaaggaagttctatgaacaaaacaattttgaatgtataggcacctctaatagctaaacaacaaggtacattctgcatgttgtgctatatgttcttccaggtataaaggaagcataagaaatagtctccaacttcacggagattaaattttattttagggaacagaatatatcctatgaaaaaatcaggaaatggaatgaagcaataggtaatccaatgccaaaataatacaattaataactgatgaatgaaagtttagaaaaggtacattactacaaatcagagaactaaagtaaagcttcatgtaaaaagtagaacttgaatagcctcttaagaatgaataggcggctgggctcggtggctcacacctgtaatcccagcactttgggaggccaaggtgggtggatcacaggaattcaagaccagccgaccaacatggtgaaaccccgtctctactgaaaacacaaaaattagctggacgtggaggtgagtgcctgtaatcccagctactcaggagcctgaggcaggagaatcacttgaacctgggaggcagaggttgcagtgagctgagatcgcaccactgtcctccagcctgagcgacagagtgagactctgtctcaaaaacaaaaacaaaaacaaagaatgaatagaattagaaaaaagttacaggacacttaaggcaagataaatatcatgaataacaatggccagtgagaagctgaccagcaaagaaaggtgatgcaaagcagagggagatttgtttggataaggagcatggaaccaggctatggcaagacttgagagcctggcctatgaagtaggagtcagatcaaaacagataggtgggttcagttttatttggcattcattgaaacaaatattctttaattaccttctcaacatttactagaggtggtgtctgagagctgtatgatgatggaattcatatagaaggaaggttccttttgggcatccttcctttaataaaataaaagccctgtgattaatctgacttttcttcagataagtgaccatctgctattatataagttaattatttgggcatttcatttccaccccaagggggttatcaagtgatattttcaactacatgggatattctttttgacaggagttcttgtaaatcattttttccatttgatgacctttgcaatgatgttgcaaatatgtggactgttgccttgggcagccattcactttgagtagacaacagatacgcaatttggattcctgacaggcaagtatgatacatggacaacagtcctctgcaatgaagtctgacaactttgataaggcttgctaaaagggaggaggttcctggcataaatctatgcatgaagtgagtgataaccaaggaccaggttgtagacagtgacactggaaaatgagggagataacccaacagctttttcagaggaaaaataatacaattttggtgtaagatgaggtataactgatgatggaaaaggaacaagaatgatttcatgagttttagcctggcaggtttaaaagaaaaactggcatcacaaacagaaatggagaagttttgaaaggagatggaagaaaaatgagctgactttgaagttatattgagtgtgtgacaacaaaagaatagaacatgtataatttccaggaaaaaaaatgagaactatgggactacagcactggtgtgagatcagctctagtcatgtagactttgggataatgtgcatgtaagtgacagcaggtgtggtgggaaaggagttaataaaaaagagagagttaaggatataacattggagataccaacagttatcttacaagaggagaaaatgaatgagatggttatgaatcagtcaatgaattaactgattattatattgcagatataaaaattgtctgttagtgcaaaatcaactttttaaatacaagctgtatcattattcattccatctgcttaagcaagtattccctggagcagtttttctggaaatgtagtatatgacagctgttatgttaaaaatggtcaaataagtttgggaaatatgggaatattttgggaaaattagtgcaagactcttcaaagcttttaatagatcagtattcattgttattctttaagagaagaacccagtgcttcttaaagctatttgatcacagacactgctcccctcctccctttttttttgagcagatgctcatgggactagggcttttaggagtagactttgggaagccctgccttagataatagctgtgttcttttcatttgtttactaagatcttcatataaatcagtaatgttttagttattaaaaaattatttccataaaacttactcctagagtttcagtaagataaaatgctaagctctaaaaatgttaattcttattgatctagcaattcttcaggaaaaatttcctaaggaaatagtctaaaatatgaaaaaggctatatttatggaaaaattcatcacagcattattatgaagaaaaattataacattcctaaatgcataacaagaggtttagatctataaatcatgtactggttataacaatttattgggaagatggttatatcaaagagaaatgcttattggttaaaaaaagaagaatttaaaattgagtgtgtagtcttttataattccttataaaaccatatgcataacgggaaaaaagactaaaagttgtgtcaacgtatgcccgtagttataatacaatgatatgcttgtggaatgacttttgtcttacttttatcactttccaaactttcaataatgtgtttatatgacattcataactttaaaactccttttacaattacaccaaaataaaaaggaatctatagaattgtcagctttcattgcttcatatttcattttaatgaagtattttcctgtacagcttttgtgttgtgaattgtatttataagccatgtttggcggggacggggagggctttcatttaaaaaacaaaatatttcagctcaacttaaaacacacatacggtacccacagatacaccacagcttggattctgatcctctccagtctctccttccccacaaagcccacaataccagtctcttacctttctcccttttatctgacttatattcagctgttccagtgattgaagttggcacagttcaataggaaaatgtataaattgattgcttgagaagtttaatttctggattccttttaaattacagatgtctgaagagattttctgtaattggttttccgaaagatcaagtacttgcaaattttctaaagtacacaattctctagggaaagtttcaaatttattacagcataaaataagtacgtggagtgatatcatattagaaattgatgctggaattttctttatttggtttttaccaagatccaggtatttaagattaataagagaacaaaagtgctcagaaaatatgaggagtttgttttcactcaattctaaatgaagcagttgtttactgaaagatatatccacaggtatttctgaaatataatttccattaacactcaaataataaagagaatctaaagcacacagtcccaatggaaaatacattattttgttataactcaattcaattttaattattttttggcagttttttatttcaatgggaacatctgtgattatgtttcctgaaaattctagactgcatatgttattaagatgtgagatacagtcagttatttttaccatattatttctgtttacatggagttttcttaaattgttaagcttatggatgtacttagggagttctgttaatttattatcactaagactaaggcattccaacattgcacagcaagatattttctctggtatatttttcaataaatttttatcaagtataagaatcctaagttccctgaaattctcaattttgtgtgaaataacttccaatttattgtcggccagttggagttcttttattttgagtaactgaaaaatttctacagccagaaaggtaagcttattgtgatccattaaaagtgtttctaaatttttaagctctctaatttcttttggcaaactgcttattaggtttccagtaaggtctagtgaaattaactttggaaggaagcagagagctttaggaaatgttgttaactgattatattccaaattgagaaccctcaaggtttttaaactaggcagagtatctggtatatgtcttaacttatttttacccaaacttaaaatttccaagtttccaagacattctaagtcagaaggaaaattttcaatgtaattgttataaaaaaagagttgtctgatattcccaagctgagatatttctttaggtatatgtgatatgtggttatgactgacatttaatatccttaaattatgaagtaactgaatttcagatggaagtgatgataatccattttcttgcagggatagaatttcaagtcctaacagatcacctgagtctgccccttgaaatgttttgatttgattcttgtctaaatatagatattttacatatttgatttttaaaatgtccttaggaaattcctgtaaacccttggcctcaaggttaactgtaaagttatctgcccctaggccaagttgtttctgattttcttcagagacttgtggactaacttctcctactgtttcatgagataggaagttaaccaaagcctgatattctgcagtcctcccagttagtgatgataaactctgtgaagttcctgttctagtgcttgtttcagaaaattgaagatttttcttttgttcttcatttctcttagacttccttccagaggaagatgttgactctaatgtattctgtctaggatgtgtttcataaatctggttagaagatttcccttccaggtaatcagaagcttcgtttatcaaatttgatgtttctttaataaagccaggctccttcattgactgtgatctagattctttcctaaattgactaatagtatcctctagcacttctgacataccctccttttcagacatcttatttgctgatatgttttatgccaatacaaaattgtaacttgattttaattttcatgttttttcctttgaat

SEQ ID NO: 2119 - DNA, 169800 bp, Homo sapiens; identical to SEQ ID NO: 2117

SEQ ID NO: 2120 - DNA, 7997 bp, Homo sapiens
taaaattaaggtcatataatttgtctcacgtctttcagtttatgtcagagctagattgtatcttgaaaataccgacattatctgatttgccattttttaagtcaatgcctctgaaaattactctttaatattagctgaaatgccaacaaaatgcacagaaatgattatcatttccttaaactatattaggcaaacatattcctttatttagattttatattcacatttagttttttatgcacacatttaagactttataaacactaacattagcaattccagaagggtaggtagattttttaaatataattactcttataaaaggaagaaatagagactttactaaaggactgtatttttgacttcacctataatgcaactaatcatctacttagttgctatgttaatctatttgcttcttcagcaaattatcactgactcagtggtttaaaacaacacaaatttaccatcttatggttctgtgggtcagaagtttgacattgatctcactgggctaaaaaggtgccagcaaggctgcattcctttctggggactctaatggagaatctgtttccttgccttttcaatctttttttacaggcccccttcattccttggctcaaggtgtcttcctccttcaaagccaccttttaacttccttcaaaagtagttgtctttcttatacaggatcactctgacctcctcttttgcctccctcttcaacttttaaagatccctacaattatattaggccctccaaagtaattcaggataatctccccatctcaaggcccttaataacattttaaattaatcacttctgcaaaattcttttgcaatgtggcataacatattcacagttcctgagaattaaaaacattggcatccttaggcaaatctgcttaactttttcaatttagcttcatatctttttttactccaagatagaagagtgatgtttaaagtactcaagttacagccagcatttaccaattctttgattcgactttttaaagtacttatgcttgaatccagaacccgaggattttcgattatttgtgaaatgctaatgttttcttccatgaggcagtctattttatcattaaactttttctctgccaagaagatcacatctggatagcttaagacaaacttctgtacctcttcttcagtacatccaagagaaaacagcttctctttgatgtttgcgtagcttcttctggcatagtcattggaaaggtctaggatttcagctcctggaccacatatcagaaccagcagttcctcactgttcaaattgaaagttgaccgtaagaattcaatgttagctttcacccgcttggtgctctgaattaagataaaagggtttttaaaaattatctttctgacaaaatctgcgggatcattgtgacccaatgacaaaccggctgcctgcaaaaattcaaccatctgtttattcagatcaagactattggagaaggtacgaggggcattggtcaacaatcgacaaaggcatttacgggtcaatccaactgagtagaggaactttatattattctctaagtttaggttgttattggaccgaaaaaaggattcaggagaacgttccaaaatatttacaatttcaaggtctgatgtcacaatctttctccacagatcccaccgttttgaaagattctcgggagtacgtgttattgctcgtggatatcttgatatgatgctagcgatcacttctttgctagctcctttggaaagaaggaacatcttcaggtcctgctcattggtaatcatcctatgaaaaactccaggctgtcgtttccttgccatgtcaatatctactcccatagtaagtaagtttttcagtaggtcctcatttttcaaaggctcactgtctgtattatgacacttcacaccaaaaagcctaaatgaaactgatttgaagatgttttctgctgaaaatcgagtcatccaacatcttgaaccaaagagaaagttatttctcatatgccagaggtttcctggtgccataatggttaggtagttcaaaccttttgaaatgctgtgtaaaacaacacataaaatattacacaaatgcatgtgttaaacaactaaatgaccatattacaatcctataagcatcatggtcatttctatgagaatataccttcagctccagctctccagaactgtgttaataattcagccactgctgaattattaaataaatagtaaaactacaatttatatttgtcttagcctttgaaaaattctacatgttttataatataaacaatatgattgtactgtaagacatatataatcaataaacaaatgtacatatataactgtctctccctagctcactgcttctgttacctgtaagcacaggactgcttccattgttaacctaaagaaaagcaggtggggcaccattagtgccccagaattgttcttgcttttttcttgctctttttgtttacctttgcctgccttggctacctaaaatcagttgaccctctccatctctgctttgtcctcctgatttccaaactttttttttttgacacagggtctcactctgtcacccaggcttggagtgcagcagcactatcatggctcgttgcagcctcacctccctgggctcaggtgatgcttccacctcaaccacctgagtagttgggaccacaggaatgccccacacgcccagctgattttttatttttattttttgtagagacagtgtttcactatgtcacccagactggtctcaaactcctgggctcaagtgatctgcctgccttggcctcccaaagtgctgggattacaggtgtgagccaccatgccaggcgtggcttatttcttataatgacactttcatttctgcctcatatttcaattttccaggtcttcgaccttgccctgcccatagatactagatttctttgcctctggcctcctggttttcaaactctaaatctagccctgaaaaccaacacctcagattaatttccatcttgaacatcttttcctaaattcctgctaccctttatatccatgctaccattaaagccttaatttttcttagcttatatagacctctagtcaacagctcttgatcacaatctccatctcatttggtttaccctatcattccctacgttgtaacccaataattccaaaccaattttcatcttcaaaatgatctagttgtgatattaaatccacatggcccgccacatgtgaaactgtgctgaaagatggcatgtaaacattaaaacgttacctttaccattctccccttctccatcaccatattacacaagactaattctgggctgtttgcatctgttacacaacactttcaacttgcagcttctagcatgtgactaaaacctcaataactcattttcctgatcatttggaaatggggctcaaaacatacaaacttatttataatcataaccataggtccctactaaaatgagcatctctatttataagaaatattttatgaggaaagcaacagaaaaagtgttctgttattcaacctatctgatgatttgtttctaagctacttgtgcctgagtcatataacagtacatatatattttttaaactgtacttttgcctttttagaatatatagctgtaacaagttcgtgcttgatttctaattacttacaatgggctcttacttagaaaaggcatttcttttttctccttctcctaattaagcataaaacagaaaatagagatagataattccaacccactactaacctctttgggctaaagatactgctttcaagatcaatttcaaagaaagcctctttgtgtctgtcctttcaattactccaattttaactagaacttgattatgcctacaggcagggaacattcctgtggctcacataatctacagattctcacagaattgggaaaagatcccaaaactacagaatcaagtaatgttcaaagccaaatgcaaggtactcacaacataaacatcaaacaacaaaagcacatttcagattgatccatactctactgagctcactattcttcacttctccgtaataccacatactactctgtaattactcttccaaaaatgcatgaatttagaaactttaaaatataattatccttctaactgaagaatgacggctctaccttgcatagttcaacagcctgttttctcttccagatgctcgactgacctctactggaataaaggggcagaatgcgtcagctggaaatcagatcagtactttctagagaggtccaagatgatacaatgggatggaggaagaaaatagttaaaactacaatttgtatttgtcttagcctttgaaaaattctttctacatatgttttataatataaacaatatgattgtactgtaagacatatataatcaataaacaaatgtacatatattgtaggcatatttctattgacaatgtacacaatcaaaaaagtgtgaagactactagacagtgcactttcttaggactattagcatcatggtaaacaggctgaataagccacagaatgttcaacagaaattctattaataacaaactaaaaataggtgaaaatgtaagccaaaattcctaacaaaaagtaacaaatctataaacgtttcttctaaatctgtcacaagtaaatttcatgtcttgtgtataactcatcctccatggaagtttcttccacacaaacttaacatgccccaaacttgagtatctttcccagtccccaaatttgccctcttctgactaaagatatcattatcacaatcactatctaagagtcatttgtgataaaaatctaaaagtgagctttgctttcttcctcttcctcaactccagtcatcaaatcacgtagactcaacttctttggcatctctctgaaatccaacctcgctactctttgtaattctcattctgttacaagtcttcattctcttttacccagcctgtaacagccacctgatgtgcttctctgacatccatcactcgaaactgccaccatactgacatttgtaaaatgatgtgattatgtccctcattctctgattaaagaccttctgtagctctccccgaaaaaacaaaatcttcaaagtgatctttttctagctaccttttcagttagctaactaccttaccatctacttctaactacctttctagctatctcttctattgtaccacctcaatacctagcactatcgcctctcaaacctctgatcccaaacatccttgcccattcctgtctccctacctttgcttaagctgttctttcttttagaaaggcccatcctcctgatgcctatccataggacaaggtcccattcaaatataatcttccctcaaatccttaacttactttaaaatactaaccactgaaatcaaccatttgttttatgataatttattactaaggaatctaaaactaagctttctatttatagaaaacaagagctgaaatggacttacaactggcaactgaaatttggtcttgattacaatactaaaatgcaataaatttactctaaaaatgacatctaaaaatgacatgtgtggtctcagctaaacctagaaatttggtcttgattacaatactaaaatgcagtaaatttactctaaaaatgacatgtgtggtctcagctaaacttagaaacagtaattaataatattgactgttaatgaacatatgaggaaacagaggaaattctcaaatattgttaatggaccagaatttggcaccagctgccacaattttaaatgttcatagcctttaattcagcatttccacttcttggagattatccaaagggggaaaaaagggccaggggcagcggctcacacctgtaatgccagcattttggaaagccaaggtgggaggattgcttaaacccaggagtttgagaccagcctggacaacaaagtgagacccttattctacaaaaaatcaaaacattagccaactgtaacagcacacacctatagtcccagctgctcagaaggctgaggtaggaggactgcttgagcccaggagatccagactgcagtgagccataatctagccactgcaccccagcctggatgacagagtgagcccatctcaaaaagaaaaaaagacaatatgtgtttgttatgaaaaaggatgactaggccaagcacagtggcttcacacctataatctcaccactttgagatgttggccaggagtttgagatcagcctggccaacatgacgaaaccccatctctactaaaaatactaaaattagccaggcatggtgatatatgtctctaatcccagctactcaggtggctaaggcacaataactgcttaaacctgggaggcggaggttgtagtgagctgagattgcaccactgcactccagtctgggcaacagagcaagaatctgtctcataaaaaaagaaaatagaagaaaaagaaagaaagaaaaaggatgaccatcataacattatttgctataacaaagaagaagaaacccaaatggccaccaatagaataattaataaattgtggtacatctatgcaatatactataaaggtgccaaaaataaaggccgatctactgcaatcaaaagatgtcagatattctacatgacaaactgcttaacagtatggataatgccatgtatattaaaggcggggagggggacgttaatatatacagagggggaaagtggaatgacacttatttctgaaagattattagaggctatgtactacttctgaaatactgggactttatttaatgaatatgtgttactttgcagtcagatgaaaaaatttaaacaagtaaaactggcctttggtgtgaaaaacaatggaaaatacaaattatctttatctatttttcggtttctagtaccaaaaaagtcacacttcaaaattctccatgatgctttactcttagcaacggatctccattcaaaatactcataatatctagtagggtaaatgaacatctaaatagcctaatacaagaaagttagcaactttcctcacgtacaaatttcaaaaatggtacctattcaaaaattgacttcgatctatttctcaaattgactttttaattaaccaaaaccattatccaaagggctaatgttcaaacttaacaaacactgaaaatttctatgcttgtagtatgaggggtctaaaaaaagatttacgttcgcctctgccccacaactggcctgttaaaaaggctgttaatggaaataactaatcactggccctaaaataccacattccagctggtcttcttttgatacagcaagctaagtttggagatctttacatgcatttctcaccttgtttgtcctaaggaaaggctctgcatccctccagaaaggctggagaacagctatctctggaaatgacacacacacacaaaaaaaaggcaaaatatttcaggccttcctaatacaaaataagagatcgatcccagctaacgttctcgttgcattatgttctcgtgagatgcattacctcttgcaaacaacatttctcagacatacagaaaagaaaacggcaagtacatgcctacatatgatgggaaaaggtagcggaatcacgaatacgttttgtaccaaagctaagtgcttcatatatattgtctcgctttactccccacaacaatttaaaaggtaggcataagccttaaaattacaaaatctgaaacagcgccgagctcccatactagcctgccttcgctagctgaagcattagggttcgaacccaggtgggtctttcttaactcaaaaccaaggtaattccacaccgaaggctctttccatccctcttcctcctccaaagacaaatctgcaaagggctgcactgtacagcagtcacccacacccacttcttaacaaaaagaaaggaaagcacagcctcaccaccttcccaatctcaccctgaactgcacccatccactgtagttcgcttttacttccgcctct

SEQ ID NO: 2121 - DNA, 57214 bp, Homo sapiens
attcataatgaaattgaatatttatttgaatttctcctggtaatagcactcaacaaataagaaaaaccgagctgtgagattttgttttaaatgtagccatatttcaaaaggtaaaaagttggcttctatatttaatggcaagtgggacatcttctattttaaaattaacattcaaaaagtagtaaaatatacactatcatgaacacgatgtgttttatagaatggattcatgtccgaatactaatctgaatgtggaagaaatgtattatctgttaaaaaccacactggaaaaatgttcttttttataaaaagtagcttgaagtaaaaaggaacttgctaataaagccagtaaactttcacacgtgggatttttaaaaaatctccacccatcccacctctgaaaaaaaaagaaggagaagaataaaagaaagaaaaagaaaaaacccatatggtcaatctgagtagagccattcattacatgactgctcattctgtacaatgtggaagcctggttatttaggaaatatttcgtttcctaaagtgcatcttttgaagatttgcctagtaaaactgcaatatcatatacaaaacacttaacacaagacatgcaataacaaagctaaatcattccagtgtaaagttgttaaaactacttttaaaacttttgtttcaccaagaaataaagatgtaaaatacagtagcattcttgttctccaacagtatgcattgtatgcttttgttatttggcaaatcttttagagtcgaacaaaaataatagtctaaacaacatttcttctgtcattataatacgaatcccgggcagaacagtaagatgtagaggaagagttagatttttggaagctttggtgcattaaccacaggatttgcctcgtgcaagtatctcctccctgcactcttgtaatcataggtacagccatgagtttctgcataacgatgagatgcacagaagttgtttccacatctaaagcacaaaaaaagtttacgtgaatagttgtatttctatgaaaggctcatctgtctgggagacaggagcttgacttcaggtagtccaacaggggccctttggttctttttagcaatttcactgctgacatttcccttccattcgtaaacaagcataaatacccccaaaaagaacaagttaattatctacgaatatgacaatttatgataaagaagtcattattgactgaaacagggtagaccaggggcggtggctcaagcctgtaatcccagcactttgggaagccgaggcgggtggatctccaggccatccaggccaacatgatgaaaacccatctctattaaaaatacaaaaattagctgggtgtggtggcgtgcatctatagtccagctactcgggaggctgaggcaggagaatcgcttgaacccaggaggtggaggttgcagtgagccaagatcgtgccactgcactccagcctggtgacagagcgagacacaatctcaaaaagaaaaaagaaaaaaaaaaaagaatgaaacagggtatagaactctatcagtagtaaaactgcaaaaagctgataaatatgcccatcgtttctcttatacctagtaaacctaaaagaattctgaatttctgaggaattcagtctcatgataaaattaaaatagtaaaacctaactatgccatgaaaggatttttaaaaatatttctagtagcaaaataggttgttttcattcgaaccgaatacactctaaaaagcagggattgggatgggtgtggtggcggctcacacctgaaattccagcactttgggaggcaaaggtgagaagatcacttgaggccaggagtttgagaccagcctaggcaatatagtgagatctgtctctacaaaaaatttaaaaaattaaccaggcatgatggcacatgcctatagtcctcactattagggaggctgaggcagggggatcgcttgagcccaagacatcaaggctccagtgagttatgattacagtactgaaaaaaaaaaaaaaaaaaaaaagtccgcagcagcagttattttaattcaagcctagccccaatctaagggcagacatccaagataatatgacataacatccttggaggatatcaatcaatactaatgaaataaataattacagtaagaaaaaggtcatacttttttggaaatatattattcatctattttatattaacttttaattttttaattaaatttttaatagaatattcagggaggggttcttccaaggtgccactcaaacaaaatccaagcaggttcatcataagacgaaaaaggtacactctcagattggtttaaacctcctaacttaaaggacaaggaaggatctgtttttgtcttttggaaacccatgagctatctacttgttctttacttcagccaattagaagttcaactgaagatagctattgaacatcatcttaatgatgttataaacaggcaatttaaatattttattttgcataatccccaagctgggttatcacagagaaagcatctgagcttctccagctcgccaacctgcctgcattcgtagctactagccagtcctgttttctttccacaaagaaaacaatgatttgttgttttcttctttgtctgaagaggggctttcacaggtgggaggtgatgagtagtacattctcctgtttagagaaaggacaccttgattaacacaggcataaaatcctaaacatgaaatattattaagcaaaacacaaaacatagtcctatcaaagtaaatatctatgccataaaaattaatttgtgctatttttatatctaaaattacttataaaatctacaggtcaagttgcagtggaactatttcttttaagatgtggtaggtttctactgattagcacttatatttttagaactttttatacacaccactttcctcattatttctaatggtaatcagtttatataaagtacaccaaattttgacagagaataaagaaaaatgtctgcttcaaaatcatatttgatgaagcctctgagaacatgattgcaatataaatattctgtttgttcacaccaaaaagaagtaccagaatatcatgaaacatgccttttagtcctattacaccactgacagttcatcaaaccatgagcaagtcatttattctttcaaaacttcaatatgtttatttttaacataatagaacatgtatttttctctctaggttaataagcactttaaggtcaactcaatccatatatgtaaaaagcactctgaaagttttaagcatgttataattacataaaatgtcatattaataatagtaactaacagtacacagctcaatttcacagtactactagttttccaaaaatatttactgaattctgtattactgtatcaacttgagtttttaccttaaaaataagagcacatctgttattatataagaaagaattaaatcaattttttttttttttgagacattttgctctgtcgcccaggctgtagtgcagtggcgcaatctcggctcactgcaagctctgtgtcttgggttcaagtggttcttctgcctcagcctcccgagtagctgggactatgggcacgcaccaccacgctcagcttttttttttgtatttttagtagagacggggtttcaccatcttggtcagtctggtctggtcttgaactcctgacctcatgatccgcccatctcaacctcccaaagtgctgggattacaggtgtgagccaccacgccaggccaaatcaatttctttaattactaagttaaatgtcttttagaactgatcaaaatgccaacaaaccccagtcataagcagagaggctcaaagttcctgcccatagttgataaagtaacagtacaaatacacatgtgcttggtgtcacacaaaggctaagaagcaagaggcaaagaaagaatgcaagaacaagtggaaggagtgaggaaaaactggtagtgtcaatggtgctgggaccttttctccactactgaaaaaggtttaggaggcctaagcttggtatttagttggcagctaaaagtctgaaatttcttaaagggttcaaaaaattggatttacaattaattggttctatgtctttttttttttgtcacaacagagattaggtaatttgtacacaagcccagcaaaattaaatcttctttattaccagtataaaatacacttccagatcttgccaaaactagaaacaaaatttgaaacaattgagagactcctaatggtgcctgggtaccaactcagttaataaacgttttctttctcaagtgcacttagagataccaagaacatctcacaaaggtgagggagtaattccattatttaaagtatttttaaaaagatatttacttgcacttgcacaagacaccaaagaaaggcatatattacaagatgtccaatgaatgttaatctactcgaaaccatctttaaaattcaggcttaggatattcttccttaaacaatggtggaagaatctctgatgataatttaattcactgtagtcacattttcattttttttcttttcttaggggatgcttaacttgatattctccatactttttttcatttaagaactcttgtgaggctgggcgcggtggctcacatctgtaatcctagcactttgggaggccaaggtgggcgaatcaactgaggtcagttcaagaccagtcaggccaacatggtaaaactccgtctctactaaaaatacataaattagctgggcatggtagcacgcgcctgtagtcccagctactcaggaggctgaagcagaagaatcacttcaacccgcgaggaagaggttgcagtgagccgagatcgtgccactgcacttcagcctaatcaggtaacagggcgagactctgtctaaaaaaaaagaactcttgcgaatgtgtagagacagagaatacattagtgacagtaatgaggtagcacaaaaatataagtgcagtactctatgagagcagcctccatacatccttctaccaatagagaaaactattagcaactactgtgtactaggaaccatcaataaacatattgattccccactataaacaggaaaaatctaaattccttggactggcatttaaggtattattatgtccaatataatgcctttctaactatccagagacactgtaatttaccatgtcatacctaccccgaaggatgtaccaagtccttccacatctgcaatctcttctaaagtaaactctaccttgtcaacccagtagaatttgacttatcctgtaagacatcatcaattatcaactcctctctgaagccttctctcaaatgtgtactgaacagatgaataaagaaaaaaacccataaaatcatattgatggtaagagttgcttttcacaacaagatgaaaggtacttgaggtaattcacttgcttgccatttcctagtctcatattttatctaacatctaacaggatctacaaaaactgacccaacagaaaggcagcaaaaagtaataaatcagtgttccagacgcaaggctggtagtcgtctgcctaaaatcaatggctaaatctataataatgaatacagtttccaagggaaaccttatagtgaaaagaacagaggaccaatggaggaatttaggaagtcaattaaatgaaacttgcatcaaaatgtatatagactcttctagataattcagaatgatagttattacagtgagagaaaaatggaagcaagttacacagctctactgcagctagcagctgatacttcaaatctaaatgaaatcaaacaaaaaagcatatatctggggacaagcagagggctggttaaaaaaaaaaaaaaaaggacagaagaaaactgaggttaaggccaggcgcagtggctcacacctgtaatcccagcactttgggaggctgaggtgggcggatcccgacgtcaggagatcgagaccatcctggctaacacagtgaaaccccgtttctactaaaaatacaaaaaattagccgggtgtggtggcgggcacctgtagtcccagctgctcgggaggctgaggcaggagaatggcgtgaacctgggaggtggagcttgcagtgagccgagatcgtgccaccgcactccagcctgggagacagagtgagactccacctcacaaaaaacaaacaaacaaacaaacaaaaactgaggttaaaaaaagattaaaacaaaagtaaaaatttataacaatgtgatagcctagaattttttttaaaaaaaactatttcaagaatgaaggacacaaaaatcaaataagataaagatatggaggcatccaatggatttgaaattatggagattgtcagtgaccacggcaatagcagtttcagaagagcagtgagacgtgaaccagcactgaagactgaactagagctgagtgagtagggatgggtgcaatgcaaatttccaagaagatcagttgtgcgttagggcaggacagagttatgtgtcaacgaaaaacaacaactataacattaaaagtcaataaattacagtaataaaaacgatgtgatactggcataaaacagacacatagaccaatgagtagacagtccagaaacaaatcctcgtatacatgatcaaatgactttcaacacgggtgccaagaccattcaatgaggaaggacagtgtttcaacaaaagttaataagaaaatgggatgttcacatgcaaaagaatgaagtggaacccttactttacactctattttaactcaaaatggatcaaagacctaaacataagacctaaaactataaaacttctagaagaaaagataggggaaaagcttcatggtattggatttggtggtgatttcttggatatgacaccaaaggcacaggtaacaaaaggagaaaatagacaaactggatttcctaatgtgtcaggcatcggatttcctaatgtgtcaggcattctggactttccagtgatgccactgagatagcacctgtcaaaagagcagtggttccatttctagattgtggatcttcagataaattctgccattttcatttcacttcctgaaagtcagggttggcttgtgaaaagttgttaaacaacatgctaaatgtgaaatgtcaaccctcactctaaactttccccgttcagaacatcagatacttcattgggttttatagtggctttctgatttttggtagtccgttgaagacgggagtttgaaagttgttgtatactgttaacgactgtctgtccatgtactgcctgaaataccatgattgtttatggaaagtatctttaataaagctggatacagtttggtttcggggaaaaaaaaaacatgaaaagacatttctccaaagaagatctacaaatggccaataagcacatgaaactactcattaggaaatcaacttcactaattagggaatcaataatcagtaacactaatcgtcacagatacgcaaatcaaaaccacagtgacatcacctcacacccattaggatggctactagcaaaaacataggaaaataacaagtgttgccaaggatgtggagaaattggaatccttttgcactgtcgatggaatgaaacatggtacagcaactgtggaaaacaatatgacggttcctcaaaaaattaaaaatagaaataccttctgatcccgcaatttcatttctgggtatatattctaaagaattgaaagtagtgtctcaaagacatatatgtgcacccatgttcacagcaccattattcacaatagctaaaacatggaaacaatacaactgtctattaacagatgaatggataagcaaaatatggtgtgtgtgtatgtgtatattgtgtgtgtgtgtacacacacacgcacaatacagtatcagccccaaaaagaaaataatttctgatatatgctactacatgggtaaactttgaggacattctgataagtgaaataagccagtcataaaaagacaaatactgtttgattccacttacataggtacttagagtacctaaaaaatcattgaattaggaaatgaaatggtggttgccagggtggtgggagggggaagagtgtttcagttttgtaagatgaaaagtgttctagagaaaggtggtggtgatggatccccaacaatgtgaaagtcactgaactttatacttaaaaatggttatgacagtaaaatttatgttatgtttattttaccacagtacaaaataattgaaaaaatgtgcaaatagattatgattttataaccttgggccttacataggaatgaaaaacaaaccctaaatgtcttcaataaaaacataaaacccacatgacaaccataacaaataaggtatcttttaaaaccttgaggctacaaaggtggcacatctttggtaacgagtttcccatccctggtctgggtattaaaacatttaaaaagatggcttccttcctccttgaaaataatgactggccggtgcatctttaatgtgttaccatactggtagaaagaagtgctaatgtcatggtcacttccactaataggccttggaaagggctggccctacagactgtccctttcttttatccagaaatgactagttcatcaaaaagagattcttaccaccacctctgatgtttggccatgatgttgaaagacatctttctagggtaattcttcaaaacccacatggctctagagtggccagcaactaaggtggttgggaactacatgttcattcttcaataatcttgtgggtttttttgacatagataacacctcttccaagataatatatttcaatttcaatttttgttttattctttatatatgtcctacagtccgttctcataattattcttaattggaaaaagcatttagagacagaatttactctgtacatgccacagagaaggttcttcccatttctctttgaaaattcaaccggatgcataattatgtaattatcagccttgtattgttttcaaaattatctgtagcttacctacgcttttccctgctgctgcattatttccattcattccaacaccatgggtagactacaattaaaacacaaaacatctatagaggtgagtcaatgaagaatagaaatgatcaacaaacatgaaatacttgtattttatcactaagatgctgttggactttcattttaaattatttattccaatttttgtttaattaaattaactcagaacctgattccacatctagcaatatcgtgcttattatttatctttaagagggtagaatttgccgggtgctgtgactcatgcctgtaatcccagcactttaggaagctgaggtgagaggattgcttgagcctgggacgtcgtggctgcagcgagctgtgattgcaccactgtgttccaggagtttgagagcagcctgggcaacatggtgaaaccccatctctacaaagaatataaaagttagccaggcatggtggcatgtgcctgtagtcccagggactcaagagactgaggcgggaggattgcttgagccctggaggtcaaggctgcagtgaaccatgattatgccactgtgctccagcctgggtgacagagtgagaccctgtctcaaaaaaaaaaaaaaggccgggcgcaatggctcacacctgtaatcccagcactttgggaggcccaggcgggtggatcacgaggtcaggagatcgagaccatcctggctaacacggtgaaaccccatctctactaaaaatacaaaaaaaattagccaggcgtggtggtaggtgcctgtagtcccagctacttgggagcctgaggcaggagaatggcgtgaacccgggaggcagagcttgcagtgagccgagatagcgccattgcactccagcctgggtgaaagagcgagactccgtctcaaaaaaaaaaaaaaaaaaaaagggagagagagagtgaaatttgatgactcaaataaaaagttcttacttgggatggaaaaaaacattaaaaacatttagcatttaaaaatacatatttttaatacgtatttgaaaatatgggtgtattggcatgttcctatattcccagctactcaggaggctaaggcaggaggattgcttgagcccaggagtttgaggagtacaacatatacatacatatctgataaactgtttacattaacttatgttcaaattactgttctcatttcaggactaaaacagcattcaaaattcgactatcaagattttatacaaactaaataaacattttcagataaatttatgaaaataatctaatcttagccttccttatttatgtaaacaaaaaccaaactttaaataagttgaatcactacaaggataactactagagcatgttgaaaggaaaatactgaccaaaaaaactcctgtatgttctaactggggagaacttttcctaaagttttcttcctgaaaatgctggaggtttgtagacagcccagttccagagttctgaagcctgcctgccccacgtgtgctctgtaatctatttctgcttgtgctcccggccagtgaggcaagaaaactgatattatttacacaaccaacaggctctttggaagccttgttagtcatttctgtgatatcccgagcctcaactttggaaataacatcagatcttttcccaagtgaatcaactttaacaccttgaaagcaagtagtcctagagaaagaagaatcagttatgttttgaacatccagtgactgagaagaagaaggctgtagcttcccaaactcaaaacatttggactgtctctctggtttcaccagagaattatgtagcgacattggtgcagaacagcgaagaggtgacaagagtctattcttgtgaggacttaattcccggtagttaagaactgaagtctctactgattccccattcagcactcctgcaacatgcttgagatgctgctctggagctttcaaccctttgtcagcattagtgagtagcaactccagattcactttgcacgcaccttctaagccgctgctctgttcatcagcatttccttctgcaaatgaagccagtgagcccactttaggtagaagtgattgttcggttacacattcttctgaaggtaagacaatgttcccattactagatggcaagtttcctaaaaaatgttttgtttgcctaggcagggatgatccaagatggagaacagagtcagcaagctcctggtcatttcccaactccaaatggggtatctgaggaggtagtttgacgttgctactgaagtgagacagtgtgttattctcccagctattatcttccttaagaaattcaccagtgatagaagatatgtatctctcagcagagagttgagttgccaaacttgaaattccattcctggagatttcgggcggatatgcattcccaaaagcaggtgaacaagattgaccaatgttggggaggacccttaacaatcggtggcgagatggtgcagtggaaccactagaaggtcgaggagctacaggtgggtgaggttttatcttgacagctttcttaggctaaaaggaatgaatatacagtttctttacacagtcgttttctctgcccattaacaaaaattagcgaaggaagaaaatgttacttaccataacatactagcatttttactatctcaatttaaaatgtttaagaagaataaaatcttaagattatgacagagaagatgctattttccttcactgagtatacttttctgggaatattaaagaaaaataattttgttttatttccttactgctgtttctcagagttttactacaaagaaaatgaactgattatattagatatgacattgctgacctattttagatctccaacaatttttcctactatgttgaataaatgtttcattggactggtacacagaaaaaaagttatcaatcctaaaaaaaaaaaaaaagttaaaagggctaaactgctatccttgaaaagacttgctggcaacactggcctttggctggcttttgggaacatctatttcaggaggttcaggagggttcccatgaacctaactgataagagtcgttcattgtgccaaactatttacgcaataatacagttcatgatgaacacttgctttccttttgggagtctgaaccgcaaatgctaggcagagggtgcctacaatgaagaggcccagtaaaatccctgggcacagagtctctaatgagcctccccggtaaacaacatttcacatatattgttacaactcactgatagaggactaagcacatctcatgagactccactgaaagaggactctaggaagcttgcacttggtttcctccagacgtggctctatgcaccttttacctttgctgattttgccttgtatctttttgctgtaataagtacaactatatacagcaacatactacagccctgtgaatcttcctagcaaaccatcacacctggggtggtcttggtgccctctggcatggtagattttttaaaaagtaccacaaaaattcaagatcttatgaataaagttgagaactaaacacaagaaatctagctcttaaaaataagcaaaaatggtagcaagcaggcatgaggatgggatggaataccttatgacataccaatgctcccacttacagaagatataaaatatatgaaaatataagaaaagctggataattcagtggataccaactgaggcaagaaaaattagaggagctaagaaggaagaaaccttggaaagatgagctggctcctatagatgtttttatcctagagacagagttgtcgcctaggcaggagtgcaatggcacaatctcaggcctccacctcccgggttcaagcaattctcctgcctcagcctcctgagtagctgggattatgggcacccgccaccatgtccaggtaatttttgtatttttagtagagatggggtttctctatgttggccaggctggtctcgaacccctgacctcaggtgattcacccatctcagcctcccaaagtgctgggattacaggtgtgagccaccacgcctggcccaatctgtaattctttatccagcaaaaaattcttcaaaaattaaggatatgacttctgggctgttgaaattaatgacagctgcctaaaactgaatttctccatgctccagaaaaactacacagatcaacaacatacacaaataaaatcactcataacccatgcatcagaaaaactgggagacatatgatatgaacttcaaaatattccccaatccaagaaactcatctgcaaagcctatgcctgtggtgacagacaggcaaaagtatggagaagtatggagcttcaccaaaaaaaaaaaaaaaaaaaaagggaaaaaaaataaagaaagaaaaggagaggtttgctgatggaacaaagaaaaatccacaaaagacaaaatcccacttgattatgaagatactaaaaatagatctaagatatgggatatcaaacacaggctaccgagaaattaaaaggaagtgactttatttttatgtgtattttttgagacagggtctggctctgttacccaggctagagtgcagtggtacaataatggcttactgcagcctcaccctcccagggtcaatcgatcctccgagcagctgggactacagacacacatcaccatgcccagctaatttttatattttttgtagagatggggtctccctatgttgacaggctggtctcaaactcctggattcaagtgatcctcccacctctgcctcccaaagttctgggattataggcatgagccaccacaccgggcattaaagttgttcaggataaaggaggtagcttcaagaagacatcactttttgaagggagaaggggtaaattgaaaggaaaaggcaaccattgagactttgatagtaaaagtaaagaaagaagcaggaaagggaaaataaggatccttcaaaaacagtagtgaatcacaaatcagaaaacatactgacactgccctccaataagagtgtcattgatttgagccaggcatggtggctcacaactataatcccagcactttgggaggccaaggtgggaagattgcttgagttcaggagttcaagaccagcctagaaaacatgagaaaaacccatctctatcaataatacaaaaaaattagctgggcatggtggcaggagcccgtagtcccagctacttgggaggctgaggtgggaggatcgcttgagctcaggaggcagaggttgcagtgagtcaagatcatgccactacaccccagcctggatgatagagcaagaccccatgtcaaaaaataaaaataaattaatttttaaaataacaaataaaaaagtgtgtcactgatttaaaaaacctgcatctcactacaccaaaggaagaggatgctcttgaaataagaaacttacttccctacacaaaatcctcacttctgtgtattaatatataactgttaatactcatctaagtaaataaaattatagaaaatacaattagaaaataaatagaaaaaggcagaccaaatccatgtaaagctgctataaaaataaaacagaaaatgagaatcagaacattttagctaatgaaaatcctccctaaaacaatgaaacaaaagaaaactccatcacaataccccaacctaaattaagtatcttttagtatttgcagatattttttaaaatctcatcaaatcataaatgcaaaaactcaaggcagaatagataaaagtaataggaggatacgaaatgagagctgagcaaacccagaaatactctgcagaaaacaaaatcatctcagaaatgaagactaaattacaaggtgcccacaggagactaaaattctacttaatatttaataaagaatactgagaaaaggtataggccgggtgcggtggctcacacctgtaatcccagcactttgggaggccgaggcggatcacgaggtcaggagatcgagaccatcctggctaagagggtgaaatcctgtctctactaaaaatataaaaaaattagccgggcgtggtggcaggcacctgtagtcccagctcaggaggctgaggcaggagaattggcatgaacccggaagacaaagcttgcagcgagccaagatcgcaccactgcactccagcctgggcgacacagcaagactccatctcaaaaacaaaaatactgaggaaaggtatgaaaacagccaaaagaataaaaataaaataaagaatctaaaaggataagagagaaggtggttgtatattagacaaagaagttctaacagggcagagggggtatctcatgccgctgaggcaggaaggtcacttgagcccaggagttcgaggctgcagtgagctcaggctatggcactccagcctgggtgacactgcaagaccctgtctttaaaaaaaaaaaaaaagaaagaaagaaagaaaagaccacgacgatgttctaacttatgtataaaataagctccaaaggccgggcgcggtggctcacgtctgtaatcctagcactttggaaggccgaggcgggcggatcaccaggtcaggagatcgagaccatcctggctaacacggtgaaaccctgtctctactaaaaatacaaaaaattagctgggtgtggtgacgggcgcctgtagtccagctactccggaggcagaggcgggagaatggcgtgaacctgggaggcggagcttgcagtgcgccgagatcatgccactgcactccagcctgggcaacacagcaagactccgccccccaaaaaaaaaaaattccaaaaaagaaaacaaacaaaaaaacaaataaagtactaaaaaaaaaaaacatataaattctaagaaataatcctgaaataaaagacttgaatctttatgttaaaaagactcaagtgtatagtgaaaattgaccctgaagagttaattccaagatacatcctaataaaaccactacatttaaaagaaaaaaaaatcctcattttctccagacaaaaaaaccaaatcatttacagagaaaagaaagattggtaattagatttctcaatggcaatataaaaagcaaagcatagcagagcaacattttagacaaactcaagggaaaagatgtgaaccaaacattttatatccaggcaagccatcatgtaaggattaaggctaatgtttctagcattaaaaaaagatgaatatttaaggttatggatatcccaattacactgatctgatgtttacaaattatattcatgtattaaattatcacatgtaccctgaaaatatatctattacgtatcaatgaaaataggaaaatacaaaaatagaagaaaaacctacaattaatatcatacataatggtaaaaacaaataaaaatgttaagtctaaagaaaagggtttgaacatcgaaaaattcaagaattactgtacctacaagcctttcttgaggacttcagatgagcttcttctaaccaaaatgtatggggaaacctacagcaaaaagactgatcataagaatggaatacaattggccgggcatggtggctcatgcctgtaatcccagcactttgggaggccaaggtgggtggatcacaaggtcaggagttcgagaccagcctggccaacatggtgaaaccccgtctctagtaaagatacaaaaaaaaaattagccgggtgtggtggcacacgcctgtaatcctagctactcagaagactgaggcaggagaattgcttgaacccaggaggcacaggttgcagtgagccaagatcgtgccattgcactccagcctgggtgacagggcaagactccatctcaaaataaataagtgaataaataaaaaggatggaataaaattaaaactaaaataagagtgagtagaaagaaaaatgatttgtaaaggctatgttttctttaaaaaagtagaaaaaaatttttaatgagaggatgaagagagaagagaaaaaaataagttcactgattttcacttagtaattaggagtcaaaggatatttaaagctggcaaataaaagaggagaaggttaaataaggaaaaggcagatcaagaacatgataaatagtattaatgtaaagtgaatcaataaaacaaaatgcaaaagccttctgaaataccaaaaaatacacccttacacattcatatatacagatacacacaaaagaaagcatagagaaggaaactgtaagtataacaaaataagacatttaagaccaaatatgaagtcatatcaataaatataaacgtgattaagttacctgttttaaaatttcaagctggctcacaaagcaaaaaccaactctatagtgtatataaaggaaatatgtaaaacaaagtaacttaaaagttaataaatagagacatgggaaaaggtataccaagcaaatgaaaccaagaagataccagtaggtatgggcctgatatcaggcaaggaaaattcaaggggaaagtcagtgaatgtgatagagatgaaacatttcactacttttgtaactagcaacacagtgaaaatatgttattaatatttatgtaccaaattacacaactaccactttcttacagcaaaaagtatgagaaatgaaaagagaaatacacagaaacctatgaataatagaccttcatctattaccattctcattctaagacagatcaagttgacaaaaaaaaaaaaaaactttaataaggtctatcttataaatatctagcaaacttttacctttttgatagagaataaactgtcttctgaggtatatattcatgaaaagtgctattagatcccaaagaataaaatgctataaagtagaaatacaaacaatattctctgagttccatgcaataaaactagaaattaaaaacaatgaaaaatcaagcccggcatggtgctgcacacatagtcccagctacgtgggaggctgaaatgagaagatcccttggtcccaggagttcagtaacatagtgagactcccacctctaaaaacaagaaaagaaaagaaaaagaaaaaccaaaaagcctctgccaccagaacattttcaaaatatattaaaatactcttggactaatgaggaaataccaactaaaattgcaaattttctttaaaaaaaaaaacgaaaaagaaactactacaaattaacattatgtgccttctgatgtgttgcactgagaagaataaatcatctgtgtagtattcctaccaaaaatgttcaaattccatctaatcataatgaaacagccaaatctccaaattgaagaatattttacaaaacaactgatctatattcttcaaaaatattttacatgcatgtccaaataaggcttagaaacagttttgtataaaaggagactatgaaaacattacaacgaaatgcaatgcatcattcttgattggatcccagattaaaaacaatataaaatgctattaagcacattattaagacctgggaaatatgaatatagatgacataatgtgtatcaatcataaatgagtatggtaactgtatcataatcatgtaaaaggtggcccttattcttaggagatacataataaataaagtacttaggggaagtgtcatgatatctaacttgcacatagatcagctaaagaaaaatccaaacagaaagcaaatgtgggaaaatattaattgatgaatctagtcttataacatttctaaataattaaacatttctcagccaggcgcggtggctcatgcctgtaatcccagcaccttgggaggccgaggcaggcagatcacggggtcaagagatcaagaccattctggccaacatggtgaaaccccatctctattaaaaatacaaaaattagttgggcatggtggctcatgcctgtagtcctagctactgctactcgggaagctgagggaggagaatcgcttgaacccaggaggtggaggttgcagtgagccgagaccacaccactgcactccagcctgggcaacagcaagactccatctcaaaaaaaaaaaaaaagaattaaacatttctcaaaattaaaaaggtaaaataagttttcagacaaatgctgagagaattatcatcaggaaccctaaatgaaaagaagtactagtactagaagtcctagctggagaaatcagacaagagaaagaaataaagggcatacaaatttgaaagaaggaagtcaaattatccttgattgcagataatatgatcttgtatttggaaaaacagaaagactgcaccaaaaaacgattagaactgataaacacattcagtaaagttgcgggatacaaaatcaacatacaaaacccagtagcatttctatataccaacaataatctaaaaaaatcaagaaagtaatctcatttacaatagctacaaataaagtaaaataaaatacctaggaataaacttatctaaaaaagtgaaagatctctataatgaaagctataaaacattggacgacacaaaaatatgaaaaaatattccatgttcatgagttggaagaattaatattgttaaaatgtccatactgcccaacgcaatctacaaattcaacataatctctatcaaaataccaatgacatttttcacagaaacagaaaaaataatcctaaaatttacatggaaccacaaaagacacagaatagtcaaagccatctaagcaaaaaaaaaaaaaaaaaacaaaaaaaaaacaaacaaaaaaaaactggaagaatcacaattatgtgactttaaattatactacagagctacagtaaccaaaacagcacagtactgacatgaacatagatgcacaaccaatggaaaagaacagagaacccagaaacaagtccacagacccacagtgaacttatttttgataaagatgccaagaacatacactggggaaaggatagtctcttcaataaataatgttgggaaaactggatccacatgcagaagaatgaaattagaccccttatcttttaccatatacaaaaatcaaatctaaatgaactaaagacttaactctaagatctgaaactatgaaactactaaaagaaaacattgaaagtagggtctcaaagacatatttgtatacttatgttcatagcaccattattcacaatagccaaaagatgggggcaatccaagtatacattgaggaatgaatggattaaaaaagtgtggtatatagccatacaatgaaatattatccagccttaaaaaggaaggaaattctgacacgttatgacaattttacaagacaaaaaacttctggagattggttgcacaacactgtgttatacacttaacattactgaactgtttgtacacttaagatggttaagataattttatgacatatgtattttaccacaaaaataaaatttaaaaaattttaatggtagaatctagatattagataaataagtgttcatggtaaaattctttcaaccttactgtatattggaaaagaaaaatatagatcaaaatttctctcatgaatgaaatcgtaatgcaaaaatcctaaagaaaatattaataatttaaatctaaagaaatgaaaaatacatcacaaccaagaatggttcattctaacaatgcaagactattttatatttttaaaaaatcagttcatcacaatatcagaatatttttattcagtgaaaaaatacttacttctctttggacttcttgactatcagttacttagaagtgtgttattttcaaatatcagaaagctttccacatatctattattaatttctaattttattccattgtaatcagagagcatttttgtattatttggaatcttttataatttatttgaaactggtctaggcgcagtgactcatacctgtaatcccagcactttgggaggccaagacaggtggattgcttgaggtcaggagttcaagaccaacctgaccaacatggtgaaaccccgtctctactaaaaatacaaaaaattagccaggcatggtggcatgagcctgtcgtcccagctactcaggaggctgaggtaagacaatcgcttaaacctgggaggtggagattgtagtgagccaagattgtgccactgaacttcagtttgagggacagagcaagattctgtctcaaaaaaaaaaaaagaaaattgaacctgttttatggcacacaatatggtttaccctggtaaatgttctacatgcacttaaaaagaaatgtgtactctgctgttttgggtagagcatactgtaaatgtcagttgggtcaagtaggttgattagtgttgttcaagtctcctaaatccttcactgattttctatctgttccatcgatttttgagagtgggatgtagaaatctttcaacaaaagtatttgtttatttctttgtagtttttgcttcatgtattttgaagttctattattaagtgcataaacatttaggactgtgaagaaaggatgttttttcttaatagagctaagtcaattgttccccatcagaaaaaaaaaaaaaaaagatctttaccccactttacgttatatcagaaaaatttcagctgggcgcggtggctcgctcctgtaatcccaacactttgggaggccaaggtgggaggactacctgaggtcaggagtttgagaccagcctggccaacatggcaaaaccccatctctactaaaaatacaaaaaatagccgggcatggtggcacatgcctgtagtcccagctactcaggaggctgaggcacgagaatcacttgaaccaaggaggtggaggttgcagtgggccaatattgtgccactgcagtccaccctggagacacagcaagactccgtctcaaaaaaaaaaaaaaaaaaaatttcagctggactaaacctaagtgagagaaaaacaatcataaagctttaaagacctgtggtaggaaaatatttcatcaaaaggttatcaaaaatgataatcataaaagtaagctgggtgcagtgactcatgcctgtaatcccagcactttgggaggccgaggcaggcagatgacaaggtcagaagttcaagaccagcctgaccaacaaggtgaaaccccgtctctactaaaaatacaaaaattagccgggcgtggagatgcgcacccgtaatcccagctatttgggaggctggggcagaagaattgcttgaacccaggaggtggaggttgcagtgagcagagatcacaccactgcactccagcctgggcaacagggcgagactctgtctcaaaaacaaaacaaaacaaaacaaaacaaaacaaaactgataaattagaatacaattaaaaacattcacccaaagaataagaaagtaaaagaacaagccaccatagagtgttagaagtatctgcaacccatatatctgacaaaggacttgtacccatagtatataaagatgcctagaaatcagtaagcaaaaggcagagaactcaatttaaaaataagcaaaagacttgaacaggcacttcacataaaaaacgtatcttaatggtcaataatcatatgaaaagtcaatattattcctcattagagaaatataaaagaaaaccatttacacagtcaccagaatggttaaaattaaaaggactgacaatatcaagtgttgacaagaatgtggcataaactagaactctcacgttgctgggaagaatgtaaattggttcaaatgcttggcaaaattggccgggcgcggtggctcatgtctgtaatcccagcactttgggaggtcgaggcagtcagatcatgaggtcaggagatcgagaccaacttggctaatacggtgaaaccccgtctctactaaaaatacaaaaaaaaaaaaaaaaattagcccggcgtagtggcgggcgcctgtggtctcagctactcaggaggctgaggcaggacaatggcgtgaacccgggaggcagagcttgcagtgagccgagatagcgcctgggtgacagagcaagactctgtctcaaaaaagaaaaaaaacaaaaaacaaaaaaacaaaaaaaccaaaaaatgcttggcaaaattgtctggcataatactaaagttaaacgtgcatcttccctctgactccgaaagtccattgctaggtatatgctccaaagaaacaagtgctatgtccaccaaagaatgtatgagaatattcaaaggaagtttattgataaaagccaaaagctagagacaactcaaatgtccatcaaaaggaaaagaaagaagcaaattgaggtaaatcaatcacacagtacaatagtacacaacaataaaaaagaattaactgatacatacaaccacatggataaatcaaacaaatacttttaacaaaagaaaccagaccatactctctatgattccatttatataaatttcaggaataggaaaaacgtatttacggtaatagatgtaagaacagtcgttatttctgagagtaggaacaggtacgtattaactgggaaatattatgaggaaacattctggagtgaaaggtcctattttaatttgggttgtgtctacatgagtgtatataaatgtaaaaattcgtcaagtagtatattaaagatttttgaattttattatacatgaaaaggaagggagccattaatagagtaaaaaggaaagcaataaagtggtaatatgaaacaaaggacttttatctagaatatatataaaactccaaaaaaaatctgtaacaaaaaacatacaacccaatagaaaaatggaaaaatataggtgttttattaaaaagggtatccaaatgcccaataaacatatgaaaggtgctcaaccttccaggtctcatgagagaaatgcaattaaaaccacaatgtgatgccaccacaaacaaagtaggattacaaaaattacaaaggaccatgccaaatactggtaagaatatgggaaaatggcaactctcattcactgttgtaaagaatgtaaattggttcaatcactttggaaaaaactggcactatctactaaatagtagatatctttatccataataaataaatattaacatattttaaaaagtaattattgccagattaagattaagctctctttttttatccttcttagacccagaatgatctttaaaatgatgttaagtgcagtataatcccttcaggtgtgcttctaatccaaaaaatccaatttatcccttttagaagtttaataaataactgaggccagaaacctgaaatgaataatactttataattttttcacaatgaccaacagacctcattgctgagtgctctgcaggggtaagctagagataagcctggtcaaatgccaacagcttcacctttttgctgagattcatgttcttcatcttagccttcagcagcttcatcttattcatagttattgaattttcaattatctgttgcccagaagaagaaggctcagtttcttcatcctcatctgtatctgaattatacatagaaccaccactgcaaagaaaacaataactacttgaaatttttctgatacctgctcagtgactaaaaatgctctatatgaaacagcaatctatagaagttactaatgataaaacactacatccattttgtcaatgttaatgtcaggaaaatatatttcaaagaatgtacttcttaaaagaaaaaatgaaatgggaataaatattatgatctaggattactgaaaatctagtatagctgagcttctctgaattcagtatatcataaatgaagatgttttgacacctgccatatcattcccaaagaggcaaaatccatttccatgagaatgtctgatttcattttatcagccaaggctgataattgtgcaacccagacaacaggctgatgagatttccatgaatcagaatttttttaaatttggcacgggagagaagtacagatttttagtcatcctgaggagattctcactaaaaaaaaaaaaaaaaaaagaattcatacacaggtgtcatcagaacattttctattcttaaggagcaaaaaacattttttttttcttgagacagtctcactcttgtcgccaggctggagtgcaatggcacaatctcggctcactgcaacctctgcctcccgggttcaagcgattctcctgcctcagcctcccaagtagctgggactacaggtgtgtgccaccatgcccagataattttttgtatttttagtagagacagggtttcactgtgttagccaggacagtctcaatctcctgacctcgtgatccgcctacctcggcctcccaaagtgctgggattgtaggtgtgagccaccgcgcccagccaatacatttttttaagtagagataacttcaaatttttctaagtgtgtttgaaaatgtaaaaacctagactagcatagattttaacaagaaaaaacacatccagtcaagtcatgatacaagctattaaacaggttaaacatttcaattactgatcaaccacagcgacgttattcatatttcaatgtaattaatatttggagcccttcctctttgattgtataatataatgatgtatcacacgatcctcatatttatacttacatgtttgttttgccccttattctcccacatgtaagcaagttgaaagcagacattagactttatcttctgagtctgcaccaggcacagcgcttggcacatagccaataaatgtttgatgaactgaacacaaagattttgaaatttaatttattttttctataatgggaaaattagaatggcaaggatttgataaaacacaagcttggcacatttggaaaacaattaagactttaaataaagcaaaataagaatacatattagtttctatgcagatttacttataggaaaactaggttatctacactatggaagtatgaggaaaatttcccgttttatatggttgtaagaaatggaaacaatttaggacagccttaatggggtatattccttaatgtttctgaagcacatattgtcacacaaggccaaaaaagagagcagacagccccattcctaaattttatatggtgcaacatgaaatgttctgaaactgtgggttaattacacgcactatacgcatgggtagcatctgaaggaagaatgtaggactggtctccacaaccaattcagtctgtggtgcttgacttgtgacagccacagttacctactacagcatggctaccacagtatgataactgacacaagtacaacactgaagtaataatattgcctgccatttactgaatgcctgctctgccaggcacttcccacacattattcctaattctcacaaaactacataaggtagatattatagctgattttattaatgaagaaactgcaggtgagagaggttaagtgatttggctcaagatcagaaagctatagacagcagacctaagattcaaatcccctatgtgtctggttcctaagctgattcttcctactactactcattgcttccccaggcaccaaatgacaggacttactgcatcatgcttgtgcacccagatgagtgccagaacttctactgtgtgaaggcttttgtctcaaggccaactatacaatacctgaagaagggtgcatgaagattttcgtcatgtcaccctgtggagttagaaggaataactcaagtatacactattctcagttaccttgcaatattttaaccttaaatacttctgagttactctgtggcattttaagtatctttactgaatactgaaagaagtttctgattcaacattactgtcatgaaaagacctattctctcatggaatagatacatatatacacacacatacatacacacatatatatatatataaaagaacaatcagctgggcgtgatggctcacgcctgtaatcccagcactttgggaggccgaggcgggtggatcacgaggtcaggagatcgagaccatcctggctaacatggtgaaaccccatctctactaaaaatacaaaaaattcgccgggcgtggtggcgggtgcctgtagtcccagctactcaggaggctgaggcaggagaatggcgtgaacccgggaggcagagcttgcaagtgagccgagatcacaccagtgcactccagcctgggcgacagagtgagactccatctcaaaaaaaaaaaaaaaaagaacaatcatgataaatcactggactcattttagagtataaaaacacttttaaattcacctttttttttcaaagaaccacattattttgttttctctcatgaagtatagattcatgagatgagttagaatccaatcacaaatttttttcagatgaaaaaatgtaactaggttaacatactaatttataaatttaatccgaaatgactttctttatatttaaatataatataacatttccttgaatttctaaattttttttagtgctatatgtaatttctccaaatcttttttttttttttttttttttttgagacagagtttcactcttgttgcccaggctggagtgcaatggtgcaatctcggctcaccgcaacctccacctcccgggttcaagcgccctttctcctgcctcagcctccctagtagctgggattacaggcatgcaccatcacgcccggctaattttgcatttttagtagagatgcggtttctccatgttggtcagactggtctcaaactcctgacctcaggtgatccgcctgcctctgcctcccaaagtgctgggattacaggcatgagccaccacgcccggcctcaaatcttttgatttaatgatatgattaaaggatacaagataggcaaatgtaatattattcaagcatgaaatctgcacatcgcaaagccaagacctcatttaactttcacagtttaccattaagtcttacaatgtctccttatctatctttctgcttaaaaaatcccaggccgggcacagtggctcatgcctgtaatcccagcactttgggaggccgaggtgggcggatcaccaggacgggagatcaagaccatcctggctaacacggtgaaaccccgtctctgctaaaaatacaaaaaattagctgggcatggtggcgggcgcctgtagtcccagctacttgggaggctgaggcaagagaatcgcttgaatctgggaggcagaggttgcagtgagccaagatcgtgccactgcactccagcctgggtgacagagcaagactccatctcaaaaaaaaaaaaaaaaaaaaaaataccagtaaggtggcatgatccactaaaaagatttgagactaaaaaaagactgatgctgcattttgtatcagaatgaaacaaattaacactcaattctccctctttctttttagagtagaagccagcaaaccatggtcatgggtcaaatctgccccaccacctatttctatttctgtgtggcccatgagctaagaatggtttatgaactttaattagttgaaaaaactcaaaataatggtatttcataacaaatgaaaattaaataaaattcaaatttgtgtccataaataaagttttattggaacaaagccatattcacccaatcatgtattacaaatggctgcttttgcctacaatggcagagttgagtagctatgacagactttatgtggctctctcgttgctctacactgtgatatggagaactacaaatcacagtaacatagtcataattcaacagtattttgactgccatgtatattgctattctgtgactttttttattactagggtatacccaaccttgtcaaacaagaaaagtagacttcaaatgttgccattttaaggtaccgtagagtggattatttgttagcaattagatagcaaagcatgatgcttataatgcagtgacactatagctatgctaaaggaaaacagcataaatagacattaccaggttaggcattcatcacaatattcccaactttcaggaaagcaacagtcagaaaaactagaaaatttacagtagaatatctcatcacagcagaatttctttacacaaataaaaaatgaaaatgaagctataaaaccaaagaagtttctgaatgtttatatctgctagccaagcaaggaaagctactcatcaatagtgaattaattcactattgatcacagcagttgaggaagtatgtcctgagaaaataaagttgtttaaagattacttttccagcagggacaatttctcaaaaagttgatagaattggaagtaatgtcaacagctgatttaaaaagctgattgttttttgatgagctgacatatattacccatattgctctgtgttattgtttattgagggcgtcaataccaagtttgaagtgactgaagagttggcccctatgaatagtctgcatgaagctactacaggtgagaatattttcaaataaattgctaaatactaatttagtacaactttaagtgaactctgctataactgatggggtgatgtgtgaaacagaaaaaaacttattggacaaatttatagttagtgaacatgtaaggtctttttttttttttttttgtctttttgagagggggtctcactctgtcacccaggctggagtgcagtggtgtgatctcggctcactgcaacctccacctcttgggctcaagcaatcctcccaccacagcctccgaagtagctgggactacaggtgtgcaccaccaggcccagctaatttttttccagatggagtttcactgtgttgcccggacttgtctcaaactcccggactcaagagattcgcccaccttccaaaagtgctgggattacaggtgtgagccaccatgccctttaaacatgtaaggtctttaaagtctacagttattcattgtattattcatcagcaggtatttcatggtaaatatctgagtctatcctgtgttattaaaccagcagtgttaatggtaaacttcaattgtttcatggacttatccatcatcagtttggtggcttactggtaataaagttttattatgttttttttagctcaggaactctgaatgagaagaactggccttaactactattacaaacactttttaaatttttaaattgcctttggaaattaatttttactgtggacttcataatgtttcataatgaatttaacctaaaattacaaaataaaacaatatttatatgtgaaacatatactgcaataatgtcatgttaacaacaactagtgtttgaattacacgtaacagcaagctgcaatcattcccatgctttcaaaagtagaaattaagtgatatctctattcccacagaaatttgcagcagatatatttccgagctcaaattataggtctagcagtgtttttatacctcagtgcaatttccaaataatgttctatttcaaaattcatttaaatgtgcaactgaggagcttccagggcaaacaccaagagaagatctgatagaattttataaacgccttaaaaatgatcaatatgttcaataaaagcatgtgctcatggactgatatcagcatctgacagtacctatctgtgtgaaaaaaaaatttctaagataaaatacataaaatctcattacagatcagctctaacaagtgaacttttgcaattgactttgcaaatttgatgggcaacactaactttccacctcaattaggtaaaacgttattcccatgaaaaagaattccattcttctctggaattctgtggtacaaacagaagaaaagtacccaattgttagtcttatattttgaactttgttagtgaaagttctgtggaaatttgttttctctcgttacataagtacctatttaatatccttgatgctgtctcttggcctaaaaatcctaaaatagttactatctgcacacctttacagaagaagtttgctacccctgttgtagactaggaaagcctcttctagaacaggaaatataaatgttcttcatggtatgatcagattgttttctactcctctttctcattcatccatccctttccttgtccaattattgtagatgaatacaaaggaagaaaaaatatataaattatcttgtgatgaacaacaagacagttctaattaaattccatgatgatatttgggctgagtcataaacacaaatagaagttggctgaggagaagctggagtaagaggagaaaatgacgtttcaagcaaaggagaaaagatgtctaaaaacacagcataatgagaagacctggaaaactgatggtaacacgttgtcaaaggactcatacgctaagctgaggagcttgggtttcctttaggaaaagggagccaaaagagtgtgtactagagaagaaaactaaacagtgagccagcacacggcaaaactggtatgaagacattctattaatggcctaaggctgtaaccctcactgctacctcctccatttcttgcccagggtttatgccaagtttgaagtgctaaccagatgctgacatgttaaagtcaacaggtaacacccatgtgtcacagtctgctctctgaggccacaaaaaattcagtctaatctttctttcatgtaacactctgtggaggggcagaagcctaggggaatctctctgactcttgacccttggtgttcacatcacatatggtttcctacccttgagtgtgggcatgatggacatctagcttctagccaactgaatatggcaaaggacgttgcagatgtaatttaggccccaaatcagttggttttgggttcatcaaaagggagctgagggcagcctctagtcaatagccagcaaaaaactgggcgctccatcatataactgaaaggaaatgaattatgccagcaataagagtgactctgtaagtagattctcctccccagtcaagcctcttgataagagaattgctgacaccttgactccagattgtgggacttggagcacagcaatgctgtgcctggactcctgatccacagaaactgttctccaaactacaagctgttttttttttttttttttaatgattttaccactacctttttattttgcaggatgtgtaacaccttcccttgctttgtctgcttggcaaactccactccccttttagggtcacttcttctcagaggatgtgtctaactctctgcctttcatgcataataaaggccctgtcatctattctcccagagatcttgatatctttttataacatcaccaacattatatcactgatactcttcatagcagactgcatgctccatgaaggtaggaataatcatctttacaacatcagtgccttgctcagtgaatggccataaaagttcagtgagtgaatgcttaataacttgaagtgaaaggagataaaaaaatcatagtaactcagaatgcacagcaactaactgagaggttgccttgtccaattctctaattcttctattgcttagctaaatatatgtagggtttttcctcctgattttagaatattacaatttatctcccttttatagagtaggaaaacaagaccagagaagtaaagagatttatctgcctttaaggagcagagttaaatttagaaaaaaaggtatcaactttaggtttaaccctttctattatgctaaggttgtataataacacactattatgacaggattctataatctattaggcatcttagagtttcacagactaacagaaacaaatctttttatgaaaacatcccactctaaaaaaacctcagttttatcatatcaattatacgaaggacaatttcagacttatatattgggggctggggcaggaatgagatgcatgacatttgttaatatatatagattattttgacaacacaaggtaaacaaaagtttatggagtacctcatacgatgttctccttttctccgtaggacatgcaaatgaaaatctattttctttgaagagtcagataacggtgttaaagtgccatctcccctatctactgcaggaaagaaattcaattgatctccttcttggtataccaaaaatgtaacttgtttgctgcaggaggtcttctcccagacctcaactcgactggaatccaagtactctgccatcttcctaagtggatcgtctgtaggaactacaaatggaaaattgaaataagtcttcaatttggatcaagttttatgcatcttggtacagtgacaggatataatatactgaatttgaacaacagtcctgtgcatataatataaacatgatattcttcaaataagtttctgatctttctacaattaatatagcattccctatgttatattaataagaaacaaacaaacaaaatgcatgattatgttgctatattcaaagacagggctaaactaaaacatgagagttttttgtcctatgccattatagtctatattttttccctatgtcactagagtctgtgtatttgctgattctatgatattactatcaataatttttttactatatactttctgctccctatattttcaaatattggttccaacaataattaaaaccaaaataaattccacttacgttagattaaaagtacacagacacggccgggtgcggtggctcatgcctgtaatcccagcactttgggaggccgaggcgggcagatcatgaagtcaagagatcaagaccatcctggccaacatggtgaaaccccgtctctactaaaaaaaatacaaaaattagctgggcatggtggtgcgcacctgtagtccctcaaaaaaaaaaaaaaaaagtacacacacacacacaattaggagacatatctaagaaattagaagtaagcagacctatctttttctttctggttttatataaaggctgattcttaagagctgttccttgacatgaagttaggtaattaaaagtacataataacttagaacgtgaggggggtcacttcatgtactaaaactgcaacagttccaggaaaaaataaaagttctctcccaaagacattctcatcatactgcagaaacatctgttttctcctaaaagaggtaaagatttcccaagctgcataactttcacttatttattaacagaatcgtggtgctctacaaccctttaaaaagaagttgcagcaataggaaaatattaaacttggaaagcagtaaggtaaaaacatcaaagatgcttccatagcctaaattcaataacactattactaacataaaaatcttataatatggtttagcttgctttatgaaaacagttatttggatgttttgatttactttcacaggcccaaaatgtataaatattaaaagacacttttcaaacaagttcttgccttttgtaagttaatgctccactttccatattacatcaagagataaaaatttggatcagagagcagacctttaggggggaaaaaacccaacaaaacacaacaaaaaagaaataaaaattatgcccattttttagatattgctatagccattaccacagtcacatgaaagcctttcctaaaccagcacagggtgccttactcaggcaagtgtatgtgtggatcttctcataacagaaaaatctttcagattttatcagctataaaacaatatatatgaagtttgatatgcattgggcacaatttagttttagaaaagaaacattttaatctttctatgctgctttgataatagttatttcaaaaacaatttttttttatttgtattcgttttttgagacagagtctcactctgtcacccagactggactgtagtggcgcagtctccactcactgtaacctctgtcacccagactggactgtagtggcgcagtctccactcactgtaacgtctgtctcccaggttcaagcaattctcatgtctcagcctcctgagtagcccgccaccatgcccagctaatttttgtatttttagtagagatggggtttcaccatgttggccaagctggtctcaaactcctgacctcaataccactgcctgtaatcccagctactcgggaggctgaggcaggagaatcacttgaacccaggtggcagaggttgaagtgagcagagatcatgccactgcactccagcctcggtgacagagcaagactccgtctcaaaaaaaaaaagaaaagtaaaaaatatatatatttacctcagaatctgtatcacactcctcataaacatataaaataattttagttctaataagaaaagtaggtgttttgattaaacactttggtttaaagtagtactacgcacaaataaccaactttcaaaaatgtaatacaatagagttcacatggcattaaacactatataattctatcttaacataatggttcagtaaacacagggttcttgtgctacttcaagagttattactataaacatcacatagttattactataaacatttatagttattactataaatgtcacataggacaattacctaaatccaattaattaaaagtctctggtatcaggagtgctaaaaggccctaacattattaactttgtttttctctaacctataaaaagcagtccaacagccaaagtagcatatctcattaaatcctcttgaaatagctaagaaaaagatggcaataatcctattttctaaccaaaattattaaacatagggatataatttgacatgtggaagcaagccaggagtagaatcaatacttatccttcggttttctggttagtgaaggatcaaataaatctgaaggacttcctcaaaatgaggtccacagaagaggatgctctgactagtctcctccacttcatgggaattcatgtgacatacctgactcagggaccaatgtgaatactgccgtctcttcttgtgcttaataaaaccctctcatcaatcaagtctccactaatgtcatctttttcgagggcccttcctaccctattttctgcatagcacttacaaccattaggagttacatcgactctttacacatttattgtaggcactgtcatgaagcagagactttctctcccatgtctaccatacttggaacattgcactgaccattcagtagacgctcaatacgtatttgttgaatgaatgactggatttcagaactacttatattctgagaaaggatgcaaccggggccatgataatatccatgaaacccagacacatcacaaaccaggtaaacaggcaatgttggaattttgcaaaacgatcatcatcttgggatttgaagatctggtagatttaaaaataaacaagactcgtatgaaactaaacacaatggtaaagtagtatttatagtatgtcattccatttctgttccctatactggcaaaaggtttatttttaaacctctctgaattggatcaggaatcatgtgatttttctgaattgtattttagagttccagcctctaggcatttaggttttaaagaacaatgcctagagaatcaaatgtgatttttctaagacctaatagcagaaaggaaacctaaataaaacctgaggctataaaaatactaactgacataaagaatgttactgtcaaattgctttaatatatatatatgcctacctcttctagtatttataggtccgccacgcatagccaaaactagcttcaaggtacacccttctgaaatgctgtggatagttaacacaaaaataaatcataatcatcaaaatgcattcagttaaatgtacacataattatgtgctggcttatcaggcagagtggccactctctaaaatataaaaagatatagcaatgtaaatacatataaaatgttaacatatttactggtacaaataataaaaaaggtgaaacaaattctcataagccataaagaaatccaagaataaacatactggaaaagacctctgtgattacgtgttttagcctgttcatttcacattaaggaaaaggaggcccagagaacaaaagtggcatgccggagacccaaagtgcagaaaatagcaaatctatttaataaaacagaaaatagaaaaataacaaggtctcctgactctcagtgctcttacagctattccacactgcctcttatccttttactcttttcttaacaaaagagtgatgaattatgtgaaagaggggagaaataagagagacaaagtgtcagaaagtacgttggtagtcactggtgcacacagcattgcttagtaacaaaaggagggcttaatgagaaaggaaagactttgggaagaacaattctctcttatccaaaactcttgtaaaaacagaaagaaaggaacatagccaggaaggaatggttcaatattcaaagaaaggagaaaagtaggcaagaagataataggaggatttcaaaaggcaggagataaacagcttgacatgaaaaatgaaaagggaaaataaatgtatcagaggataaaggttaaagtagtatacagtaccaaactaatgcatctaaagttcaggatgtataatgaaatctaggaatgtgaactattcaggagaaaaacagacatgatctaagagttcaaaagaaaaacattagcatatggagtcataatactaagtgcctacaaaacagccaatatgcaattacactcacttgtaatcattcaagcaataatcattttcaagttccatgttattccaaattaagtgttgtcgacagatgggaataccttaagggaaagttattaaaaaaaagtgttaaagaattcaatagcatctccaaaagagtatgatacaaatctatttcattaaggaactaagagcactaaaaaattaaacattcttctaaattgaatgctaggtgctaaaatttacagaatcataggtagaaggcatgcctaaaaggagatatagtccaatccattcactgtagaaaagaacagcatgttgcaataactctctggtcctaaaacaaggtataagatagggatccctttaaaaggcaagatatcatgctcctgcacagcaaaagaaactatcaacagagtaaagagatgatctacagaatgggagaacatattcacaaactatgcatctgacaaagatctaatatctacgatctgtaaagaacttaattcaacaaacaaagaacaaccccattaaaaaatgggcaaaggacatgcatgaacagacacttctcaaaaaaagacatatatgtggccaacaaatatatttaaaaagctcaacattactaatcattagacaaatgtaaatcaaaaccacaatgagatacaagctcacacctgtcagaatggctattaataaaaagtcaaaaaataactgatgttgtcaaggttgaggagaacagggaacgcatacactgctggtgggaatgcaaattagttcagccattgtggaaagcaatgtggagatttctcaaagagtttaaaacagaacgaccattgaacccaacaatcccactactgggtatatacccagagaaaaataaatcactctatcaaaaagacacatgcactagtatgttcatcacagtactattcacaatacaaaagagatgaaatcaatcaagatgcccctgcaacagtggactggacaaataaaatgtggtgcatatacaccacagaacaccatgcggccataaaaagaataaaatcatgtcctttgcagcaacatgaatgcagctggaggccatcatcctaagagaacaaatgcaggaacagaaaacccaaataacatgtgttctcacttataagcaggagctaaacactgagtatatatggagacaaagatgggaacaataaacactagggactacatggggagggaaggggatgtgggttgaaaaactacctatcgagtactatgctcacatcctgggtgacaggataattcatacaccaaacttcagcaacacacaatttacccacgtaacaaacctacccatgtatccactgaacctaaaagttgaaaaaacaaaaaaagatattgggctgggcacagtagctcatgcctgtaattccagcactttaggaggccgaggcaggtggatcacgaggtcaagagatcgagaccatcctggccaacatggtgaaaccccgtctctactaaaaatacaaaaattagccaggcatagtggcaggcgcctgtagtagcagctactctgtaggctgaggcaggagaatcacttgaacctgggaggcagaggttgcagtgagccgagattgcgccactgcactccagcctggcaacagagtgagactccatctcaaaaaaaaaaaaagatatcatgaatcaggcctgaagagtttagtatttgaggcctaaaatggaaatcaaaagcaagcaggagtagctattcttatatcagagaaaacagagtttaaagcaacaatattacaaaaaaagacaaagaaggtcattatataatgataaaaggatcaatccaacaagaagatattacaatcctaaatatatatgcacctaactcttgagctcccagattcataaaacaattgctatcaggaaaagagataaacaacaacacaataatagtgggggactttaacactccactgacagcactagacaggtcatcaagccagaaagtcaacaaagaaaaaatggacttaaactgcactctagaacaaatggacctaacagatatttacagaacattcaaccgaagaactgaaaaatatacattcgtctcatcagcacatgaaacattctccaagatagatcatatgagaagccacaaaaaagtctcaaaaatttttaaaaaatcaaaattctatcaagtatcccccccagaccacagtggaataaaattagaaatcaactccaaaagggaatcctcaaactatacaaatacatggaaattaaacaatctgctcctgaatgatttttgggttaacaatgaaatcaagatggagatttaaaaattcttccaaaggaatgataatagtaatacaagttatctaaacctctgggatacagcaaaagcagtgctaagaggaaagtttatagtgctgaatgcctacatcaaaaagtctgaaaggtcacaaactgacatcacagtttgatgtgtaacatcacacctcaaggaactaaagaaacaagaacaaaccaaacccacagctagcattagaaaagaaataacaaagatcagagcagaactaaattgaatggaaacaaaaaatactaaagatcaataaataaaagtttggttctttggaaatataaacaaaatccacaggccattagctatattaatcaagaaaagaaaacagaaaatgcaaataaactcactgagaaataaaaatggagacattacaacttacaccacagaaatacaaaagatcattcaagattactataaatacctttatgcacataaactagaaaatctagatgaaatggataaattcctagaaacatacaatcctcctaccttaagtcaggaagaaatagaaatcctgaacagaccagtaacaagcagtgagaatgaatcagtaatttttaaattgcaaacaacaaaaaaagcccagggccagatggattcacagacaaattctaccagacattcaatgaattggtactggccgggcgcagtggctcacgcctgtaatcccagcactttgggaggccgaggtgggtggatcacgaggtcaggagatcaagaccatcctggctaacacagtgaaaccccatctctactaaaaatacaaaaaattagctgggcgtggtggcacgcacctgtagccccagctacttgggaggctgaggcaggagaatggcttgaacccgggaggcggaggttgcagtgagctgagatcgcaccactgcactccagccttgacagagcaagactccgtttctaaaaagaaaagagaagagaagagaagagaagagaagaattggtaccaatcctactgaaactattccaaaagattgaaaaagagggaatcggccaggcaaggtggctcatgcttgtaatcccagcactttgggaggttgaggtgggcagatcacaaggtcaggagaccagcctggccaatatggtgaaaccctgtctctgagagctcaaagcttcagtgagctgtaatggtgccactgcactccaggctgggtaacaaagtgagaacctgtctcaaaaaaaaaaaaaaaaaaaaaaaagaaaagaaaaaagaaagaaagaaaagaaacaaaaactgtaatggaaaacttaaaagcaccagaatatcaaaacacagtaacaagaaaacgacaaaaatttgaaaagacgcttcaccaaaaaagatatacagataatgcaacagactgaatgtttgtattcccccacccaaattcatatgctgaagcctaaatacccaatataatggtatcagaggtaaggatgggggtctttggaggtaattaggtcatgagggtagggtcctcaagaatgggattagtgtccttagaagagagatgatctccctctctttatctaccgtgagaggatgtagaaagaaaatagctatctgcaaaccagaaagagtgccctcaccagaccctagacctgtggattagtaatcttggacttcccagctccagaaccgtgagaaataaacttctgttgtttaagacatccaatctatggtattctgtgacagcaacctgaacttttttttttttttttttgagacagggtctcatccattgcccaggctggagtgcaatggtgcaattttagctcactgcaatctccatgtcctgagctcaagcgatcctcccacctcagcctcctgagcagctgggactacaggcgcatgccaccacgcccagaaaaaatttttgtatttttagtagagacagggtttcgcaatgttgcccagactggtcttgaactcctggacttgagtgatccacctggctcagcctctcaacctgaacttattaagacagatgacaagcaaattaaaagatgcataacatcatcagtcattaggaaaatgtaaattaaaaccacagtgaaatatttccagttcgaattataatagcaaaaatgaaacaaaaagtaaaactaaaagaacccagacaatattattaagtgctgataaggatacagagcaactagaacttttatgtattactcatacaaacacaaaatggtaacaaccactctggaaaataatttagcagttttataaagttaactatatacttcctatgcaattcagcaattccactcttaagtatttacccaagtgaaataaaaacctatgcttccataaaaatgtgtatgtgaaagtttatatggctttatttgtaatcaccaaaaactaaaaaccacccagatgtccctcaacttgggaatgagtaactatggtacttccttataatggaacattactcggccataaacagaatgaactactgatacatataacaatatgataagtctcaaacatattatgcataagtgaaaaaaaccagacttaagagactataaagtatatgatttcatttatataaaattctaaaaaaggcaaaattacaggaacagaaacagatcagtgggtatgataggggcttggaatagaggaagggattgaccacaaaaggtacaggagaattctgataggtgatggaactgttctatatcttgattgtggtggtgactgtatgatagtaaatgtctgccaacaccaacagaacgatatacttgttatgatatactgtgtcccttcaaaattcttaggtggaagtctaagcctcttatacctcagaatgtgaccttaacttgaagacagaatcttgacatatgtattcaagttaaagtgagctaactagggagggccctcatccaatatgactggtatccatataaaaaggagaaatttggaggcagatacacacagacacaaggagattatcacatgagaagaccagggtgatgccttgaataagccaatgaactagaaagattgaaagcaaacccccaggagctgggtgaaaggcatgtgacagattctacagccctcagaaggacctgacactgtcaccaactaaatcttgtattttcagcctccaaaatcgtgtaactttctgttaagtcacccagtttgtgatactttgctatgacagccctagcaaactaatacaatatgtgaattgtatgatatgtaaattatatcttcctaaaaaatagtttgttagaatttggagacaaataaaaacatgctcagtattattagttagcaaattaagaatgtgtataaactaaaaaaaatgatcgaagctgtctaatcgtatatattgctgtgattacaaagcccttaaagaactattataattttttaaacaaaaaaatatttttagcaaaacaaatacttggaatttaataacactgacattcaacttaccaaaaacttgtaggatatagctaacacagttattggaattttaaaataaacggttatgtttttaagaagttgagactcctagtttcagctctgatatatggagaacttttaattcaccactccttacaagaaaaaaagctgaacaaaccgaaaaccaacaacttttctttgtgccatcagagaaattaggtagtaaggtaaatcaccataagaaaatctgttgagataggcaaacccagagagtcagagccaagatccatttacgtgaagctgaagcctctaaagtcataaactggaaggaacacttgaatggtaattttgatgaattcatagaggctgagtgtggactagtatgagactgggaaattattgagggccagaaaccaggcccctctagcctccctacctcacctaaactactagaagttgaaggaggggagaagctaagatacactttgaaggtcccagcctagaggcacaggcccactgcaagatttaatcataagattacagaatgttccccctcttcccaatacctcaccaccacactaacaaggctccagtataacaacagtggattacaacggaaagaattgtaagacgcaaactctaaggaggagtctttagggaaactcaaaggcaacaggggagacaaaacaagaaaaaactagaggaatttgaaggctctggcacttataactacagcaaacattaaacacagcccaatttctagcaagttgaagataaaacctcactctaatgtcctatttacctcaattcctattacctgatatgttatgtctggttttcaactaaaaattacaaagcatgctaaaagacatgaaaaaatatggtatgaaaagacaaaactagcatcagaaatagactcaggtatgtcagagatcttgaaattatcagacagggaaattaaaacagctaagattaatatgctaagaaatctaatggaaaagtatacaacatgaaataacagattgataatacaagcagagatggaaactttaagaataaaaagtagatgttaaaaataaaagctccaacagaaataaagaatgcctttgattggtcatctgcagactggatctggaaaagaattgggaagtttgaaaaatggcaacagaggccgggcgcggtggctcacgcctggaatcccagcactttgggaggccgagacaggcggatcccgaggtcaggagatcgagaccatcctgactaacacggtgaaaccccgtctctactaaaatacaaaaaattagccgggtgtgtagtcccacctactcgggaggctgaggcaggagaatggcgtgaacccaggaggcagagcttgcagtgagccaagatcacaccactgcacttcagcatgggcgacagagcgagacgcatctcaaaaaaaaaaaaaaaaaagaaaaatggcaacagaaacttcctaggcaaggcacagtggtatgcacttgtagtcccagctacttgaaaggctgaggcacaaggattatttgagtccaggaggtcgagtccagcctggccaacatagtgaaatcccatctcaaaataaataaataaataaaagaaacaaagaaaagaaaataaacttggcaaaacggactgttaagagaaaaaagaatgcacaaaaacaacatctattaactgtgggacaatttcaaaagttgtggcaatttcaaaaggtgccactagaatatcagaagaaaaaatgagacagaagaaatacttaaataatggcccagattttccaaaattaatgaaacataccaaaccacagatccaagaagctcagagaataccaaacacgataactaccaaagaatctacaccttcaacatattatatcaaactgtagaaaagcaaagacaaagacaaaattcttaaatcagccaggaaagggaaaaaaacaccttacctaaagagaagcaaagataattactacaggggagttttcatcagaaatcatgcaaataagaaaagactagagtgaaatatttagtgttgaaagaaaaaaaataccaacttagaattctataccctgaaatattatccttcagaaatgaaggagaaatactttttcagacaaacaagaaacgttaaaagatggcttttttgcaagaaacgttaaaagacattattcacagaaaaaatgatgtaggtcagaaactaagatctacataaagaaagcaagaggtggaatttgttgccagtggacccatattgcaagaaatgttaaaagacattcttcacaaaaaacaggatgtaggtcagaaactcagatctacataaacaaaggaagagggctgggcctggtggctcaggtctgtaatcccagctctttggaaggctgaggcaggaggatcactctgctaagcacttcacctttaactcatttaatcctgagaacaaccctttgagataaatactattattcttcctatcttagactgagacaactaagatacagagagattaagtaatttgggcagccagtaatctgaagccaggcagcatggcttcggcactccagtccctttttcaaggcccattgtaaatccctgagcaggccctgctcctcccttgctgcagcctccttgttcctaatgcagcacactccttcagtcctttctccactagcccctccatcctccccactctccccaccaggctctagttctcaactcaccaaaaacttcccctaaagaaaaagcagtctggcagagtaatcattttcccagcaggacgaacccaagcagcctcatctctgccctccgtattccatatccctctaacttggagaatctgactcacaccatgtgaccccaaatgtcttccaggatataaatataaagatcacccagaaagggcttaaaatgtgtttttcagctgggttaggtggctcacgcctgtaatcccagcactttgggaggccgaggcaggtggatcacctgaggtcaggagttcgagaccagcctggccaacatggtgaaaccccatctctactaaaagtgcaaaatcagtcaggcatggtggcgcatgcctgtaatcccagctactcgggaggctgaggcaggagaatcgcttgaacccaggaggcggaggttgtggtgagcagagattgcgccattctccagcctgcgcaacaggtgcaaaactccgtctcgaagaaaaaaaaaaaaaaaaagatactatgttctctctctgccatgtgaaaatgcagtgaacaagcctagaggacagcccccaccagaacctgcccatgctggtaccctgatattcagccttcagacagtgagaaataaatttctgttgtttaagccaccggtctgtggtattttgttatgacagctccagcagactaagatagtaggtattttacatattaccttatttaatttcctaatatctgtatttgttcataaacatttaaacttagattcaattgtctaataaccaaaaagccactgcttttgtccccacaatgtctcctcctacagagacaaggactctataacttggctctggttctgactcatggaaactaaatatttcccttggatgagttattaatctcctctaaacccaagttgactcttctgacataaaaagattgaaacaggattctctctaaagtgcttttgctgcatacaaattatttaaaattcatgaaagagataaaaagtacagagattatttacaacgcaagatttcaccttcatgctccaaaaaaggtatcctttaaactatgatataaattgcaaagcagaacgaagtcaaaataaactatcatgactctagatctcaccaaatcatttagggcagacaaaagcttcaagagtcattactgaatgtgctgatgtggtcactggactcggccagccactcacttcagtaggatctcctgggtctagagaaatagcaaatattcaggagctcatatatatccttggcctcacaaaaatgaaaaattctaaccctcctcatccttctataattctgaacttaaaccagctggagggcaaccctagtcactacctttatattacaagcaagttccagctggttccatcaacaaagatccatttactgttatatggaacaatttaattttctactaaaaactggatttttaacaactataaatggcaaacattacttattgcagaaatctgcaaaatgcaaagactaattttaataaaaattagtctttttaggcactttctgcaaatatacaaaccacaaaagagacattacacattattcagcacccctgctatactaagggaactttgaatatacgtaaatgtaagccaaagactcttttcggaaaacctccacattaaaaaaaaaaaaaaggagggtggttgcaaagcagtgtaaaaagggaaataaggtccctagaagggaatataattactatttcccattaaaagtaaaatataaagtaacattaaaagtaactataaaatagttaaggcataatttgcaggtcaccataacctgctgaaagctattctaaaatattatttcacaccatagcatgatgccagggatttgtttccaaagaatctggtgaacacagcaatggggataaaatagttcataagctgataaatgttggagagagggagtaggagggggttcattatcttattctaacatcatatatgtttgaaattgtctccattaaaatactttaaaaactactagacattattgatgaacaaatttaattttcatatcctaaaaacaaagaaagatgagtaccttccaatcttcgaatttttgctttcacagaaataacagtttcaaaaggtgaaactctcagctcaaaacatgttccagttaatgtttcaatgaagagctccatggtatcacagaaatgaagtctgtagtaaaatggtcccatgttatcatcattgaagaatggaggctcttttctgttatccattactttgacttttctagttcttctaaaatatgtcgcaggcaactgtattccagttctaggcaaaccaggtttgaagattggtaatatatattgttgttcatgttttgagttttgtacctaaaaaaacaagaatttttttaacaagcctatctgaaagttgtatttgtccataaagattttccgttaactgtggcccatatcaatcttccagacggccccagaattcactttagtgcttttaattatgtctaatcctgaacttttcacatttgtctctgaaatcactctcccatctagaccataagattattaagaatacgcatatttttgatattataatgtatcttactagagctcagcacagttatatatatagtacatgctcaacaaatacttttgttgttaagtgatatataagccaaactcaacaaacacatcagtatatttctgtaaggctttgaaaaatttattcatatccttttctaaaacatacaaattatgtcttctataccatataaagcataactttacaacgattgtacatttgactttttttttttttttgacagagtctcgctctgtcgccaggctggagtgcagtggcacaatctcggctcactgcaacctccgcctcccgggttcaagcaattctcctgcctcagcctcccaagaagctgggattacaggcacccaccaccatgcccagcagatttttgtatttttagtagagacggggtttcaccacgttggccaggatggtctcgatctcttcaccttgtgatccacccgcctcggcctcccaaagtgctgggattacaggcgtgagccaccatgcctactcctgttgtatatttgaatcatactggataaaaggaatgccaaccaccataataggttgcttaaaaatagtactcactaggctgggggctgtggctcatgcctgtaatcccagcactttgggaggccgagatggcagatcatgatgaggtcaggagatcgagaccatcctggctaacatggtgagacccaatctctactaaaaatacaagaaaaaaatgagctgggcgtggcggtgtctgcctgtagtcccagctacttgggaggctgaggcaggagaatggcgtgaacccgggaggcagagcttgcggtgagccgagattgcgccacaacaccccagcctgggcaacagagcaagactctggtctcaaaaacaaaaaaaagtagtactcactaaatcatcaacggtttccagaggatattatagcattcagatgacattagaattggtaataagtattagacaatctctgctcacatacatacaatggctaataagtatgagtggtaagcccaacaaatagaagtagtaaactaaatgacaagtatagaactaggagcacaaaaatgatcaaattgctattgctattaatcgtgaaaactctatacaggggggccttgaacttaaactaggacaaatgatacacatctttctggtgaggtggttaaacctttttaaaaatagctttattgagggccaggcacagtggctcacacctgtaatcccagcacgttgggaggccgaggtgggcggatcacctgaggtcaggagttcgagaccagcctggccaaaatggcgaaaccccatctctaccaaaaaatacaaaaattagccaggaatggtggcgcacacctgtagtcccagctactcgggaggctgaggcaggagaaccgcttgagtccaggaggcagaggttgcagtgagccaagattgcaccactgcactccaacctgggtgacagagcaagactccatcattaaataagaaaaaaaaagctttattgaaatataattcacatgccataaaattcactcatttaaagcctaaaattcactggtttttatgatgtacacagagttgtgcaacaatcaccacatttgctttagaaaattttcattacctctaaaaggaaccccataccctgtaaccaacactcccaaattcccccagtcccccactcaaccctaggcaaccactaatctactttctatctccaaattggtctattctggacatttcacataaatagaatcatatatgatttttttgtgactggcttctttcacttagcataatgttttcaaagttcatcatgttctaggatatatcagtatttcactcctttttattgctgaataatagtcccctgtagcaatatatctcatgttgtttatccatccatcagttgatgagcatttgagtcgtttccaattttgggctgttacatatagtgctaagatgaacattcaactgcaagtttttgtgtaaacatatgttttcctttctctttgaagtagctttgctagataatgtggtaactcttatgtttggcaatttgtggaactaccaaactgttttctaaatggtatggatcattttatagtcccatcaacaatgaatgagggtgccaatttctccacacccttgacaatacttgtttctgtccttttgattaaagctatcctagtgggtgtgaagtagtatctcactgtggttgacttccatttctttaaaaactaatgatattgtgcatcttttttatgtgattattggccatttgcatacattctttggagaaatgcctattcatatactttgtctattttttaattggattttttattgagttgtatgagtttttatattacatattctagataaaaacacttaacagatatatgaatggtaaatattttctctcattttgtgggttgtcttttgatagtatcttttgaaacacaaaggtttttaattttgttaaactctaatttggctatttttcttttatcatacttaaaaagcttggcttaacccaaggtaataaagattgacttatatatgtttctaaaaattgtagttttagctcttatgtttaggtgtactgtccaatttcaatttagttttgtgtatggtgtgaggtagagtctaactttattcttttgcatgtggataaccagttgttccagtatcatttgtcagaattaccattcattcccaattgaattgtcttggatccttgttaaaaaccaatttactgtaaatgtgaaggtttatttccagactctttattctgttgatctacctatgccagtaccaccacatcttaattaatgtagctttgtagtaagttctgaaatcaggaagtgtgaggcctccaatttgttctttttagattgttggctattctggactccttgaattgccatatgaattttaagtatgcccattttgcaaaaatgtcagctgggattttgacagggattgtattaagtctgtagatttggagagtactgcaatcttaatactaagtcttctaatccataaatacatactatttttcagtttatatctaatttatttcaatgttttataatttttaaagcacaagttttgttctcttttattaaatttattcctaagtattttattcctttaaatgctattacaaatggaatcactgtcttatttacagattgctcattgctggtttatagaaacacaaccgattttaatatcttgatcctgtacactgcaactgtgctgaactgtttatttcgttcatttagttatttaaatcttcctaaacgctctctataaaagctctatatacaagatcatgtcatttacaaatagagttttacttctccctttctaatctatatgctcttttctttctttttttttttttttttttttttggagggggtgaaagtcccactctgttgcccgggctgaagtgaaatggcacgatctccgcttattgtaacctccgcctcccgagttcaagcgattcgcctgtctcagcttcccaaatagctgggattacaggcacctgccaccacaccaggcaaatttttgtatttttagtagagacaaggttttaccaagttggccaggctggtctcgaactgctgacctcaggtgacccacccaccctggcctcccaaagagctgggattacaggcctgagccactgcactgggcttatttccctttcttgcctaattgccctgctctggaaccttcagtacaagattgaataaaagtggtgagactggacatccttgtctaattcttgattgtagaaggaaaccattgagtctttaggtataatgttaaccgtggggttttcatagattaccaatataaggttgacgagcttcccttctattcctgctttaggtgggttttctttttaatcatgaaggggtgccaattttatcaaacgcttttttcattgtctattgaaataatcatttggttttctttacttttttattcacatattacattactttttatgtgtcaaatcaatcttgcattactggggtaaatcccatttgtacctggtatgtaatcctttacatatgttgatggatttgatctgaaaatatttcctcaggatttctgtgtctataatcacaagagatgatgatctgtagttttcattatgtctgtcaggatttggtatcagggtaatattggccttagccaaactaagcttcgtaagtgaaggagaaataaaatcctttacagacaagcaaatgctgagagattttgtcaccaccaggcctgccttacaagagctcctgaaggaaacactaaacatggaaaggaacaaccggtaccagccactgcaaaaacatgccaaatggtaaagaccattgatgctgtgaagaaactgcaacaattaatgggcaaaataaccagctaacatcataaagacaggatcaaattcacacataacaatattagccttacatgtgagtgggctaaatgccccaattaaaagacattttaatgtctggcaaattcttctcagcaccacatcgcacttattccaaagttgaccacatagctggaagtaaagcactccttagcaaatgtaaaacaacagaaatcacaacaaactgtctctcagaccacagtgcaatcaaattataactcaggattaagaaactcactcaaaactgcacaactacatggaaactgaacaacctgctcctgaatgactactgggtaaataacgaaatgaaggcagaaataaagatgttctttgaaaccaatgagaacaaagacacaacgcaccagaatctctgggacacatttaaagcagtgtgtacagggaaatttatagcactaaatgcccacaagagaaagcaggaaagatctaaaattgacaccctaaaatcacaattaaaagaactagagaagcaagagcaaacaaattcaaaagctagcaggaggcaagaaataactaagatcagagcagaactgaaggaaatagagacacaaaaatcccttcaaaaaatcaatgaatctgagagctggttttttgaaaagatcaacaaaattgatagattgttagtaagactaaagaatcaaatagatgcaataaaaaaagataaaggggatatcaccagcgatcccacagaaatacaaactaccatcagagaataccataaacacctctacacaaataaactggaaaatctagaagaaattgataaattcctggacacatataccttcccaggactaaaccaggaagaagtggaatctctgaagaaaccaataacaggctctgaaattgaggcaataattaatagcctaccaacaaaaaaagtccaggtccagatggattcacagccaaattctaccaggggtacaaagaggagctggtaccattccttctgaaactattccaatcaatagaaaaagagggaatcctccctaactcattttatgaggccagcatcatcctgataccaaagcctggcagacacacaacaaaaaaagagaattttagaccagtatccctgatgaacatctatgcgaaaatcctcaataaaatactggcacaccgaatccagcagcacatcaaaaagcttatccactatgatcaagtcggcctcatccctgggatgcaaggctggttcaatacaggcaaatcaataaatataatccatcacataaacagagccaatgacaaaaaccacatgattatcttaatagatgcagaaaaggcctttgacaaaatccaacagctcttcatgctaaaaactcttaataaactaggtattgatggaacgtatctcaaaataataagagctatttatgacaaactcacagccaatatcatagtgaatgggcaaaaactggaagcattccctttgaaaaccggcacaagacagggatgccctctctcaccactcctatttaacacagtgttggaagttctggccagagcaatcagacaggagacagaaataaaggatattcaattaggaaaagaggaagtcaaattgtccctgtttgcagatgacatgattatacatttagaaaaccccatcgtcccaacccaaaatctccttaagctgataaacaacttaagcaaagtctcagggtacaaaatcaatgtgcaaaaatcacaactatctgattttttttttttttttttgagacggagtttcacttttgttgcccaggctggagtgcaatggtgtgatcttggctcaccacaacctccgcctcccagattcaagtgattctcctgcctcagcctccctagtagctgggattacaggcatgtgccaccacgcccggctaatttttttgcatttttagtagagatttctcccaacaggggtttctccatgttcgtcaggctggtctcaaactctcaacctcaggtgatccgcctgcctcggcctcccaaagtgctgggattacaggcgtaagccactgtgcccagcctacaaccatctttgacaaacctgacaaaaacaagacgtagggaaatgattccctatttaataaatggtgctgggaaaactggctagccatatgtagaaagctgaaactggatcccttccttacaccttatacaaaaattaattcaagatggattaaagacttaaatgttagacctgaaaccataaaaaccctagaagaaaacctaggcaataccattcaggacataggcatgagcacggacttcatgactaaaacaccaaaagcaatggcaacaaaagccaaaatagacaaatgggatctaattaaactaaagagcttctgcacagcaaaagaaactaccatcagagtgaacaggcaacctacagaatgggaaaaaaattttgcaatctacccatctgacagagggctaatatccagaatctacaaagaacttagacaaattttcaagaaaaaaacaaccgcatcaaaaagtgggcaaaggatatgaacagacagttctcaaaagaagatatttatgcagccaacagacacatgaaaaaacactcatcatcactggtcatcagaaaaatgcaaatcaaaaccacagtgagataccatctcacaccagttagaatggcgatcattagaaagttaggaaacaacagatgctggagaggatgtgtagaaataggaacacttttacactgttggtgggactgtaaattagttcaaccgttgtggaaaacagtgtggcaattcctcaaggatctagaactagaaataccatttgacccagcgatcccattactgggtatatacccaaaggattataaatcatgccactataaagacacatgcacacgtatgtttactgtggcacaattcacaacagcaaagacttggaaccaacccaaatgtccatcagtgatagagtggattaagaatatgtggcacatatacaccatggaatactatgcagccataaaaaaaggatgagttcatgtcctttgcatggacatggatgaagctggaaaccatcattctcagcaaactgtcacaaggacagaaaaccaaacaccgccatgttctcactcatagatgggaactcaacaatgagaacacttggacacagggaggggaacatcacacactggggcctgtcgtggggagtgagatggggggagggatagcattaagagaaatacgcaatataaatgacgagttagtcggtgcagaaaaccaacatggcacatgtatagctatgtaccaaacctgcacgttgtgcacatgtaccctagaacttaaaaaaaaaaaaaaaatcaattcccaaagcatttctctcatttcttctgaaaagtttctaaaaacacaactccaaggatgaaatggaagttaaaggtaaacaggcaatagcgctgaatacgtaatttcagtaactcagaattttctccaacctctgctctaaagaagcttagctacagaagagcagttacctttgaaacattttccccaacataaagatatccggaatgtgaagctgccattaaaactgtgacacagatctacatttactgatacatcaaaacatccctaaagttcgaaatacgagctacagaatcacatcaaccgcctaacttgtctgtagcctaaactctagtccggagttcatctgcaagcggaattgggaagtatttcagagccagcatctcctcgcgccatccaggtacctacacacttgaggccaccgagtcacctgcgcagccgttgctcctccaagaccaatccgggctccccagacccaccggcctgaatctggaggacagcagtccgcgtgacaacagcgactcggagatcagcacccgtcgggaaagccgcgtacccgttgaagctggcgtcacgcccaaaggaacaaacgccagagcgtgtgtcctgggcaaaggcggcccgccgctccggtccccgggcagcagcggccggcgtcaggccgcaaggcgaggggcggggacaggactctacccggcagcccagcgccgagcgcccgcgccactccggccttgcgccattccggccccacgacggccggcggcggcagcgcggctgggctcagcggctcgcagcccgggcgccccccctgccggccgctcgctagctcagcctcacccgcagtcttgtccgctggctcgctcgcccgcctacaggtcgacagggcccaacgacccggcgagcaacttcacggaaggcactggccgacaacgctccgctgccgccgcgccccgcccctttgt

SEQ ID NO: 2122 - DNA, 57214 bp, Homo sapiens; identical to SEQ ID NO: 2121

SEQ ID NO: 2123 - DNA, 71945 bp, Homo sapiens
accggggccagggaccagtggtgggaggaggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtgagcgcgggcggggcacgggtggagcgcgggctgaggtgcgtccgggacccggtttggacggcagaggcctgggcgggggcgccgagggcccgtcggggcggcccggacaggactgggggtgtccaggaccctgtcagggagggcagaactgcggtggggcgtgccctgggctcccagtggccggtgggtaccctggtgggcaagcgtccaggacccctcgcggcggccgcgacccctgtcggaaacggagacttcccgcgtgccgcctgcaaggcgtcttccctgggaggagaaggcccaaggtttcccctccacttcaagatctgggctccgaggctccggagcccccttcactgggccgcgtttcttgtgccacctcttccttaggctccttctgcaggtcgcacagggagggagaggcagatgagtcatgctcacagaactctgagggcacctcggagcagccagctgtgagccgtggggaagggtgcacgtcagcgggtccagaggcctgagttctgtccagacatgaccaccagctcactctaccgtctgtctgggcctcagtttccccagctgaaaatggagggttggcttcagtctggtccatgagtcatgggtgagcccaggcccatctggtggctcagacggcacctgggcagcttacattctcaggacagtccccagaggaaattaaagggaaggaacagaacccaggccaggagaggcttttcctaaatggaggggctgcactccctcccagcagaatgtacaccagggaacacttccacgctaggtgtgaggacgcgagggagccctcagcatttggaagctagttcctaatgctgatctggacctgaattccagccccacgactcttttccatgagcatgggcaggtcgcagttctcactgagcctttaatgaagtgcctaatccagtacctggcacagaggaagcgctccgtaaatgactggtaatagtcccagacatactgcaggtgcgcagggaatatcagttcccttccaccccaccccagctcctaactggaccaaaaagatttagactttaccaagctgccttctcaccatttagtttattatttgatcaaaccttgtgaaattgctcataatggacaaatacaaccggcaagttcatgtttcaactgattactcttggataaaatttgtgttttaggtgtgcagagcctaaagtaagtaaaaactactctttttctggattccaagctctccatgggctcgattcctatccaggagcccataccctcgctgtagcacgacatggccctcagccaagttcactagcatcctggcttgagctcccttcaagaagagttaggtgttgagtacaagagcaaccttcagttgcttagttgccccagtcggggaactgaccctgaggactgcggtgccctggagttaatgtgtcgtccatttagggtgatggcaccctctgccatttctgacgcaccttcatttacttccattatttcatggattccccacacctgggggagaaggacagggtacaggctacttcccctttgtaagtgcttcctcctccccattctcctccacacatcataaggttctagaagcacaggccattggtgtgctcacactgcacagcacgggcaccccgtgtgtgctttcctcctgcaggggacatgataacgtggccatagcgggctcttcggacaaagagtgaaggcactgttttgtccactatctccctctctcggtctgtcttcccctaccctgagaagtcattcaaatgacattataattaaacacctcagccggaatcccaggggcaaatttcaggagagatttgcatgtcacatttccattgggttgagagggctataagtcaggggtggggcggggggtggttgggggtgggggctaccgcagggtggggaaccagctaaggctgaaagtttccttgaaaaaatcagcttttgagaaagttcctgttgatgcaaagttactcaacactttctcttgcccagcccagaactacttcctcattctcccagcttggtatctgtaaagacaatcatcctttttgggtaaaggtaaaagagaaaccctagaggaagtacttgctgagaagacaaggttatcccattttacagggaaaagtgttaaaatctgtattgttaacagtagtaacgataacaataacaataaaggtatttccacacaatttaatcatttccaagttattggcaggtcaacacccccctcctccagggcatagttcagtcaaataatggacaggactgattttttccttgataaagtgagtcacaggtcccttgttattctcatcagagttccgcatagtgattcagtcaggactgggaatcaagtccttcgcaggtgggattatcctataaacggttgtgtcttccttggctcctcactgtctgctggagaaagccgggatcctacacagaatggccctgtttccagaggctaacccaagtctaggcaaatttaacaagttgatttatttctttaactctgtaaatttaaagtaattcagatcggatacgataactgtaacagatctgaagatttctgagaaatcttagttggcccatttcattctgtgctggtacttttaagaaagctaagggcaatagcgtggtgtttaatatatgatacttgaatatgttcaacaagtgtagaaaagtgttataatgattcatgcttcttaagtcagtgagtattcttacattcatgaaaaattaattctagaatacctccttcttgtgaatgggaatatattagtggagcataaatatttctttggtatgaccctcaatccgtctctcatctcccagtctccccctctgagccatcttttccctacattctgccccctcttctgcctcctcttccttcccctgctcccagttccctaaatgccccccgtttctgctctctaccctacaactctcccttcttttttgctctgaattttcctctacactctgtcttccagccacctctcagaggccccttctctgctccctcaatctccggctctctgtcccacattttcccccttctctgccccttggtctccctatccactaccccaatccctctctccgtcccttgttttcctcagctcttccccatagcctccccctctctcatcccgagtctctgttttgtctggcccccaatcttcctctctgctctacagcttcctcctcccacagcccctcattagtccccctccaagatgggtagtctgggggtggggcacacatccttgcttccgcagagagatccgtctccctgtcccagcaacagcagagatctgatgaaagacagatgaaaactttcctaaaatgctgatagaaagctcacatgaaaactgaccaactgactctttgccgaaatattcaaaagctttaaaactacatatccaataaaaagttaaaagcaacaagcaaaatcagcaaagtggccccttgtgaaatgaggccggtgagttgcaggtttcccttgtttctctccagcatctgcaccaccacgccacccacttctgtccccagaaactgtgtccagccttcctcctcccacgtgtgaatcccccggggaccctgccctcccagttccccacatctgaaatgtgctacccatgcccatcctcctactcatctgccctctgaaatctgatcagcccctaaaagctgcctgaaataccctcttatgaagcttttccctgtccttccatgccactccacattgcccctttacactccatccagggtacaaaccagggctcaaagctgggccttctagcttccggttcagggcttttctcaagatgtggccttggggaactgtgggaggaacctgggcttggccatcacacaggtgtaggttctgatcttgaggccaccattgctctctgagcctcagtttctatctgtaaagcaggataatcactcgctcggccattcccaggcccagtgcttcctgagggcctgttggggggtgtccactgttgatagtgcccaccataattcagtgtgtcacctgagaatttaatgtgtcacagcaaatagacaaatatagcatcagcccagtgtacttggcccagagaggagggaggaaggtggccattgtagttccacaaaccttccgaagatattttgcagtttgacacatgtgaccctggtattttcctggaaggaggcctttatctgtcattcttccattagtggcccctgggatgttagaaccacagccatcaagctttgtcttttactccctgagttgggtcaaggctggagccctctgccccttgttcacctcttatcatattcaggcttgaagccagcaccaggaaagtggctgggctggccatagaccagccagactgcaggcctggccccctcctgctgtggaagtccctgtcagatggcagatggagtccttgtaaatctgcctagtgatttcaccccaagtgaaactcaggggctctccaccaggtgcctgcaggtgtaggtagggcagggggccaggagtgtcccagtcccctgtgactgcaccacaggtgtgctggagggtcaccccactgtccactccctcagagaagctgctcagtctcttcgtgtgggtcgtcacccccaggtagacatcgggccctccctgtgggacctgcccagtcctggaatgcctcctcagcccatctccctcccctcttagtccaaggtactgggagcctccctcccatgagagtgtccctgttagctcctcccaccccaccccagctttcctgtcatctatcccctggggacaccttcctccctctccagcccctcagagccataggaaagctacttcccctgcagcagccacactcagaccaggcccgggcctctggtggccgcccctcagtcctcaccgcacacagacttgctctgcctgccccaccagcattcagaatgcctcccactctccctctgtcctcacagccctgtctccagcctttcaggagttccttctgggctttgagtgaaggagtttgaggtcacaggttcagtttcctcctcccatgtgtgctccagttactcggattggcacatgtagtcacgaagtggccgtgacgcaggggcccatgctagctcacaggcggtgtggggcctggtgccctgcaaccccctggattcaggaaggggcactggtggttctgatgcacacaaccggtggcctgtgcctctggagaaaggaggccacccaggatggtgtcatttcattttctcaatggtcctgcaagtgaggggtatctcctttgggtagatgaagaaacagcttcagagaatgaagcaatgtgcccaggccatccagctacttgcctgaagctgggatgtgaattcagagctccagaccccagggcccaccgagccttctacccctcactgccctctccccactcctcggtgggatcaggaatctctgtcttggctcacaacctgcagctaaggcctctgtaaatccctgtggcatgcagggcctggcgtggggcaggcccgacgcgtatccagtcctgggccactcagcccccactctgctcctccagatgggcccgagcccctgagatgctgagactcctgtcccatcagaacctgcccaccctgtccatgatgggcgaggccttgtgtgtggccctgctctcctgaggacaagctgtggcaggaaggctttctcagaggtggcagatgaggctgatactctccctgcaggaggggcattgtcgtggggccgaggctggtccacatgtggctggacccaagacatgtcatcccaccacatgggcctggctcctctgtcatcagaaactgttcctagggcctctggcctagactacagagcacagggaggaagcttccgctttctgaccacaagcgtctggcctcagcgtcagccaccccaaactgctcacggtattcagagccaggaggtttgtggaaaacactcaagttcccattcctcttaggaagccctccaggggtcctcctggcagcttggaggcagggcatggaatggggatgcctgcgctcgcacaaaggatgatacccctcgccccttccactttgccatcatgctgagaactctaggttctgccgccagggataaagttcaagggttgatgaatctggcttagaaagtgccttgcaggggccaggcacagtggctcatgcctgtaatcccagcactttgggagaccgaggcaggtggatcacttgaggtcaggagtttgagaccagcctggccaacatggtgaaaccctgtctctactgaaaatacaaaacttaaccagatgtggtggcaggtgcctgtagtcccagctacttgggagactgaggcaggagaatcacttgaaccctggaagtggaggttgcagtgagccgagatcgagccactgcactccagcctgagcaacacagtgagactccacctcaaaataaaaaagaacatgccttggagggcatcgagtccggggctttccaaacctgctggtcatcagaatgcgtgatgcaatgcctgagcctctcatcccaacttcctgtctgccatccattgctgcagagacaaaagccctccagaagctatggctgttgcctcagagccgcctgtgtcctggaagcaggagcctggcagggagggggccaagcagccttgtcccagaggcctgggcagctgcgctgtacacagcctggggtggtgccttctagctgcaaggctagcctcaccctgccaccagtaatgccacaggtgcagcagagctgcttggtctcactgttctctgggcatcaccatgcagctgtgaactgcaaatgtcccaggacgactcgaatccatgcaagctccctgtatctaagcctcaccattttcactcacttattatccccactgaaaactggaaagagaggaagtggctatgatggaaagacctggggtgtgactccagctctgctggcaagtggcagaggtgggagtcactgagcctcgctgtcttcatctgtggaaggggtggtaactcccctgcactcccagagtcattgtggggatccactgtcagcaagcccatctccagttgtaaaggtctcccacaaggctatcccatgtgggggcagctgcggaccctcactgggcacagcctcgcaggtgcaggcatgagcctgggcatctccccatcctccagcctgagctaagtgcagtcagcaggcgttgccctctgagcagcacagcaccatcctggctcactggattctctctcctcaagggcagggcccaggatttgtccatttctttcacctgcctgggtcgtagcactgagccttgtcaggggcaggccttcagtgaatgtcttgggtaaatgaattcaggagttcatttaaggtgttcatgaagaatcttggctccatgaactgtagtggaggcaaaactccacctcttcccatttcagctaggtctgagaatcggcataagacagattcatgggcgaaagcctacagatttctttaatacaagttgtacgtggcatgggagccctcttaaaaagatgaagaccccaagaagcagttagagtcaatcccccttagatactgcattgaatgaatcatcgtgagatgtgataaggccaaggggcttgggctagggcaggtaactgggcagggaagtgactcgggaggtaagcgttcattgtacaagatctgtttgtatggatttcctttggcttcaacttcccaaccttgatgaaaagagtgttactttccttttggtatagtgaggacatctttcataggggactttcatctcctgcttctaagaaacagcacgaatgtcagagtatcttgcacctgctgtttttttaagtgcttttcattcaacgtagtccctgtgccacagcagcataccttggggtgacaaattcttaacacctccagaacaaaggctcaggagaccacgcatggcctgattgcctgttctccttcccaggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcggtgagcagctcaggccccttctgccccgggcttcccaagaaccgaaagttcttcctgtcctcaaagcactgtagtcataggaggaatgacactgctgtgcaggggcgggaagtgggagggctctgccctgtgcctcgacacacctgcaggaggcatgactttccttgggattcttacaagcccctgagggtggagcgggtggccccaggcctcactgtcgtcatgtcctcactctgcgctacagttctacaggggagggttgtgcccctctttttgtcagtgggtaactagggtccatacaggcagatacctatgggacatgcccctggatgggcacttctctagttgccagggtgtggcatcactttctagttcatagcctgccctccgtgagatcacagtagggctcaggcaagctcagggtgccccatgtgggcctagggagggaaggggtggacaaggagcaccccaagtgccagctctgaggagccatggacaagcctgcaaatcacagttaccagttcttcaacccgaagtctcacctttcgctgaaagaaagaagaacctcaaatctgttccccttactaagatgcccagatgtgcagaccccagttaggaggccattctttgttagggacacacagctgacctggtacagagcatcagagacggacgcaggcgtcaaggtcagccaaggctccctgaatgaaccaccttgcatacccagcctcctagtgtgcctggcaaaatcctacctcacttcgagtcataacccttcagcttgctctcagtttaaacctggaaagataagccttcaaaggccaggcagccaccgtaataagagaaagccactgcttctgccatgacagcgtcaaactctttctctttgccaagtttcctgtagctagtgtgttcttcacgaagtttggtggggtaggtaggaagagatgactgttacccccattttatagctaagaaaactgagacaaaggagaaaaaagttattctgtacctgctgttcttaagctaccaggccacatcccatcgtttctgatgtggaatttgacttaagaaaccaaatttccagaatatttctgaacatggagttaagaggatttttgtccccctacctaatgacaggaaaaaaaatcacaaagttcatttattcctgtggtcaacagaatgtggaaggttgtggacagggcacttctctttttctggtagttagaaaatgctggctctgaaactccctcctgcacatctacccaaggtctcggttatgaagcccttcttcctgcagacccttcagctcatcttggcaaaaaacagatggtacactaggatgagggtttaacaaaggggcatcacaaaggtgtgggcccatgtgcagagggaccatgcagagtgcggggccatcagcaccactagtcctgatgcagggggagggggaaggttgtgggagtaatgcagaagtatcctggagacagcacccttggaggagctgcggccctcagtagaaaggttctggggagtgattggcctctccttcctctacacattccctcctttctggtcagagttcccagtggaaaacccattgaggcatctcattccaatcactttcagggacagcacaggttggagggtgagcatagagaagctgtccagcaagttccattctctctactgctgtaaaaccaacctccttggtaactttaaacagccatttaattttgttcatgctcttgcaggtcaggaatttaggaaaggcttcactgggcagttcatctgtggccatgtagcatcagctgaagggggctgggccttcttctgtcatgtgtctggcacctctaggctccttggcctctctgtccatatggagtctcattctttaaggcttctcacagaatggtgtcctctgggtgcctgcatttcttacatgatggctggcttccaagagcaagttttctaagagacagaaagtggaagctgccaatctcttcaggcttgggcctggaaactggcacactgtaacttccatcatattctactggtccaagcagtcacagagcccacccagactccgggggtgggggtggggatgcagacccccccatctctcaatggaaggaatgtcaaagaatttgtggcctattattattattattattattattttgggacagagtctcactctattgcccaagctggagggcagtggcacgatctcagcccactgcaacctctgcctcccaggttcaagcgattctcctgcctcagcctcctagggagcttggtttacaggctccaggtagccaccaagcctggctaatttttgtatttttactagagaaagggttttgccatgttggccaggctagtctggaactcctgacctcaggtgatccacccggctcggcctcccaaagtgctgggattacagtcatgagctaccatgtccagctgtggccaattattaatccaccacatggcaaaacaaccaatcccttgaacaacctggaaatgaggggggccagcctacaagtgattcaattactcaccatatgatcaccccttaaatctaatatttcaccactacaccttgggtgaacatgaatgtcagagggccattactgtggccccacagatccagagcatctgtgtgaagggacagcttcattaaggcactgtgtcagtccttggaacctgccctgctgagctcttctgccgtcagtccaggctttctcatcctgctgtgctcccagaacttcatcagccattggataaattcttcaaacaccttcgggaccaggggagacagaactattctctttttgaaacttggcatgttgcaattccgcatgtactgacttattcataccagtgaaactgaagagatccagctcctcagagtcaaggtgcccaagagattagctggttccttaaggtagataagagatgatgaatgttgagtgcctccagaattacccccatagccaatgataacagttattgtcaccattaatactcagcttgccttctgtggcctcaagcctcccctcctggctggctttacatccccaggggaggatgcagaggtatcccgttaatattcctttttggaccccagttccaagctcaaggatgaagatgtctcagcctggaagtgctgtcgggtggacagctcagaatgtggcctgagtgtcatctgagaactaactgcgtccaggtctgcaattagatcagtacagaggttgaagcctatagttccagcactttgggtggctaaggcgggaggattgtttgagtctaggattttgtcacaagcctgggcaatgtagagagaccccatctctacaaaaaaaattgaaaattagctaggggccgaggcgggtggatcacaaggtcaggagatcgagaccatcctggctaacacagtaaaaccccgtctctactaaaaatacaaaaaattagctggatgtggtggtgggcaactgtagtcccagctacttgggaggctgaggcaggagaatggcgtgaacctgggaagtggagcttgcagtgagctgagatcatgccactgtaccccagcctgggcaacagagcaagactctgtctcaaaaaaaaaaaaaaaattagccaggtgtggtggtgtgtgcctatagtcccaactacttaggaggctgaggttggggaatcacttgagtcctgaagttcaaggctgcagggagctatgatcatgccactgcactctagcctgggagacagagggagaccctgtctcttaaaaaaaataaaaataaaataaatacaaaataaaatacaaagactcagaggaggggttttagaaacttttatagcaacttaacagaacaattttgtgacttttgcacctaataagaaaaaaaaagacttggattttgaatatctttgggtttttaaaatttcatttttctagtaattaatttttattatattttacaaaaatataataatctgtgttgaaaagtaagttttaaaacacaatgctttaccacgagagctagagaaactattccaggacctgttttcaggagatctgggctccccctattcacagctctatgggctgcgttcacaggcttggccttaagcaatagtttaaagagtggtcatgatatgacctcatctgctctaaaggctctgagaagcagccccgcccttagctacctgctacctgctccaactcctgcagtgagagacggcagcaggacaggctgagagataagatgctctcagagctaggcttagagggaggagcagaaccctcaggccagtgatgactataggcataatgataatgatcattgttcccatccattggcatttactgcgtgccaggcgccgtgtggagggctttcctgcattctctccccaaatgcacaccatgacccggagaagtaggcattatcatctccattttacatgtgagggggtcagggcaactcttggtcacacagcttcagtgacagagcccaagtccaagcacatgtgtctcttctaaagccatctaggacactgcactcttttagaatggagctcattctcaatcctctgtgtaggcacgacaggaaaccgggttgtgtcatcgtcacacatttctccatgaaacaatgaaatggacttagaaacataagagctgtgagaactgctgctctcacaggcaacactaaaacccagagtgaactcccgtttttgctcagtataagaatttcagagaagaggagtaaactattctgcagtgatttaaagatacccaccaagggccacgaaatgcctttctcctggagcaaaaaggcagctctgcaccaggggcccttaggtccctgaagagtcttgaggggctgagtggaaggttaggacctcaagtggaaatgcacacgcaggccagagttaggcatgtactgtgcctgccaagcccagtgagaaccaagcctggctcttgcatctgaacatgattctctaagcactgaaaggcaggggccccaaggcttgctgagtgagtgggcaagaggatgaggaactggatttggcttttgtaaagtgagtggctaagagcacaggagttgagttttatgttgaaaattcactaattcagactggttccaagatggccgaataggaacagctccagtctacagctcccaacatgagcaatgcagaagatgggtgatttctgcatttccaactgaggcactgggttcatctcactggggattgttggacagtgggggcagaacagtgggggcagcccattgagtgtgagcatcacctcacctgggaagtgcaaggagtcagggaattccctttcctagccaagggaagtggtgacggacagcacctggaaaattgggtcactcccaccctaatactgtacttttccaacagtcttagcaaacagcataccaggagattatatcccatgtctggctcggagggtcccatgcccacagagccttgctcattgccagcaagctcgaactgggtggagcccatcgcagctcaggaaggcctgccagcctctgtagactccacctctgggggcaggtcatagccgaacaaaaggcagcagaaacctctgcagacttaaatgtccctgtctgacagctttgaagtgactagtggttcacccaacatggaatttgagatctgagaagggacagactgccccctcaagtggctccctgaccccagagtagcctaactgggaggcaccctccagtaggggcagactgacaccccacatggccaggtacacctctgagacaaagcttccagaggagcaatcaggcagcaacatttgctgttcagcaatattcgctgttctgcagcctctgctgctgatactcgggcaaacagggtctggagtggacctctagcaaacatcaacaaacctgcagctgagggtcctgactgttagaaggaaaactaacaaacagaaaggacatccacaccaccaaaaccccatctgtacgtcaccatcatcaaagaccaaaggtaaataaaaccacaaagatggggaaaaacagagcagaaaagctgaacattctacaaatcagagtgcctctccccttccaaaggaaggcagctcctcgcgagtggtggaacaaagctggatggagaatgactttgacgagttgagagaagaaggcttcagatgatcaaacttctcccagctaaagaaggaagttggaacccatcgcaaaaaaagctaaaaaccttgaaaaaagattagacgaatggctaactagaataaccaatgtagagaagtccttaaatgacctgatggagctgaaaaacatggcacgagaactatgtgacgaatgcacaagcttcagtagccgattcgatcaactgtaagaaagggtatcagtgactgaagatcaaatgaatgaaatgaagcgagaagataagtttagagaaaaaagaataaaaagaaatgaacgaagcctccaagaaatatgggactatgtgaaaagaccaaatctacatctgattggtgtacctgaaagtgatggggagaatggaaccaggttggaaaacactctgcaggatattatgcaggagaacttgctcaccctagcaaggcaggccaacattcaaattcaggaaatacagagaacaccacaaagatactccttgagaagagcaactccgagacacataattgtcagattcaccaaagttgaaatgaaggaaaagatgttaagggcagccagagagaaaggtcaggttacccacaaagggaagcccatcagactaacagctgatctctcggcagaaaccctacaagccagaagagactgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagaactcctgaaggaagcactaaacatggaaatgaacaactggtaccagccactgcaaaaacatgccacattgtaaagaccatcaatgctaggaagaaactgcatcaactaatgagcaaaataaccatctaacatcgtaaagacaagatcaaattcacacataacaatattaaccataaatgtaaatgggctaaatgctccaattaaaagacacagactggcaaattggataaagagtcaagacccatcagtgtgctgtattcaggaaacccatctcatgtgcggagacacacataagctcaaaataaagggattggaggaagatctaccaagcaaatggaaaacaaaggcaggggttgcaatcctagtctctgataaaacagactttaaaccaacaaagatcaaaagagacaaagaaggccattacataatggtaaagggatcaattcaacaagaagagctaactatccgaaacgtatatgcacccaatacaggagcacccagatttataaagcaagtccttagagacctacaaagagacctagactcccacacaataataatgagagactttaacaccccactgtcaacattagacagatcaatgagacagaaagttaacaaggatatccaggaattgaactcagctctccagcaagcggagctaatagacatctacagaactctccaccccaaatcaacagaatgtacattcttctcagcactgcatcacacctattctgaaattgaccacatagttggaagtaaagcactccttagcaaatgtaaaagaacagaaaccataacaaactgtctctcagaccacagtgcaatcaaactagaactcaagattaagaaactcactcaaaacctctcaactacatggacactgaacaacctgcacctgaatgactactgggtacataacgaaatgaaggcagaaataaagattttctttgaaaccaatgagaacaaagacacaacataccagaatctctgggacacatttaaagcagtgtgtagagggaaatttatagcactacatgcccacaagagaaagcagggaagatctaaaattgacaccctaacatcacagttaaaagaactagagaagcaagagcaaacacattcaaaagctagcagaaggcaagaaataattaagatcagagcagaactgaaggaggtagagacacaaaaatcccttcaaaaaatcaatgagtccaggagctgattttttgaaaggatcaacaaaattgatagactgctagcaagactaataaagaagaaaagagaagaatcagctctccctctcccctctcccctctcccctctctcctctcccatctcccctctcccctctcccatctcccctctcccctctccctctccctctccccacggtctccctctccctctccccacggtctccctctccctctctttccacggtctccctctgatgccgagccaaagctggactgtactgctgccatctcggctcactgcaacctccctgcctgattctcctgcctcagcctgccgagtgcctgcgattgcaggtgcgcaccgccacgcctgactgtttttcatatttttttggtggagacggggtttcgctgtgttggccaggctggtctccagctcctaaccgcgagtgatccgccagcctcggcctcccgaggtgccgggattgcagacggagtctcattcactcagtgctcaatggtgcccaggctggggtgcagtggcgtgatctcggctcgctacaacctccacctcccagccgcctgccttggcctcccaaagtgccgagattgcagcctctgcccggccgccaccccgtctgggaagtgaggagcgtctctgcctggccacccatcgtctgggatgtaaggagcccctctgcctggctgcccagtctggaaagtgaggagcgtctctgcccggccgccatcctgtctaggaagtgaggagcgtctctgcctggccgcccatcgtctgggatgaagtgaggagcgtctctgcccagccgcccatcatctgagatgtggggagcaccactgccccaccaccctgtctgggaggtgaggagcgcctctgcccggccgccctgtctgagaagtgaggagaccctccgcccggcagccgccccatctgagaagtgaggagcccctccatctgagaagtgaggagcccctccgcccggcagccgccccttctgagaagtgaggagcccctccgcccggcagccgccccgtctgggaagtgaggagcgtctccgcccggcagccaccctgtccgggagggaggtggggggcggtcagccccccgcccggccagccgccccgtccgggaggggaggggttcagccccccgcccggccagccgccccgtccgagagggaggtgggggggtcagccccccgcccggccagctgccccgtccgggaggtgaggggtgcctctgcctggccacccctactgggaagtgaggagcccctctgcctggccaccaccccatctgggaggtgtagccaacagctcattgagaacgggccatgatgacaatggtggttttgtggaatagaaaagggggaaaggtggggaaaagattgagaaatcggatggttgctgtgtctgtgtagaaagaggtagacatgggagacttttcattttgttctgtactaagaaaaattcttctgccttgggatcctgttgatctatgaccttacccccaaccctgtgctctctgaaacatgtgctgtgtccactcagggttaaatggattaagggcagtgcaagatgtgctttgttaaacagatgcttgaaggcagcaggctccttaagagtcatcaccactccctaatctcaagtacccagggacacaaacactgcggatggccgcagggtcctctgcctaggaaaaccagagacctttgttgacttgtttatctgctgaccttccctccactattgtcctatgaccctgccaaatccccctctgcgagaaacacccaagaatgatcaattaaaaaaaaagaaaaaaaaaagaagagaagaatcaattagacgcaataaaaagtgataaaggggacatcaccacggattccacagaaatacaaactaccatcagagaatactataaacaactctaagcaaattaactagaaaatctagaaaaaatggataaattcctcgacacatacaccctcccaagactaaaccaggaagaagttgaatccctgaatagaccaataacaggctctgaaattgaggcaataattaacagcctaccaacccagaaaagttcaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagatacacacacaaaaaaaacaattttagaccaatatccctgatgaacatcgatgcaaaaatcctcaataaaatactggcaaaccgaatccagcagcacatcaaaaagcttatccaccaggatcaagtgggcatcatccctgggatgcaaagctggttcaacatacacaaatcaataaatgtaatccagcatataaacagaaccaaagacaaaaaccacatgattatctcaatagatgcagaaaaggcctttgacaaaattcaacaaccattcatgctaaaaactctcaataaattaggtattgatgggacgtatctcaaaataataagagctatttatgacaaacccacaaccaatatcatactgaatgggcaaaaactggaagcattccctttgaaaactggcacaagacagggatgccctctctcaccactcctattcaacatagtgttggaagttctggccagggcaatcaggcaggagaaagaaataaagggtatttaattaggaaaagaggaagtcaaattgtccctgtttccagatgacatgattgtatatttagaaaaccccattgtctcagcccaaaatctccttaaagctgataggcaacttcagcaaagtctcaggatacaaaatcaatgtgcaagaatcacaagcattcttatacaccaataacagacaaacagagagccaaatcaggagtgaactcccattcacaattgctacaaagagaataaaatacctaagaatccaacttacaagggatgtgaaggacctcttcaaggagaactacaaatcactgctcaacgaaataaaggaagacacaaacaaatggaagaacatcccatgctcatggataggaagaatgaatatcataaaaatggccatactcccaaggtaatttatagattcaatgtcatccccatcaaactaccaatgactttcttctcagaattggaaaaatctacgttaaagttcatatggaaccaaaaaagagcccgcattgccaagacaatcctaagccaaaagaacaaagctggaggcatcatgctacctgacttcaaactatactacaaggctacagtaaccaaaacagcatggtactggtaccaaaacagagatatagaccaatggaacagaacagagccctcagaaatgacaccacacatctacaaccatctgatctttgacaaacctgacaaaaacaagcaatggggaaaggattccctatttaataaatggtgctgggaaaactggctagccataggtagacagctgaagctggatcccttccttacaccttatacaaaaattaattcaaggtggattaaagacttaaatgttagacctaaaaccatcaaaaccctagaggaaaacctaggcaataccattcaggacataagcatgggcaaggacttcatgtctaaaacaccaaaagcaatggcaacaaaagccaaaatggacaaatgggatctaattaaactaaagagcttctgcacagcaaaagaaactaccatcagagtgaacaggcaacctacagaatgggaaaaaaattttgcaatctactcatctgacaaagggctaatatccagaatctacaaacaactcaaacaaatttacaagaaaaaaacaaacaaccccatcaaaaagtgggcgaaggatatgaacagacacttctcaaaagaagacgtttatgcagccaacagacacatgaaaaaatgctcatcatcactggccatcagagaaatgcaaatcaaaaccataatgatataccatctcacaccagttacaatggcaatcattaaaaagtcaggaaacaacaggtgctggagagggtgtggagaaatgggaacacttttatactgttggtgggactgtaaactagttcaacctttgtggaagacactgtggcaattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccatcaatgatagactgaattaagaaaatgtggcacatatacaccatggaatactatgcagccataaaaaaggatgaattcatgtcctttgtagggacatggatgaagctggaaatcacccttctcagcaaactatcgcaaggacaaaaaaacaaacactacatgttctcactcataggtgggaattgaacaatgagaacacttggacacaggaaggggaacatcacacaccaaggtctgtcatggggtgggggtaagggggagggatagcattaggagatataactaatgtaaatgacgagttaatgggtgcagcacaccaacatgacacatgtatacatatgtaacaaacctgcacgttgtgcacatgtatcctagaacttaaagtagaattaaaaaaaaaaaaagaaaattcactaattaggtgtgtgaccttgggtaaagttcaagagcaaagctacacaacttccctaagcctcagtttcttcatcattaattggggaagtgctctgaggctcaaatgaggtcatgcacataaagcactcggcatgggcagggcatctgagggaagcctgaacacttggcattgggcattgttattgttcttcctcaggctcctctcatgttgttctttctttacagcaaagttggcccgagatgaccaaattcacattctcaagcaacaccgacgtaaagaactggaaacacggcaaaaacaatatcggtgagttatgacatcagatcgagtggccacggggccatggtttcttctatctcaagagcatggtatgaaataaaccctttccacagtgtatggcctgtcactgctggaaagtcaccaaggcaccagctcccagtgtgggtgcacaatccccaaacttcaccttacctacaactccagacaagagatggagaggagagtaatgaaaataactttggatcaaccatattggcatgtaggaagaatgggcagaaaagcttgagtgtaccttaatgttctccattgtaggggttgcctcttacttcttatgtcttcttataacaattcaattataaaagtgatacatgatcagcaataaaattgacaactcttcagccaactgaccagaggattcaaaccattaaaatgagcaataagagaaaatcaatacagaaattaaaatgaataaaaaaggaaaaatgagactcataaaatgagggaaaatcaatacagaaattaaaattaataaaaaagaatactatgaacaattgcatgccaacaaactagttaaatgaaatgcgcaaattcctagaaagacgcaaactgccaaaactgactcatgaagaaatagttaatctgaataaaacaatcacaaccaaagagattgaattactaattctaaaatttcccacaaatagaagcccagacccagatagcttcactggctaattctatcaaacatttaaagaattaatactgatcttgcataaactcttttaagaaatagaaggaacacttcccaattcattgtctcatacccatattataccaaaactaaaggcatcacaagaaaactataaaccaatatcccttagcaatatagatataaacattttcaacgaaatactagcaaacctaacccagaagtatataaaaggcattaaacaatatgaacatgtgggatttagcccaggaatgcaaagttggtttaacatccaaaaatcaattaattgaattcaccatatcaatagagtaaataacaaaacaaaacaaagtacataatcatttcaatagacatacaaaaaaggcatttgacaaaatccaacacccattcatgataaaacactcaaaaaataggaattgaagaaaatgtcctcaacctgataaaggtttgaaaattcacaattaggctgggcgtggtggttcacacctgtaatcccagcactttgggaggccaaggcgggtggatcacgatgtcaagagattgagaccatcctggccaacatggtgaaaccccgtctatactaaaatacaaaaagtagctgtgtgtggtggcatgcgcctgtagtcccagctactcaggaggctgaggcaggagaatcacttgaacccagaaggcggaggttgcagtgagctgagatcatgccactgcactccagcatggtgacaagcaagactccgtccccccacatacacaaaaaaagaaaattcacagttaacattatacttaatgatgaaaggctgaatccagaaacaggataaagatgttcacttttgctacttctattcaacattgtactggagggtctagccagctcagttagggaataaaaagataagtaaaggcacccacaatggagtacagtaagtaaaactaccacaatttacaaataacatgatcttatatatagaaaatctgaaggcattcaccaaaagaaattattagaactaataaaccaccaagattgcaagatacaagataatcaattgtttttctatacattaacaaccaactatgtgaaataaaagtaagaaaaagttcaatttacaatagcatcaaaaacagtaaacatttatgaataaatttaacaaagtagtctgagacttgtacaatgaaactacaaaacattgtttaacattattaaagaagatctaaataggttgaaagacatttcatgttcatgaatcagaggacttaattttgttaaaatggcaataccccacaaattaatgtacacgttcaacacaacccttatcaaaattctagctgatttctttgcagaaattgacaagctgtcaattctgcaaattcatatggaaatggaagggacccagaatagccaaaacaatcttgataaaaagaaaacaaagatggaggacttgcacttctcaatatcaaaattactacacagctatagtattcaagacaatgtgatatcggcataaggatagatatatagatcaatgaaatagacttgagagtccagaaataagcccttacacttatggccaattaatttttgacagaagcagcaagacagtttaacagagaaagaatagtcttttcaacaaatggtcctagcaaaactggatagccacatgcaaaagaatgaagttggatccttagctcacaccatatacataaattaacacaaaatgagtcaaatacctacctaaatgtaagagctaaaactataaaactcttttaagaaaacacaggagtaaaccttcatgactttggatttgacaaaggactcttgatatgacaccaaaagcatcagcaacaaaagaaaaatagataaagtgataaagtgatgtcatcaaatttacaaacctttatgtttcaaaggacaccatcaagaaagtgaaaagatgaaccacagaatggaagaaatatttacaaattgtatatctgataagggccttccatccataatttataaagaactcttacaactcaataaagacaaatagtccaattaaaaaatgaaaaaaatgagtgaggatctgaatagatatttctccaaggacccattagtcatctaggaaatgcaaatcaacaccacaatgagataccacttgatactaggatggctagaataaaaaaatccgacaagaacaagtgttgacaaggatgtggagaaatcagaaccctcatacactgctggtgggaatgtaaaatggcacagctgcttgggaaacagtctgctagctcctgactgttcaacagagagttacaatatgacagcatttccactcttaagcatattcccaacagaaatggaaacatatgcccacacaaaaacttgtacatgcatgattatagcagcatgacctgtaactatcaaaaagtgtacacaacccaaacgtccattaatggatgaatggataaaatatagtatatctatataatttgaccatgaaagaagaatgaaatactgacacttgttacaacatggatgaatctcaaaaacattatgctaagtgaaagaaaccagtcacaaaagatcatatattgtatgattccttttatatgaaatttctggaaaagaaaaatctgtacagatataaagtagattactggttgcctaggggcagggaatgaggaagtggtcatgggagtgacagctaaaggatacagtgttccttttgccggggatgaaaatgttctaaaactgatggttgtccattgtgtaaaaattaatactaaacatccttgaattgaacactttaaatggataaattttacagtatgtgcattatatttcaataacgctgctagataaatttaaaaattaattcaaaatggatgatagatctaaaagtaagggctaacaacataacactcttggaagaaaacatacaagtaagtcttcataatcttgggttcggcaaagtctcttagatatggcaccaagagcacaggcagcaaaagaaagtagacaagttagatgtcattaaaatgtaaaagatctatgcttcaaaggacatcatcaataaagtgaaaagacaatccacagaatggagaaaatatctaaatcatatgtctgataagggacttgtatccagaatatataaagaactctgacaactcaattttaaaatattctgtacaaaaaaccccgtttaaaaattagcaaaggatttaattaaatagttctccagagaaaatttgtgaatctccaataagcacgtgaaaatatgctcaacattattaatcatcaggaaatttcaaatcaaaaccacaagatacaattctaaccactaaaatggttagaataaaaaagacagatagtaacaagtgctgccaaggatgtggagaaactggaaccctgatgctgctaccggaatgtaagatgatgcagccacttcagaaaacagtttagtggttcctcaaaatctgaaacccagctacaatatgacccagcaattctactcctaggcctctacccaagaatattgaaaccacatgtctatacaaaacttgtacacacatatttatagcaccattgttcacaatagtcaaaaagtagaaacaacctaaattccattaactgaggaatgaataaacaaaatatagtttatccatacaatgggatattttttggcatcaaaaaggaatgaatgccaagcgcggaggctcacacctgtaatcctagcactttgggaggttgagacgggcagatcacttgaggtcaggagtttgagaccaacctggccaacatggtgaaaccccatgtctacaaaaatacaaaaattagccgggcatgttggtgcacgcctgtaatcccagctgcttgggaggctaaggcaggagaatcacttgaacccgggaggcggaggttgcagtgagcctagatcccgccactgcactccagcctgggtgacagagcaagactccatttcaaaaaaagaaaagaaaagaaaagaaatgaactacagatagatgccaaacactgaatgaacttcaaaaatatgctaaatggaaaactcacttacggaagaccccatattgtgtgattctatctgtatgaaatgtccagaataggcaaacccacagagtcaggttagtaggtgagtagttgcctagcactaggagttggggaggggaaacaaggagtgaatgttaatgggttcgaggtgtcctctggggatgagattatttcagaattgggttataatgatggttacacatacaactctgcaaatatattaaaatcttttgatagcatatttttaaggggtgaatttaatggtatgtaaatgtatctcagtaaagctttttggaagataataacacattacagagtgctcctctggaaatgggtggctgatgggctgtatccagcctctacaagtgtttgatggatcattattgacttatgagtaaacagagatattcttcaggcttccccagtccacacttgtctgttgtctatatcaaggttttctttcatttcatttcctgctttggcccctggaaacatttgagtctgtgcctccttccaagggaagaaagtggaaggaatcattctacatggacagtgaagttacctgggctgtggaggggcctttgggagccaatattgtgatacttttctacatatccctcaatagttgaacttcttacaaggaatatgtagtatatctgggttgtttttttaactcaaaaaagtaaaagaaggaaaataatatagagccagaaaaatacctattttctgtatgaattatgaattttatgaactttttcataaaaattcatgtttaattgttttcactttgtcttattcactttttaaaatttgggattgtgctatatataccactttgcatcctccttgctgccctttagcagtgtagcaaaaatcattttcccatattttcaaaatctcatcataaacattattctagtttctatgtactattccattggatggatgcctcatcattcacttaaacacccagcttccctggacatttaggaggtttctaatttttgtattcttataagcaaagtgaaaacccttgtatgtgaaatttgtatacattattaagtattttcctaggacagatgcccagatatgaaattaccaaatagtaaaagttattagtatacattgacaaatttctcctcaaaaatctttaaccatttgggaggctgaggtgggtggatcaccaggtcaggagatcgagaccatcctggctaacacggtgaaaccccgtctctactaaaaaatacaaaaaattagccgggcgtggtggcgggcgcctgtagtcccagctgctcgggaggctgaggcaagagaatggcgtgaacctgggaggcggagcttgcagtgagccgagattgcaccactgcactccagcctgggcgacagagcgagactccgtctcaaaaaaaaaaaaaaaaaaaatctttaaccagttttcacgagccatgtatgggtccctgtttcatcaaacacttgccataactgagcaatatcttcatttttcttaatttttctaagttgcaacagcatccctcaaccctgtagctccttcttcccctatgcccagccacccactgctgtcaaggggtgagaaatcccacaccaagaacacaattgccccacctcaaaactgtcttagcttcatcccccttttcatcaaaaacattccttgaaacagaataaagaaacaacaaacagccacacgtatgtgggtactgggtctgctacggagggctcggctgatgggtggcactgggccactggacatgcatctcgaggacaggggccagccagcacggagggctgaaggagaaggagaagaaatcagactccacctcttgccattcaggagactcagcttggggttgattagacttaaaagttaaaggcaaaactgtaagacatttagactacaggtgattattcttccaggtctcaagctaaaaggatttttcaaacaagactcagaacatattaaacacaaaggaaaagattggtaagtttgcctccctcaagataaggacactctgttcattgaaagacaccaggagagagtgaaggcaagtcatggagtgattgacgagaattattcctagtatgtgaaggacctacaaatctttaagaaggggagtgtcattcactagaaaatgggcaagaagtttgagtacttactgtacaaaatataagcagcaagtatacaaaaggtgttcaacttcattaggactcggggaaatcagaagatcacagtgaactgctgctactaccacacatatgcccccagatgggcaacacttcaacaactgacaacacctgagtattaaagaagatccagagggctgggaacactcatataccaccggcaggaggacaagttggtaagacctccgtggaaaacaatttagcaatatgtcataaaactgaagctacattataatctatgacccagaaatcctatagtgggatccaaatttgtgtgcatgtgcgcctggatactcacaacagcattactcatgatggccaaaaaatggcaacaactcaatgtccaacaaacagtagaacagacaaattgtcaaggaaaattctacactgcaaggaaaatcaacaaactgctgctaacatggacaaacctcactgacgcagtgttgaaggaaagaagccaggagcgtgtctggccaattcataactttggaatgaaattgtttagggaggtgtgtcatagcggaaccttaaacaataacaagaaaatgattatcataaagccgaggatggtcattaccggggatggaaggagggttgattgggaaaggtgggggtgagggtacggacaatgttctgattttttacctggatggtgttcgtacaggtgttttgtacatttttctgcatgtgtgagtgtgtgtgtgcatatatacatatccatacatattttatatattctatttcccaattgaaaaatcaaaaataaaacttacatgccattagcatcaagtgtgggagagtaacctgctgtgctgtgggtcatgttaagggtttataaatgtgtgatttgttttagagtatttgtgcacaagcctctcagctcaggcaccatatgatgtgtttccagacttccatacctggtgcagtgcacacgttgtgcttgagctctgcctcccatcccaaagggctgttgtttctatgcttcttccttggcttccctccctgtttcagacacctatggcaaagcccctgcagccagttctcagagcacttctggcctgtgaatctgggttaagataaaatgcccataaaattcatttaatttgttataagccactaacactttagtatgaattagtggggctctaattagactttgctatctactcatctaagataacacaaactagcccaattatctgggagctacttaacattatcataatcttgcagcagggggcttctggtgagatcgtttccccctttcttagatttaatcatttttttcttcctccttccactcatctgtccttttcagaaaccctcctttgcttccgttcaggaaacactgaactttgcactgtctgcacaatcttggagttcctctttctcagaagatttctcaggcttccagatcagagtttggaagtaaagcaatgactaagaatagtccacactatgtcagaaagctggcgcttcttgcaggccctccttactcactcagccacgcagggagaaggagaagcagacccaggtcatagcccacagcttgtgctctcccactgtgaccacatctgtctgtgttacatgcacactcacacacagcagtaaatggcaaagtgtaggtgtttgttaatcgatataatttaatctaatcattatgtgacctgcacttttcactcatcactaagtattgaagaggatctggttgacacagatagatgtggttcatgcagttaacttcttcatggcatatcagtatctgaataacccatgcgctcgtccgctctcctgctgatgggcaggcgggctgtctttaatttctagctgttgcaaaccaagcgacagtgagctttctcacacatctctctgtgctctcatggaagagttactgtagggaatattccaagaagtagagttgcagggttgcagaccacgtgtttttaagctttctagatattgctgattgttttccaaaggcattctgccagtagacaccccagtaactgtttctgagattcactgtttccctgcatcatcaacacttcgcatcttcagatgttttcattcttgcgtgtgaaatagtatctcatatattttccccttcttaaactgctactatttcttgccttctgggaatgcaccataatttacttagccattcccctattcactgacgttcagttcatttcccatttgtagatgtgtttgtttgttttgggtattgcagtacaaacaatgctgccagaaccaaccttgtacaaacatcttgatgtactggtgctttaattaatggcagatccatttccagaactcagattgctggaacaaatcagcattttttcatcttaagaaataccgacaaaaatcctttcacaaaattgtatcgtaatttgcggtcctaccagctgtgtatgaaaagatacttttgcccatccatacatttgtcagtacccgatgaccttgtttgacagtctaaaaatccctaagaccttgtggttgttttagtctgcactcccctgaccactaataagcatcactgcattgcctatttataagctttttttccctattgttctttcaattattaatctaaaggagctctttctatatcaggatagtatccgtttgttacatatgtatagcatttattatttgtcttctgttgcttttgccacaggagattttagttctttattttattaactatgtattgtttacatctataacttttgggtttcctcctttgcttaagaaaaccctttccatcccagtgttacacaaatacttcccccgtaattttgtctaatacttttataatttcccctttgagtttagagctttcattcatctacctttttttttttttttgagacagagtcttgctctgtttcctaggctggagtgcagtggcatgatcatggttcactgctgcctcaaactaacccaggctcaatccatcttcccacgtcagcctcccaagtagctggggctacaggcgtgcgccaccatgccccactcctgccacgtgttttcatacatacctgggtggaactctcccggtagcattcgttcctgacttggatgacagggatgatgtctttcctcctgacttggatgacagggatgatgatacccacggtacaagctggcataggatggcagtcatgagctctggattcgagtgtctgggctcaactcacacttactggcactttctccagtcctgtgaaagttgtttaatctgtctgtgcctcacttccctcatctgtaaaatgagggaaataacagtgccttccttttaggggtttgagataataggttaaaccatgaaaacacagagaatagtagtaggcacatagaaagcactggataagtgttggcgagttttgtattatgtatacatagtctctgggtctgtttccgcactttatgtgttagcctatttttctactcgagaccccagcaccagcttttggttatcataactttctaataaatgttaatgtctgttacatatctcactgttctttcttaagtttttcataatgagaattactttgaacttcacataactgtgttatgtgttggcattttactgagattcagtctttccatccaggaacacagcgtgtctttccacctctctagatcctgtgtcaacgtacttccatagaatttctagttttcttcatgcaggtccttcacctttctagctactctacatttagcatttgctgttctgagtaggatatttttctgtttgcaaaaatattgctgggataaatgtaaattacttgtttcttacatttactgtgtgttggtcccttactgaattctttcattggttctaatcacttgtttttgtttgtttgttgttagtgagtctggttagttaatgtgctcatattatctaaatgttaataattttgtctcttactttccattatctacaccactgatattcttttcttattccatgtctggaattcccaaaacaagtagtggtagtagtgatgaacatccctctcatatttttgtttctttgtttactattatatttgctgtagttttataatgcatattctttgctgtatttaggagtttattgattcattctaatttaatttttgttcagctgaacttgttcaattaatttcctcagaaggtccatgtgtagtgtaagatctgagtctgtgcttgtcgtcctgtccccctacccatcccctcaaacaaattcccctgccctcattgatgacaatatgagaggcttagatgacgatctaaaaaaagtgtgtatacacttcagtcttcccattttcagaatgacagaggagaaatctaatgatagtttgtttcttttcctagagtttctatctccctccctcccccactttcttcctctctcgttcactctctgcatctctttccttctctctgtctctgtttctcctgtctcttggacattttaaaatgtattcagtatatacctaggtgtatctttttcctttttttttttcccccccacctaggacttgtcattgagaaaaatgacgagacaagtctcaatcattttaggaaatttatttgcgaaagttaaggacgcatgcccgggagacagcactatgcctttctctgaaggtgattttgagggctccaaatttaaagggaaaagggcgggatattgagaagtacacaattttcatgtaagagcagggcagggaaaaatagttattcatgcctttctctggctcagtgaatctgcattttttttaacataagatgacataaacaaatgaggcagaggaaaaatgcagggagtctgcattttacataagagaacatagataaagtaaggcaggggaacaatcagatatgcatttgtatctggtgggtgactgcacttgtaaagataagctatcaatttgcattgccatggtgaaattttaacggttcactaggaatttccttgtgagcaaaatatggtggagacatgtagcttttcatcatagccatcttatttaggaaccaaaagggggaggcaggtttgcatgacacagttcccagcttgacatttccctttggctaaatgagtttggggtcctaaaatttaatttcctttcacagacttaagatattgaagtatttttcagcttaaaggagttcttcttttatttctttgatttttttcacttctccatatattactctctctccttttggagcttttactccttgcatattacatctgtatctggctttcatgtctgttaatgaaaagagtcacactctgtgaaatatttgaaaagacttattctgagccaaatatgagtgaccagtggcccatgatgcagccccaggagatcctgagaacatgcacccaaggtggttggggtacagcttgcttttgtgcattttagggagacataagacatcagtcaatacatgtaagatggacagtggtttggttttggaaaggtgggacaacttgggggaggggagcttccaggtcataggcagattcaaagagtttctgattggcaactgcttaaaagaattattatctaaaaacttggaatgtctaggttaagataaggggttgtggaaacaaagttttttatcatgcagatgaagcctccaggtagcaggcttcaggtagaatcaattgtaaatgtttcttatcaatcttaaagagtctgttctaatgggcttaacatctctgtgttgatgtgaatgctgatcagttgtgcctgaattccaagaggaggagagtacaatgaggcacgtttagccacccattcctatcatggcctgaactaatttttcaggttaactttggaatgcccttggccaaggggagggtccatcagtcagttcaggggcttagaattttatttttggtttatgtctctcatagtttcatttatggcttccatttctttgtagtttcaccctgtatttgggttacatgttcttctattttgcacaaagcacttcctggcacatagtaggtgctccataattagttgtcgaatgaacaccttctctcttctaggtgttaatgagtttagcttaaacttttctccttacatattttaaattcagcctaaaagtttctctgtacatagtgaactgtaacctaactggatgtgtaaacagactgtcacctactctcatagcaagtaaccaagtctcagccaatcacagcggccagacttcagccactcacagtggccagctgttcaaactgggctcaagtaaggcaaatgctgagccatcaccaatctggctgtttctgtacctcacttccattttctgtacatcacgttcctttttctgcccataaatcctatccaactatgagacagcatcaaagtcactcggagcctgctctggtttaggggctgccctattcttgaattgttctttgctcaattaaactgctaaatttaatttgtctaaagcttttcttttaatacaagagaccaaacatctcacagtgattattctctttgtctgtttctctattgaagtcttcattcagaaatcatgtttgtggttacagaaagtctttttacactccaattatactaactgcatccccttaggatctctctgtctgtctgtctctctctctctctctctctctctgtctctctgtctctcttgctttctctctctctctttctctctctctctctctctgtctctctgtctctcttgctttctctctctctctttctctctctctctcattttttttccaataaattaaatgcctttctacttctttgttccttctgcctgggtgttccacttggtcttcctcaatggagtgggattccatctccaccagttaatgtctgtggccatgcaggccttcggctcctgtgcaggtcagcctgtcagggtctcttaagcagcagtgacctgcagtggaagggacataaacatttggtttcaggggggcagtagtgaactagcaagcaagctgtcctgtctccatgtgctgtgaggccatcatcttctaaccacacaagtggggcatttctgcccattggtgctgccaccctccatagaccagggcagggcatggggcaagaaggtctttttggtgctgaagaagtattccacatccgtccaagtggactattcacttaagaaaacattaatgccatttgctggcacagatgcccttgcatggctcattgtttacatactgaaaaacatctagctccactgagcttttaaaattaactagagcccttgaactgtccaggcaaagagaaaatcatcagtaatatttaaattgatatgactaatgatagctaattaattgatcattactaccagtgaggctactgaatggctcaattttagatatatattggagatgccttgagtcattttccaaaacaaacaaacaaaaaatgtgtagacttgtccacatttttatccttgttaatatactatcattggcattaatacaaacagcaaaaatggaaggttttcttaaaatctgaggacgtagaatattctaaataaaccaacagtgagaaatgtaaggtgccacataacagaaaacacttgacaaaatgcctttgctgtcagaaggatcatacccggtccctgttcacttcttgtgatcctaaggagaggctactgggccaagaggacactgtgacagttgggatttggggaaagtcaaagcacaagatcatattaaaataactcaggacttttttaagacccaaaatctcgatattttactttcctctcaaaagaaaattttaaaaggaaggagaattaggaatataaatgaaaaagctaaaaccctaaaatgtaaaatctggtttttaaacaaacacaaaatcattctccctccccaaagaaactaacaggatttcattttgtttttgttaccagaaaggggtcctgatccagaccccaagagagagttcttggacctccacaggaaagaattcagggtgaatccataaagtgaaagcaagtttattaggaaagtaaagcaataaagaaaggctactccataggcaaggcagtagcatgggctactcgactgagcatacttacagtcacttcgtgatcatgtgctaaacaatgagtggattattcatgagttttccaggagaggggtgggcaattccaggaactgaaggttcctcccttttttagaccatatagggtaacttcctgacattactatggcatttgtaaactgtcatggcactggtgggagtttcttttagcatgctaatgcattataattagcatataatgagtggtgaggatgaacagaggtcactttcatcaccatcttagttttgttgggttttggccggcttctttaccacaacccattttatcagcaaggtctttctgccctgtatcttgcatcaatgtcctgtctcatcctgtgacttagaatgcctaacctcctgggaatgctgcccagtaggtctcagccttattttacccagcccctattcaagatggagttgctgtggttcaaacacctctgacattttcacaatttaagtttactcaataagtaaacaaaaaagcaaaataaacatttttcaaaaacacaaatgcccaatgccacgggatacgtttcaaggatgtcaggatctgagcatgtttactggatgcagtccgtggcttgtctttggggaagctgttttgattgtaataatctctaaagctgctattggccagcaggtgagagagggaagccttttagccatctgtgcctgggtccctctcccaggccacctgctgccgtgtcgtcctattgtgaaggcagaagaactgtcccatttccccaaatgccacatgcaggacatgcacgcagtccagggcacacactgatcaagttggcagaatggtggatgtccaggttgggcgtggctgggcagccttaataccttctacctccagtgactggcaaggcaggcctctactgttcaatgtcacctctagtaagtgaggtctccctagactacctacagaactttttatgcagtggtgcacacctgtaccactataagcccagtctcagggttcccactctgatgctcagggcacagcaaagttggtgcgactggactttggaagaggtcccagaaccttactggacacagggtcagcctatgatgtgttgactttattttgagtacatcaatctccctgtgtaacatcgtctgacagtgtgggcggccctcagctgagggggcagaccaaaggctggcatttaactcaatttcttctcctttctcatgctcagatggatggagtggaaccctggcttccccttgagcatcgatgccaaatgccacaaggatttaccccgtgatatccagtttgatagtgaaaaaggagtggactttgttctgaattactccaaagcgtaagtttacgagaactgagggactctgggcagcccctccagtggctggtgctgggggtggaaccctcactcctttcctcatggggtccttgggttgggggaacagcctagctgagccaaacgctttgatgatatgttggccatagagtggattctcaacgcacaattgcaggacaaccggtatcttaaaaaaggcataaccagaggactccagacaccagacatacatgtgtttttggcccaaagcaggggtctttagttggaatgcctcctccccatccatatctcatgctctctatggccacttcaaaggtgtgaaggctttgtgtccaggctgtcaccaagatggcaggtgctatggtaagaatggccaaattgccagtgctgatcccaggacatatgtcccctgttcctccgtcacaaccccacgagggagccacagtcatcatccccattttacagttgaggaactgaggaatacggaggttgactaccttccttgcctaaggcccccagctaataaatggcagagatataggttctgtgcacctttgtttcatccgaatgtccgcagggctttttaaagcttgcccaggctatcgggagactctaggctgcttgttaaacatatggatcccccgaccctatcccaggactactgagtgtagggatctttaaatctgcacattgaccctatagggaattttaaaaatcatgtcagtttggcgaaactattccaatcaatagaaaaagagggaatcctccctaactcattatatgaggccagcatcatcccgataccaaagcctggcagacacacaacaaacaaagagaattttagaccaatatccctgatgaacatcaatgcgaaaatcctcaataaaatactggcaaaccgaatccagcagtacatcagaaagcttatccaccatgatcaagtgggcttcatccctgggatggaaggctggttcaacatacgcaaatcaataaatgtaatctagcatataaacagaaccaatgacaaaaaacacatgattatctcaatagatgcagaaaaggcctttgacaaaattcaacaaccattcatgctgaaaactctcaataaattaggtattgatgggatgtatctcaaaataataagagctatttatgacagacccacagccaatatcatactgaaggagcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgtagatgacatgattttatatctagaaaaccccatcgtctcagcccaaaatctccttaagctgataaggaacttcagcaaagtctcaggatacaaaatcaatgtgcaaaaatcacaagcattcttatataccaataacagacagacagccaaatcatgagtgaactcccattcacaattgcttcaaagagaataaaatacctaggaatccaacttacaagggatgtgaaggacctcttcaaggagaactacaaaccactgctcaacaaaataaaagaggacacaaacaaatggaagaacattccatgctcatggataggaagaatcaatatcatgaaaatggccatactcccaaggtaatttatagatcaatgccatccccatcaaactaccaatgactttctgcacagaattgggaaaaactactttaaagttcatatggaaccaaaaaagagcccgcattgccaagacaatcctaagccaaaagaacagagctggaggcatcatgctacctgacttcaaaccatactacgaggctacagtaaccaaaacagcatggcactggtaccaaaacagacatatagaccaatggaacagaacagagccctcagaaataacaccacacatctacaaccatctgatctttgacaaacctgacaaaaacaagcaatggggaaaggattccctatttaataaatggtgctgggaaaactggctagccatatgtagaaagctgaagctggatcccttccttacaccttatacaaaaattaattcaagatggattaaatacttaaatgttagacctaaaaccataaaaaccctagaagaaaacctaggcaataccattcaggacataggcatgggcaaggacttcatgtctaaaacaccaaaagcaatggcaacaaaagccaaaatggacaaatgggatctaattaaactaaagagcttctgcacagcaaaagaaactaccatcagagtgaacaggcaacctacagaatgggaaaaaaattttgcaatctactcagctgacaaaaggctgatatccagaatctacaaacaactcaaacaaacttacaagaaaaaaacaaccccatcaaaaagtgggcaaaggatatgagcagacacttctcaaaagaagacattcatgcagccaatagacacatgaagaaatgctcatcatcactggccatcagagaaatgcaaatcaaaaccacaatgagataccatcttacaccagttagaatggcaatcattaaaaagtcaggaaacaacaggtgctggagaggatgtggagaagtaggaacacttttacactgttggtgggactgtaaactagttcaaccattgtggaagacagtgtgacgattcctcaaggatctagaactagaaataccatttgacccagccatcccattatcgggtatatacccaaaggattataaatcatgctgctataaagacacatgcacacgtatgtttattgtggcactattcacaatagcaaagacttggaaccaacccaaatgtccatcaccgatagactggattaagaaaatgtggcacatatgcactatggaatactatgcagccataaaaaaggatgagttaatgtcctttgcagggacatggatgaagctggaaaccattattctcagcaaactatcgcaaggacaaaaaaccaaacaccgcatgttctcactcataggtgggaattgaacaatgagaacacttggacacaggaaggggaacatcacacaccagggcctgtcatggggtggggagaggggggagggatagcattaggagatatacctaattaggagttaatgggtgcagcacaccaacatggcacatgtatacatatgtaacaatcctgcacgttgtgcacatgtatcctagaatttaaagtataataataaaaaaaaagacatacacggaaaaaaggaacacaaatccacaggaacagttggtggactgtgcctttttccgaagatgtctttaagggcatcaatatttaaaggagaacaggctggaaggaagaaagggagggcatggtcacgttactgaatccacatgttgcaaaagaaaaggagcaggtaggggaatagtcagttatgtattcctcttgcgcttagtacatcagcacttgataaggtgaacaccaagagctacctgtggaggttttcaccttttatctgtagctatcttcgtttcttgcatcactcagctttcagcttaatttttcccttttggcagagtgaattggggtccaaagattttcatttccttttacacctagaatcctctgaggagcattagcacctgctagtgccaggccaaccccacacccacagatgacagtctatgagggtgggaccctggctttgagtctgcacacccagcaggtagacgaggctgagaacccagccagacttcaaagcttaaaataatattatttatttctaaacattgtgtcggtgttttggggggtacaataatctattttaagcttcatggccatcctgggaggtaaataatattattgaccatttctaggtgaggaaactgagtctccaaggggtcaaggtcaaggagtttgcctaaagtcatttaggcagaaattggcaaaaccaggatttgaatccaggtctgtttgtgtccaaagctggggcatttttctcctaccacaattggggtctactggagagaaaaattaaaacctaacatctggattagtaatgcagcagtatccaccatctccctggaaacatcacggcagttaggggctcacttcccttcccctactctgggattgggattgttgatcaaagccatgtagctttagtgggataggtcccagaccaggatgggacaggcaggacagaaggcccttgtgaaagagacagtttggagggaataataaggatggtgaggtagtgaggtggagagtactgccacccagtttggagggaatggaggaatactggacagatggacaatcaaaccgatggacaggcagatggatgggttgagggatggatgatgaatggatggatgaagggaaggaggaaggatggaagaagaggtggatgggggatggatggagagatagatgagaaattgatatacggatggatggattcatggatggtggatggatggatggatgacagatagtgagatggatggatggatagatgggtggatggattgatgggtggatggtgaatggatggtggatggatggaagtatagacagagagatggatggatagatggatggatggatggatggaggaattaatggtggagtgaaggccagactgtgcctttcttatctctgttcagtgtttctgaaggtcattgtcatctctgtatctcaggagcctctgtatcttagcagctgtcacagaataggtgctcattaaatcctattaaaatgaaagtgtgacccacctggcccctgagtgcccctgagtgccagctgggtcacagtccattttaacagggtttaatgagcacctatcctgtggtatagaaggtaactgtgcacctccttttcatgtatccccatcatggctaacaacagcctagacatatggttctcaatcctgtgtgtttagtgttacagactccatgctgcccactctgcacaaactgtggaaccaggggaagtccagcacagttatattttagggctactggtggattccagtgtatagccaggattaagaacactggcctgtaatgcctttctgggcctccccaccccccacatatggttgcatctatttgctgagtcaagtccatctgctgggtcccagggagtgcctcctcctctcccagctccaccatctctcctgagtgagggcaggagcatctttccagctgcctccctgggctccatctctcaagacagtgggagggcttattctcaagtgcttgtataatttgttggaggctcgctctaaaaagtaaatataatttcttggttggctcaattgcaggtgagagcccagatgtctctgcccagaaatggagatacatccatagggacgcacccgcccctgccatctctcaggtcctacatgcataggatgctccaccgtggggagccagcagggctttgcagagcatctcttgtctctgacctagctgtttcctttgccacacccaccctccccacttcttggccaagacatgggtgaggggccccttcttgcagaagcttctagaagcctctggccccagtgaggtcccctcccctgtactccccagtgccgcccaccctgcccttggccccagaagtgctgcagcccacgtttctccacatcgtcctgtcattagccccttgagtgatggcctattggcaggagcagagcgaaggaatcctgagaggggcccttctgcccctcctggcccagcaggctggacagtaagcttagccccactctgagcaccgcctctgtgctggcacagtggatggagacccttgagttctgcgggggagagaagaggtgtccctgtatttgaggagctgagccaagggggctggaccacaaggaagcagcttagaggagcctgtgtggggatgaggggtgcctgggagagggccctgggccggtgggggttggggggaccctaggaaagtcgtctaagttccctgagcctcggtgtcctcaaatgaacaatgagacccggccccagctcctccccagggttgtgagattaaaatgggatcgcacacatcagcccctcagggaagtttctccctaaagacagcctttgtcttctccattcttggttcaggccctctgggaccgcgtctccaccatcacacaccggcctagggctgcactcttggaagggcccctgcgcttgcagggtgggcaggggaccctcgcttcacctgggcgtcctctctgatggggcccaggaaggctttgcagccgggggccatctgaccaggtcttactgggcccaggcagaggtacgtggggcctggagaatggcacagggggctgcagcggagagagactgtgggcacaggtgtggcgaggccaggccgccgagagccaagtggtttgcgaaatttcctggtggtgtggagggaggaaaagctgatgtgttcacctccccactcgctgtttgcagcctggaagacgattgcagggggtggcagggctgaaaagacaatgtcctcattaaaggaaattgagaaagagagtttccttcccagtggggcgggacagtgcagaaatgcggccggtcctggaagaggtgggggcgaggggtcgggggctcacacgccctgcgatttcctcccatgagaatgggcgggggcagctccgggaagggtggcggatggagccgccctctccccaggaccacaggggcgctttccagtgaaggcgccgtaggaaacgccagtctgtgccgcagtgtacgtagaggcgctatgagcccgagtttcccacgtccagggacaaactgggagccgtgactgtcaggccgcgcggaggctgccctggccgcctttgcggtcaggtgaaggcgcagaggcagggaggccgggcgagcgcaggcgggcggagagcagaccacgcggaagaggccgagagagaaagcggggcacccggccgggggggtcatttacaagggacgctgggcacgaaggaggctggggcgaagatgagtccaggggttgggttgagagcgctgcgcagccgggctgagaagagaagctgacgagtgactcccgacaagggacgggggagagggaacctgggggcaggcagaggcctagggggtgggctctgagggcagccactcccaccggccctcccccagccccgcaggccagccacatgccccgtgctccagacgacccagctacatggatggcagcgtcctgaagggggatgatcggtagggagtgggtgcggaggctcacgcctgtaatcccagtgttcggggattcccgagcgggaggatcgcttgagccggggaggtggaagctgcagtgatctgcgccactgaactcccgcctgggcggcagagtgagaccctgtttcaaaaggcaccaggggtgtagggaaggagcgatatcccccaggcaaggaaggctgcggaggggccaggccaggagagaagggccctgagctcagtggacgggcagggtgcctgtggaggaagggagggacgtagcagcaggaggaagggtgaggacccaggctggggatcgggagaagtgatggcggaggaaagagaggccggaagaggagggggcctgctggcctggcactggaaagcaaagcgtgggtttgtatatgggaagaagaccacatcccctcttatcgtcatcccaactcagaaaccatttggccccaagtcaccaaagcactcataggaaccacttttcctgtgacacaagtaggattctcccacttttaacttcccaaatgctacccgaaagcctctgaaatccttggaaatttaaaaaataatccccttctattaactgatgcctataaaacatattgactttcattaaattttgttatgaaatcagggatgtgtcccattgtaaaataaatttgtttggaaaatgtagggtggtatcccatctaaaaatcagacgaggctagaaaatttcaattttatttgctaaggtagcatcatgttgttaaaaatgcatcataaaataagaccaagagttaatacaaagcatgaagtcatgtttccctcaaaaaaatgatttgttctgtagtcaaattaatttggaaaacattgcaaactcttcagcagtggttctcaaagtatagcttgcgtcagaatcccctggggcccttgctaaaatctggatggctacactccccgcctagagtgggttaaactcagtgcccactggcaggaaactgaaacttggctgaagtcaccgaggaggccttccccgttaaacctctggctggcgacagcttggtttcctcgccgctgcttctgagtaattctggcacgcagttcctcctagccacctgctgtacctggaagggggccagccctcctcagcaggctttgctcctgccctgcacagcacaactgtggcgtaaaaaatggaaaagctggtagcagaaggaaagagcagggagacagaggttaggtgaacctcaatggcctcattaaagcaaattgagaaagagagtttccttcccagtgaggcgggacagtgcagaaatgcggcccgtcctgggagaagtaggggcgaggggtggggggctcaccgggcacatggccaacagctggtgcccagcctgggccacagtttggcacaggagaaagctgaagatgcaggagaaagctaggtcactgcccctaggccaggtgatcaaggtggctgttacctgcctgtgtggccttgaaaaagcctggtgccctctctggcttgcagggtccttctttttacaaaagcgggtcttcgaagccctgaatattccagttatctgtaaggatatagaaatattttgcctctagatgacatgtaaatatgttcctcctaactccacttcttcctacatctgtggcttcttctgagaactaccagacccaccctgttttcagagtaaacctcctgttttgaggtcaaacagacccagctgggtaattggtgactcactcctggttcctccaaagaacaggggcaagggaccacccgggacctcaggtgccccagcacaggacctctttctggggcaccctctggcactgggccatcttcaggccctacagggctctcggggcctgcgtaggcctctcatctcccagaaataagttcttttccccacccagactgacaccagatgctacagtgaggtttacccctccagcttgacaagcattcctagcccagaacactcagctgacgaggggtgctgggggaggaaggaggcagcaaggctgaaagaagcttctctgggtattccagtgcctggctgctggtcgtagccatggtgagaccacagcagcctccctggaagcaagcacctgtgtaaaagcccctccttccccacaaggggctggatccaagtgaagaaggtaccagaaggactggaagatgatgctggtattattcgacagctccagggtgctgtagcactgagcacctactgtatgcagcccatcacaaagccagccacactgcccaggctgtgccatggcaacttccagcagtacaccctctcggtcacctgcaggctccttgttcatcctgacacatgaggagaaaaagacagtactcacaaaggcctctagccttgtggccccaggaccctctcctgagcatcatggcctcctaggagacccagggtagccaggacaaaggagagaagcatttgctaagctaagaaaggatggaaggggattgctgttctgcctggatgcacccctagacctggcagggcaggcaggagagacccccagtgtctcttgcttatcctaggagttcccccctgtggttgctccagtttgctgccttcatgcatgttcacagggtgattcccctgagacaacagagctgggatgtcaccaagccctgtgtcccatcagccaggctctccccagcctccatcctctcattctgctggatcaggaggatgtggggaggtccctgactccccagctttccccatgacaaggtgtgtgtctacagctcagacccagccatgctccacctgagaagtgggtccaggcagagcactgggtcctggccacctagggctgcctcctcaggggtgggcaggaaggggagccactggaggagtgccccgggcacagtcccctgcaccaggtgaggtcacctcttagtccatgaggcgatgctgcatgagcccctctggacactagaaggcctgggctcaatgctgagtaaagtgcaggcatgactgtgccctcagcatgcatagggcagcaggcatagattcatacacgtgagtttgcacttaagctgcagtaagagctacagaggaaatgaacagagacagcatcactccagtgagccctccagatacaccccatgtgcgcagtaagagaatggcatagtctattgggacagccacatcaaaataccacagaccagatggcttaaacggcagatatttgtctctcacaggtccggaggctagaagtccaagattagggtgccagccaatccacttgctggtgagggccctcttcccagcttgcagatgtctctgtgttcccacagcatggtcacgtggcagagagagggggacagggcatgaataagccctcggtgccttcctcttcttacgaggatgctaatcccatcacgggtaccccaccctcgtgacctcgtctaaccctaatcacctcccaaaggccccatctcctaatgccatcacactgggggtcagggcttcaacacatgaatttggggagcacaatttagtccacagcagaaaagaaaggggcacagagcattccagcctgaaggaaacagatgtgcaaaggcccaaggcaaaggcctgagctctgaggggcaaccagagtcaaggctgaagagtgggcagtgattgagcactgacggtggagaggcaacaggctatcttgttaatctcagtcttttgtgtgccagagagagaaactgaggcacagtgtgtcatggtgaacactgggcagcactcccacgctcctgtcctgcactctgcagggttatggaggaagcctgggaagtctctcccctcttttccacctttcctggacccatcccacaccctgcctcctccaggaagccctggggattgctcatacactcacatctcactccttagtacctgcagcctgcattctgaatttagcaagctctggccttgggtttctattttcttgtcctgtgcagtgagcatttggaaacttctcctcagcaccaaacacggagccatttagcagaaaatacatgagttttcaagtcaattgaactgttcatcgccccaaaagccaggcaacacggtagagcagctggatctctgttcgtagaagctttctcagggactggcccaccgagtgggggactgcaagtgcccgatgagtgaatgaatgaacacatgtgtgaatggaattcaaggcactgcaggctattctggagggtactggcctgtctcttcgacaggtgaggtgcagtagaacagcatcccgtatagatgccagtttctgacctggttctgaaaagccagtcacctacctctgcagagctgcctggagggggcgggggttgtgaggacccctgagagcttggtgtgaaggggctctgcagagggaggcatggctagtgtgcgcaaggtgacctctctcctggtctgcaggatggagaacctgttcatcaaccgcttcatgcacatgttccagtcttcttggaatgacttcgccgactttgagaaaatctttgtcaagatcagcaacactatttctggtgagtgtgcctctgggggcccaagtggtgctggggacaggggatgctgctctcctgtctgatacttgccgggaaattgacaagggccttcctgcctgctgcagcatgggggcctcgctgccaccatgccaccctggacagcaccccctacactccacaccttttaccatcactgtggtcacccttgtgcccagaggtttctcctcctcagatattcaagctcgagcaccctcaacctcatttcactatcaaaagtctcaaaagtatcagaactttttcttggcacaaatcaatcatttgtgcttctgaacagagcaaaggcagaacttggcttgtgttttaggtatttacacaaaagcaactttgggttcctttggactaggatgtgtttgatgagagcactagcttcatagtggccagtcatggcatgggaaggacgttaggaaggcaggaatggctggacaagaagaggtgctgaaatcaggacatggggaaccaaacttggcaaactgcccccagggactctcctccacgccctccttcttccatcctggacactccatgctgggctgaaggacctgagtgctccaggaggcttctgagccacgaagggccagctcaggtatgatgagttggtgccacagcctgacccagtgatgggcagggggcagcagttggagctgtgcccatccagggagcactcgggagaggagaccaagcagggactctgctcttaggtgaggtcaggagggccatggccctggctgccctctactcagagctcagggtgggcctcgcttttctcctggtagagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccaggtaggggttgatgggctggggaagtggccaaggtcacagtctgtcaggtggaagccagttcctcctggccagtgctcataggccaccaagacgctaactgcaggcccatctggcctacagcagccgcttccttttcctggcagcagtgtcagccagggtcctgggcattatgcagactgtcttgtgcaacatcagaggaggaattgcggggaatgtttctccatgatgctcgagtctgggaacataatgtcaatattttcactatcagtatcaataattacaggagctacccttgattaggggcctgtggtgggacaggcattgtgacaggtgctttacacacaaggtcatcagttgtcacccaccttgcaaaggggagaacactggagaaagaagcagaccttgtgtgagaataaaaaaggggcacgaggagaaacccaacagaatggttgattttctcgttagaaatgctgctgcccatgctcctgtcgcaccctcctccccaccctcacctgcagactcagctgcctccggctgcaaggctgacctagtcttgagacagaagaagttcaaaccaactccacctggatctggtggggctcagcaacaggcgctggcccatcagcctgcctcttccccatggatccagcgtgatggggcctcctgccacccaggccctgctgcctatccccaggtgtccaggtggcctctgctgcttccagtcttttgagctcagcttaccctgaggccctagttggagagggatggttggtgccctttagagataaacctacagccccagtacctggcccacctgaatctagagggccacccacccagctgaagtccctgggcaagtctcctgccccagtgcaggcagtgtttcctaacctcctcctcctcctgcacccaaccaggcccagaacacttcctggtcatgtgaacagctgacagttacaatcccccacacactgagagagcatctgtgttcctgagtggactgaattgctagatgtagtaacattgatttggtggctataggtttcaaacttcaagtcagagatcatagaactttaagccatatagaatcctagaattggaagactctgagcagccatctctgcacccagcagccaaggagtggccatcctcagcacctggcagggcatcagcctcccactgggagtcccggccacctccagggcacgtgggttatgagtcacctttcctttgagctgacccacccctcactgactagactcttaaacacacactgccccgtctaatacacaccagcatgattcttaatccccacagtcattcacgctgcccatctggcagcaccttaatgatctacagcaagcttgtggcctactaaaaacgcctccattgttttttaaaatgtgcagttattttccggatcatgaatagagaaattgtatccctgttgttggtattgattcagtgttccagctcaagtttgagttcttagactttatatttggattctttggtttcaaatcacaaaaatcaactccatctggtttaatccaagaactctattggctcaggcaacagtaaaaagcaatgctaactcatttgggaccagggctcagatcatcccctgcactgtctctctctcgctccatgtctcaatcctctgcctctggtgattttttccttaggagggtttccttatgtggaggtaaaaaatgatcaccggcagcttcagatttaccttccaccagcttagcaaacaccacccactcccagcaagaaagaccctgtttcccaatgctcccagcagatgtcttaggccatcctcgggcctcactgattctgtgagccagtgcccacggccaggagaatggaatacactgacctagaggggacagggactctagacaggcaaaaactccactgtcagaagcagaatcctaaaatgtcagaactgaaaggtaggcccgcccctcgttttccagaaatatgaaagggaggcttgggataacagagaaatgctgcaggcattggccccaaatctcaggcctcctattcccagtatcaccttcaccagcctgggtggtctcaagattggattagcagccattccttctgggtagagtctgatggtcacttcagctctcaaagtccagctatccagccatagtcctagaaggcaagacatcactgtgcccgaccaacccaagggtctccacctgcccccctcaacacaaggtgccctgagtgcctccgcggggatagtccccgtccccacccctgcttcccccgcccatcgcgacagatgctcagagctcatccctggtgtcacaccacataaaggaggagggcggtggccaggctccgagctcctgccgtcctgggtgggtggcttctgtcctgcgtgccgccgggcagcccgggggtcctgcgcgcgggcgcggtcggtggagctgcaggggggcgctctgggatgtctccaggcagagtagatactgacccctccgcagccgggaccctcaccctttccttcatcactcaggaaacagaaaaggcttcagaaggagcggccatgcccccggcctaagcgctgcgttcccggcccagcaggcctaccctgcacctggcgttcctaggggcccctctgcgggacccactgcgcggctcgcagcggccgcccgcctcccacttcaccggcacgctcgttgcgtgtcgaggtgtgttgactcctacagcaaagggcacggatccgcgggtcagcaagcccgacgaatttacaccaatgacccgccgtgtcgccagtctcagaccagggcacaacacgccaaccctgcagaccacccccacctccccagccactgcagacccttccccctctgcttctgcagcacctctcccgaaacacgctcattcccgcccccgcagaccttccctacctcctggagacccccctcaacccctgtagagtcccctgcccgtgcagaatcccctcccccttcccccgcagcccccctaccccacccggcggacagccccgcctcgcttcctgtctcttcctcccaagggagacccctgtcctggctctgactggggttgagttcgccagttttgacttatgtgtagagtccggcagcatcattttttggcatttaactcgtcacatctatttcacctaacctctttcttcttagtaaactgacactcgggtcggtctctcatctttcgtgccagtcaagcaggtttcagacaccacaaatgccgaatgagctgctgccattccttcatcttaccccgaactgccacaacctgtgaacaccttccatgtgaatcaatcagccttggagtcagaggagagaagtacacattctgagctccgctgagtcgcaggaaagggagaggggtgcccagaggtcatcactctttccccaggcctgatttttggtccgtctgctgagcctgatttggacacatctctctgcctcctgcagcaagggaacattttcatcgtggactttgagctgctggatggcatcgatgccaacaaaacagacccctgcacactccagttcctggccgctcccatctgcttgctgtataagaacctggccaacaagattgtccccattgccatccaggtaggctgctggggggcacacctttctgagcagctcagtcctctgcgatccagggctcctgggtggctccattcacactccagctgaggaagctatgtcttgaaagacactagggcttcctgcaggccctgaggtgggctgtccataggggcggagagggttctactccccaaggcacacttgagaagcccctggccagtcgaggcacactgtggaggacctgccctgggatcatattctgcactctccaccccagcaccctgaccaagggcccccagtcaaggtgctgccaggggccaggcaggtgaagctgtggactaagctggagaccaagaccactgaggggcaccatgggttctggggtcaggaaccaggccagtcctggtatgccacctttgatgatgatgtgagttcttatgtccaccggagatgaggcaggaggaagagggagaccctggaggaaaggcaggcgggcacagggctttgtctccccctgttcctggcaccagcctgctgccaggctgggagctggtgtgcagacagcaggggccaaggccaggactggactgggcataggtccctgggagtagggaggaactgcgcagaggacaccgtgggagactggcagatgagcattcagcaaataatgtccatgaactggaccttgggagctgtggacacaatagcagctggataggtcaggcaccagccacatgccaaggctatcctatgggttaacctgcacagtccgcaatcccttaccctcgattctaaatctaaaaaatctgaaaactgctgcatatttcaaaactgtgcagcaaattcattgtttgtaaacaaaccttctttgaagcaataggtgaggttatttagaggctttttccattcaatgtgatatgtatgtggatcactgcagaaatactgctctgttcgattgtaaaatagtatgttgccctagactgggggtgggagggggtatggcacataatgaagtatacccactgctaaaatcctaaaaattctggattctgaagcacatttgaccactggggttttagataacctatctttatttgtgtaatcatcaccacaaccatcctaggtagtgggctctattgatgttgatcattttacccagataagaaaactgagacacaggtgcccacagccagccacagagctaggattcaagccaggtcatctgactctagattccagcctccccacagtctcccaggggcacgtagcctcagaggagcttcctgtctgttaccagagagaagccctgtgcctaagaaactgaagcagcaggtaaagggacaggtgacctaaaagaagacaaaattgctgggagatccccggagatcccaggcaccactgatggtgccttcaaaagcttggctcagagatctcttggagcagcctggagtcaggggcctagcttaaattccagttcagccacttgctagcaggctgtgggaccttgagcaagccacagaatgttcctgggtctctttcttcttctgaaaatggaaactttgcaaactataaagactcaagcaaatgaaagccagaggatagtaaatccaagatctggttctttgaaaggtccaaaaaataataataataacctcctcatgaggctgatggaaaaaaagagatagaaaaaaaaaatgcaagattcggaataaaaaaggaatcataaaaagagtaattatagccaggcaccatggtggtacacaactgtagtcccagctacttgagaggctgaggcaggaggctcacttgaggctgtagtgtgctatgatcacacctgtgaatagccacagcagtctagcctgagcaacatatcaagaccccgtctcttaaaaaaaaaaaagaacagtaattatgattacatattttttaaatgagagtaatatggcaaaaatttgaaaaattagagaaatggataaaaacctaggaaaagataaattagaagaaattgtagaaaataggccaatttccatatagtgattggaaacagacctacacagcgagcagctgagtctcacccagccactagacagctgacatttccagggctctttatcagccccaaattgatcatataaagctggtgtaagcttagttctgaaactggatacaggcaggcttcaaaagaaggctgaagaccaatccaagtattaaataaagatttaaaagaaaactaaaggtgatattagcgaagtgagtgcagcagtgtattaaatgactatatgtaataaccaagcagggtttattccagatatttcaatatcaagagagctaccaccataatttattatacccataaggataaagtttatgattatatcaattcacactaaaagggaatttaataacatttaatagccacaactaataaaaattaataggaggaaccttactttatatgataaagatagctaacatcaaaaaggtgcaactctaatgccatttccattaaaataataagaatgctgatatcactgtttttattcaacattattttagaggtcataccacatgataaaacaggaaaacaatcaataaacatattgtcaaagaacagggaagatgatcttttctggtaatgctatggtagacctagaaaacacaagagattctaatttttttaaaagctactagattaataaattcatttggcaaagtgtttagataaatatatttctcaaaaaaatcaatagcctttctccatactaacaataaaatataatgcccatataaggaaaaactataaagttatttatttatttatttatttatttatttatttatttatttgagatggagtttcgcactgtcacccaggctagagtgcagtggcgtgatctcggctcactgcaacctccacctcccaggttcaagcaattctcctgcctcagcctcccgagtagctgggattacaggcacctgccaccacgcccagctaattttttgtatttttagtagagacggcatttcaccatgttggccaggctggtctcgaactcctgaccttgtgatttgcctgcctcagcctcccaaagtgttggcattacaggcgtgagctaccgcacccggccaactataaagttattttaaaggatatacaatgaactcttaacagtgatttgatattggggaggaaactgtaaaaatgtcagttctaccaaattctattataaaaacttaatgcacttccaagtaaaatttcagccagaattttttatctttcttggtgggggtgtggtggtggtgaagaggaactaaaaaggagagaaaacaattaaaaaattgaaagattcatatggaaaaagaaatctagcatagtcaaaaattttttgaaaaaaattaaaaccacatagagaggcagggcaaccaagtgagacctcatgtcttaaaaaaaaaaaaaattaatagaaaaaattaggtatggtggcgcatgcctgtaatcccaactgctcaggaggctgaggtgggaggatggcttgagtccaggagtttgaggctgcagtgagccatggtcgctccactgcactccacactgggcaacagagtaagaccctatctttaaaaaaaaaaaaaaaaagtaaaagaaaacacagaaggaacactttccttgctggatttgtaaggttactgttaagcagacactgtgcttgaaaacagagagaattgggggacagtatagagtaagatccagaaatggactcccccacagaggaattcagtgtatcacaatggaggtttttcaactcagtgaaaaagggatattattttaatgatgctatcacactgcctttgcatgagaagaaaattaaattggactgctctgtcatgccatttacaaaaataaatctcatcatgtagaggagttgcttagaagaaaaagaaaaaattcagatgaagtaaaaattaaaatgaaaaaagtaaacgaatttagaaaaactaattacgcagacactcagaagacttttagaaggaaaaggaaaccaagaagttataaggggaaagctaagcatatttgattatgtaatgttttaaaacttgagtgataaaccataaacaaagccaaaaagcaaaacagagattagggtgagtaaccataacagaagtgacagctaagagatgcctatctatgatacacaggtagctcctttacattgacgggaaaataccaatactccagtggaaaaatgagcagagaatatgaataggcaattcacaaaagaagaaatgtaaatgggcaaccagcatatggaaaaactcctaacttcacctgtagttagagaaatgcaaatgaaagttaacaatgagatatcatttctgacatgcctggttggaaaaacaaaggggtaactcccagacaccagcaaggacggagccccatgctctgctcatgagttgttgcagcctggcagtgttcacgggataactggtgggcctgggcagcccaaggtcagagcttcggccagcaccggagcaaggtcagagcttcggccagcaccggagcagatcccacagcgcctgctgtaccaggtgcatgttgcagtgggcggtcagagggtcctggggttgaggctgtcgtggcgaggacagttgtgttaccgagctggactgggatctgcttgcccagtgcagcaaaaccaaacactgagattgggatataatctacgagaacacaaggcatttattgcggggaccaaaaaaggagaattgggcagctcactcttaagaccggaactccctgatggcttgcaggtaagggtttttaaaggcagagtgaatttcaggaattgcagaagttaacaggcaaaatcattaatcaatacatggagggtacacattggttttggcctaaaagggcgggatatcttgaagtgggggtgggcttccaggtcataggtagattcaaaaatttgttgttttgaaattggttaaggaagagaagtttcatttaaaaatttgggttaccagaaaggaatgttagctgtggcttgtgggcgggacttcccccaggccccccaggaagaaatttagaacaaagagcctgctcagagttcagtcctcagttccgtcttatctgaggtctctgtgccagtggatcggtttggtgggggtctgggtttctgaaaaacaactcagagacacatgttcaggggttctctttagtttccagagggaaccaaacagcccaggactctggcttccttggctgttgttttaggctgctgttaccctcttgtttgtcaagttgctcatttatttctcagggctagctaggtgcctggaacttcccttcaaggaactcgggattttccttcatttccatgccctgttgcggggctggggggctacagtgccctaagaggaggcccctgccccgtctcaattggaggagcactggaggggactttattgtttaagtgttctgacagccagtagcactgaacaggtgtgcaccaggagagtgaaactgtctgaggaacagtagggcaggcactgtctactcgaaaacatacccaaacccccaaggctcagccttcgctagcagccactcagcagaaatgaaagcacaaatgtgtgtgggtagcaacaggagcatagtttgtgatggggaaaaaaattgaaaacagtctgaaggcagaagaggattgagtgagtgagcccttccatgtcctcaccataaaatgttgaggcgtctttgaaaggaatgctttggttcccttccagctgacctggaggggtctccacaatgagttaacagtggaaaaacaagacacaagggaccgataaaggatacatatctgtcgtatacaaatagctccttcaaactgctaaggcaatgggcatggtctcacttatgtaaaatgaatgcaaggatgcagcaggcctactgtgccagcatggggacacaaggacgcagtgtcaccaggtaggaacacagtgatggcccagtgggggacaggtgagcaaaacaaagagacagatgttgattataatcatattcagttgatggaaaattggacagataaatgtgcacacatgcaaagacctatgaaaggaggctccccagaatttggtggttatccctgggcgctggaagatgagatgatgttttctttctcaggctctcctgtcatgactcagatttctttttacgataagcacatattcttttctaatcagaaacgcaaagctacttccttacccaaaaaacaaatttaagaaacacaaattgctcagggcaagttctggcatcccatggcaggccaaaatcctggacaggagtgggaggatgtgaaggatgggttggggaaggcccagctcagtggtacaagagctcaaggagatgggcaggtgaggcccggtcaggccgggaggtgaagagaagcagaagggagagtgatgggctgaaataggcagagcactgggcccatcctcattcagctctttttttactggtcagaacagtttttttttttttaatatataaaattttagattcaggtacatgtgcaggtttgttacatggttatattgcataatgctggggttaggcttctattgaacccatcactcaaatactgagcatagtacccaatacccagtttttcaaccctttcctccctccctccccttcctggagtccccagtgtcttttgttcccacttttatgcccatgtgtacacaatgcttagctcccacttataaataagaacatgcagtattcgattttctgtttctgggttaattcacttaagattatggcttaagtgccaatcctaagctgcatccatgttgctgcaaagaacacgatttcattcttttttatggctatgtagtattccttggagtacatgtatcacattttctttatctggtgccactattgatgggcacctaggttgattacatgattttgatattgtgaacagtgctgcaataaacatatgtgtgcctatgtccttttggtaaaacaatttcttttcctttgggtaggtacacagtaatggggttgttgggtcaactggtaattctatttgcagttctttgcaaaatctccaaactgctttccacagggatggaagtaatttacactgccaccaacagtgtgtaagcattcccttttgtctgcatcctgccaacatctgtcatttttttactttttaataatagccattctgactggtatccctttgtggttttaatttgcatttctctgatgattagtgatgttgggcattttttcatatgtttgttggccacttgtatgtcttcttttgagaagtgtctgttcctgtcctttgcccactttttaatggtggtgttttttcttaagttcctcatagattctgggtattagtcgtttgtggatgcatagttgcaaatattttctctcattctgtaggttgtctgtttactttgttgatagtttgttttgctgtgcagaagctctttaatttgattaagtctcatttgtcaatttttgtttttgttgcatatgcctttgaggtctagtcataaattctttgcctaggaaatgtccataagattttttcctaggttttcttctagaatgtttaaagtttgaagtcttacatttaagtctgtaatccatctagaggtaatttttgtatatggtgagaggtaggggcccagcgtcattcttctgcatataggtagccagtttttccaacactatttattgaataggatgtcctttccttattgtttatttttgttgattttgtcaaaaatcagttggttgcaggtatatggctttatttctgggttctctgttctgttccattgatctctgtgcctatttttgtaccagtataccatgctgtttttgttactgtagtcttgtagtatagtttgaagtcaggtaatgtgatgcctccagctttgtatttttgcctaggattgctttggctattcggctattttttggttccatatgaattttaggatttttttttctaattctgtgaaaaatgatgttgataatttgataggaattgtgttgtatctgtagattgctttcttccaacccattagctgggatgtttttccatttttttgtgtcatctatgatttctttcatcagtgttttatagttctctctgtagagctctttcacctccttggctggatacattctttggtattttattttgtgtatgggggactattgtaactgagatcaccacgttcctgatatggttctcagcctgaacctgaacattgttggtgcatagaaatgctactgatttttaggccaggcacagtggctcacgcctgtaatcccagcactttgggaggccgaggtgggcagatcacctgaggtcaggagtttgagaccagcctgaccaacatggtgaaaccccgtctcaattaaaaatacaaaaattagccaggtgtggtaacacctgcctgtaatcccagctacttgggaggctgaggcaggagaattgcttgaacctgggaggcggaggttgcagtgagctgcgatcacaccactgcactccagcctgggtgatagtgagactccgtctcaaataaaaagaaatgctactgatttttgtacactgattttgtatcttgagtgtagaaagtcaaaagttttttttttgttaaggagtaaattatgtgttagaaataatagttttttctaaagactaactttttttaagccttttcgctttgtgctaataactttttgttaagccctatcatatgtagctgttagatataagggaatgagtacattctatgtccttgtactttaaccaagatatttgtgctggacgtgctcacaggcatgtcccagcttgcagcccatgccccttccttatttggaaatgttattacttttctaagtcctttcataagcaacttcctcttttcctttgtctttccactgcttttacctatttagaaaagttttaagttattagccagtcgggttttagtttagactgtgaggtttggctccagccaatggagacaggacacggtagcagggacaagctgcgtaaggaataaaaattgcttctctccattattcaggtgtgctctcgccattgttccatctgcgaggagcaccctttctgcagaaagtaaaattggcttgctaaaaaaactttttgtctaaatgctgatttttccttgcagtaccgaggaacaagcattctgtttctaaacaagcattttacttataacattgagactttactgaagttgtttatcaagtctaggagtcttttggaggaatcttcagggttttctaggtatagaatcatatcatggatgaacaaagataatttgacttcctctttttttttttttcatttggatcccttttatttctttctcttgcctaattgctctgactaggacttccagtactctattgaataggaggggtgagagtggacatccttgtcttgttccagtttttagggggattgcttccaatttttgcctgttcaatatcatgttgccggctgagctctttacctactgtgtgacttgggagagctgctaaaccagctggagcctcagtttccccccatgtaaaatgggtacagcaaggaatatctgccttgcagggtcaaagtgaggattaagtgagatagcatgggtaaagcccctagcacacaacaggggggctcctcggccccagaggatgtcaggaacatgtcagtgtcccagagccatcaggaacatgtcagtgtcccagagccatcaggaacatgtcagagcatgtggggacatgtcagaaagtgtctcagagcatgccaggcagcccagcattctagggcacagatcaggtatcagtggcccaggcatctcatgcaaacgggtgtggcagtggggaccctgagagctgggactctgtaaaagggacaagagcgtagttctgtgagaacctgggtgcagagttctgagaccttctaatttttcaagaaaaccaggtcattcaaatttttatgtgaaactgtctggtatttaaaagcagccaactaatctcaagtataaacagacaggcacgcctaatgtgcaagtcacactctgctctccctcctccctcccccctccttggtcctcagggagtgctgaggcttctggggtctctctgaccagggtggagccactggccaccagggctctggagcacttgggatttggctcgtccaaaccaaaacctgctgcaagtgcaaagttcacacctgatttttaagacttagaataaggaggtggggaatgtgaaatatctcatttaatagttttagattggtttcatgttgaagtgataatattctggatatattgggtaaaataaaattatattattcaccggcatttcacctgtttccttttatttttattaatatggcttcctgaatatatacaattccatgtgtggggtagcattatatgtctattggacagcactgttttcgagggagagacgcccaaggaccccaccttccacaatacttatagcaagtgacacagctgtgtgctctgggacagttctccctccccagccatgaccactgtgctgcagtgacactggtctttcccagcacctaaagtctggccatgccccttcctggccgctcttggctgcagccctgccacccacctcattctttctgtcaacccctccaataccccatgtcttcatgtaaaaatgggcaatgccagcacctgctgccggctcccgtgagaactcactgtcgggtgctgaggctgtgctgggctctcaataagggggcaacgtgcagggctgctggcatggagggacctggggctgggtgctggtgtgggggcacgaaagtgaggctgtgtgtacagaggcatcagcaaccaggtcaccacagagcttggggattttattttctggcattaagaggtgattgaggaggcagttaacatgacatgatttgcattttggaaaagaaaaaaactcaccttgtcccagtgtggagtggaaactggaaagggaagacaggtccagcctctgctacaggaggtgcctggccacaggtgtgggctccaggcagagctcaagctgcagaccctgatctgggaggctcagtaccaggagggccccaagcctttaaacaggaggagctgacttagggcaagaaaagaagacaggagcaccagggcagaccctggggagctccagcatttcagggaagaggagagggaggaaagtatgagagaccaaggagaggcagtagaagagggagcagggcaaggagggaagagggggacagcgatcctccccctccgctgctgggccttcggcctgcccgctccttccatgctgccagctcctgagtaactgtgagccgagcgatcactgtccccacatgacagatgctgaagccggagcttagaaagcccagtgtgtcatccagagtcatgcaggttgtaagtaatatggctgggacaggaaataccaccgcagggccctttaccccctccaggctcttctgattccaaagtcactgttaaagaaattcagatacttctggaacttcccaagaggcgaagttctccaacaactatactctgaagtgaaatatagcagtgtgtttcctttcccccaatgtatcagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaaggtacagccagctaccgccccacctgctatgggagggcatctgagatgtggagtgggagggatcactgacatcccacagggggacctgtggctgggagtgggtggcagaaagggagccctggagagatgttctcagagtcagtaatgcccctaaaggaagaaaacagctaggagcctgctgttccccaggacacgcggctggggcatgggcctgacacacgggcctcgctggccagccagtagagttggaaaaggcaaatgagttcatggtgatcctcggctgatgctgatggccgcccctgccatcactctccgtccctgttctcgaatcctacaagcattggctgctggggtgactgcatgctaaaagtacccatgtgcctcagtttcctcaccagtaaaacaggtcaaatagtacagctgccttacagaatgatggtcagattaagacagtgaactcagggagcaaagaggtaagcattgtacaagtgctggccaggaccctctgaatcattatcatgcttagtaagcatcagaggggtgcaggcctccagcacttattcagcagaaagatcagcacccagccttcacttcctccctgcgcccagcatcatcctatagggcaggcctgggtgggggagctgcgggtccctgaggcaccaggtcacctgactgggccccctctgaggcctcctcctctcccctccccagctgctggtggcacacgtgagattcaccattgcaatcaacaccaaggcccgtgagcagctcatctgcgagtgtggcctctttgacaaggtgggtgccctcctaccctacttgttgcctggaagagcccagcctggccgccttcactccctatctgagatctagacaccctttcaggaggcctggaagggtgaaggctggagtctgctcagagcactggctccagcatcctcctgatgtctccagcccgtgccattcagccaggagcactcctccaggcgcaccaccaggtcttccttctcactgatggctcctggtcccctcctcccacccctcccctctcccagcctctgggacctgggtgtagacccccctctggaacacactccttatggccccctgacctcctacgcaccaggaacctgtgtctgcctcttaatctgccacacccctgccaccctgacctggacctccccagcactctgcttcccgggtcccaaccctcccaacccactgtctcctgcatcggggactccaggccctgcccagccctcgcatccctcaggtagcaccccacctcgttttgagccctctgtagccttaccaagcttggactctcacatgggcccttgccccaaccttcctcctttccccagcccattagtgaccaggccagatgaccactgaagttgagacactgtttgggctgcaaatgacaaaacccaactcaaaccagctgcagctggacaagacatgccttatctcaaatacctggacacaatagagggtcgggggcctcagccagaaatggatccagggactcaagcaatgccccagggtgcatgcacactggctccctctttctgtctctttcacctgtgttggcatcacactctcctgctgcagacaggcccccatgggagagggcacaggagctcatcatagtagctccacctcaggttctcatgtggccattatctcccagccgcatctaaacagaaagtgctggggggcagctctggttggtcctgcttgggctgaatgcccaccgtggaccaatctctggcaccccagcacccaagtccttcttcaaaacctctgtggcaccgacagcccagccccctgggtgtatttgcatgtgtgtgtgtgcacgtggacacacatatgtgccagtgagcttgtgagtgtgtctgcatcactcagaagccgggatcgggatcaggaccaggatccctccttgtgggtctctccagccctcacctgagcacacaacaggccctcaacagagttgcatgggtcctggaaactgagggtcactgagagcaatgactgagggtcgtgtgctcagcactagagcagacttcacagcccaggcccgctggtgctggggtcccccacacacctgcccacgcctgctgccctcctgtggctgggagcgcacccttccctcttgtactctgcagccccacggttcagtcccttgcattggattgggcgggaggctcctccctagcacctctccacccggctgcccttgtcattctctgcgttaaacatccctcccccatctcacaggacaagggcttgcacctctgcctgcctggcctcctcgcctcccctggcacatttcctcagggatgggtctggacagctgtgggaggagccacccgctcagggcactctacctcccactccaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgtgagcgcccgcggggcggtggtcctgggggaggagccgggacccctgcctgactacctggggcgggcctggcccctccaccgctagcgctgaatggggacggggtgggggagtcccagcgtccgtgagggggttgccgccgggcaccgctccgcagacctggctgggtcgcccaccccggctgcgccccctgagccaggttcacggccgaggtggtagacatctactacgagggcgaccaggtggtggaggaggacccggagctgcaggacttcgtgaacgatgtctacgtgtacggcatgcggggccgcaagtcctcaggtagggcctccgggacgtctccggacccggctcccccgcagtcggcagcgctggcccctccgccacccctccggggtgtcctgcccagggtgccctccggccttggggcagggaatccgggcacggggtgggcgccgggccctggggtcctcagggactgggcctcagcccgccggtggttccaccctaggcttccccaagtcggtcaagagccgggagcagctgtcggagtacctgaccgtggtgatcttcaccgcctccgcccagcacgccgcggtcaacttcggccaggtaggcagggccgggcccgctgggcagggctcccttctcaaggccgctgcctcctcccccgccccggttctgcacgcgtactgcaccctcggacagcctcggggcctggcacgggacttgcaggatggattctgcccgctcagccaagggcgctggccgcggggaaagaggatggacggactgcagggcccgctggagttggggggcacggggaggacggggcccagggggcagctgggcagcagggcttcgggggtgcccacgcttgctggcggtcgtctccgcagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgaggtgaagctgggcagggcggggcacagccccaggtcaccccaggttaagcggttcctcagcctcagggctttgtgactcgggccccaaggctcacttggagcaaaggaatcctgacttccaaggctggaagggcccagaaggctgcagccgccaccaggtcccccggcctcagcctggacagagctcagggtgtgcagggcaggagagcacacagcccaggctttgctcactgtcaccagagggtcgtgtgtgacgccccctccccccagctattgacaaagttcttgcacatgtgttttaccctggtactccagagggaatgaccaagagtttcctgggttccttccggacacgtgcatctcatttaacctaacaactgaatccggtgtgtcttcgtggatgcacccgctttggggtagctcagtactgcatagaatggccggaccagtccaacctgctccagactgctgggtgtctgagttgttcccggccaatgtgttggtccctcactggacatccttgtttttgtggctttgcacatgtgttcagtatgaccgcacacattcctagcagacaaattccttggtcaaagaatattgatactgaattgccctccacaaactaaattcaaaatcccattatcaatagcctatgtttcttggacctttccagctcagaagctttgtgatcttaatccaatacagtatttttttaaaatgatatctagctctgccccgcagacatctgtgtgagaatgcaaataagcacaggaccccaacagggcagccaccccttcaggctccctggcccgctttctgccttcctgggctggagaggccagtgctggccccagcgcccctgatgggaggtgagagtgctgcgcaggggtggcccaagacagcaggataccatggctgcaaacaccagcagcccccagcttcatctgcatcatctcgtaaccacttggcagcaggcagttattttcccacttatccatgaagccccagccctggagccttccttagagaagcaggttggaggcgacgacacttgccttcccgaggccctcttgtcaggcagcagagggtgaatatggggaggtgaatagatgctccctccttcatctcccaaacggtggctggccccttgggatgagacaggcctgtcagtttacacgggtagtggattgacctatgtgtgtgtccatgtctgggccctcagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaatg

SEQ ID NO: 2124 - DNA, 137539 bp, Homo sapiens
agcataggaatcatgctttaattgccatttagcatccactaattcccatgagatctgtgattaaaaaaaaagcctctggcctgcttgtcctgtcttaaaagtcatgagtctgttttatgaacagaaagaatgccacgcttcttagcatatgtaaggcaaaatggatttttgatctctcatgatgtaaaggagatacaaaggtaaggaagggaagatttctaagtgagactttttttgagtgtcaatcccgctggacacacatattacaaaataaagattttcttctgtaaagtgctgtttgctcagtgaatcatgcgccaccacagagcaccatggctccacctgctcaagagcatggaggaggcagcatcggcagagggcaggcaggagtctgtgtttgggggtctgtttcaataccatctcctggggttcgccgtgatgcagagggaatcttctcgtcatggctagacactccccaatgctctgctccaggctggggaccactgcaagctggaggcggctgggtatcagggcctgggcacccctgctcctcctcttcccttgggattggcattttattctctcattcagctcaagaccatgggcaggaactctgctggctccccatgatgtcatcatggggtcttccactttcccacagagctgccaggcagaggcaggacccaggcatgcctggcccacaggaaggttttctaggagactaaggagggtttagaaaaagagaagccactataaatagtcacctgtccagtctatgctattaaaggacataagaaaggtatacaattggcagtaaacaatttccttcagctcttcatggatgtccaggaaaatgacaacccgcacacaatcagacgtgaatgatttctgctccagtgtcttcaggctctgtgcaacaagaagagtttgtgtcggaatgacagattccatatccatgtttattttcaaagttgggctctgttagtggagatttttcaaaaatattctttttgcttgtttctggacagttttgaacatagatcactctattataggccttgagtctcttccacaattgcacatacactttacactgaacatacataaaaagaagtcctccggtgaagccgatggccacaaccaccaatttagtccaaaagggccattctaggattcctggaagggaaaaactcagcctattagattttatttaagatatgaagtaaagaaaaacacaacttctgaacttcccataatcaactgattctttgttgttgttgttgttttttaagagatggagtcttgctatgttgcccaggctggagtgcagtggctattcacaggtgtgatcatggcacactacagccttgaactcctgagcctcagcaatcctccatccctcagcctcaagtatctggggaccacaagcctgcaccactgaccaatggattcacaactcatccaatgttgctcagtcaaagaagagtggaagacagtgtccagctacttcctgcttttataggatgtagtttgcggagattctcatgctccagaatatgaactctcctgactgggtttcaaaaactaccaccacagcaaaagaaatgccaaaaaggaggctagtgcctcctaactgatgtccctcctccggaaacccagacgtttttggctaactggaaaatcctctgaccccaggactcctgtgagctatcccggcccccatgctgagcttgctccagcctgagaactcacctgttgcctgcccctgcttgatctcctcagcagtacggtcaatgagcacatacaaggaccagaccacacatgtgatggcaatgacgtggaatgtcactgagcacatgatcttcctgcgctcgctggacgtcatctgcaacttctcccactagaaagacaacacagagtgtgaggctcaggcttctggggaagggctccggtggggtgagagcattgtaggtaggtaagattggctttccaccccacttctcccttcccaaactagatgcattcccccaagtattgttctcctaaaaccacttggcttcaaccaggtaccaggtgcagccaactttctatgcaatgaaaagaagccaggatcaagatgaatgcagaactaccatcaaaaatccccttgtctgcttattcttgcaagcagacataagatggcctgataaagaattctatgatttcagtcctaatgaaaacagtatgttggcccaggacccaggtactacgttttaagtctccctgatgtgctgactggcatggacgagcggaagaagagggttgatgatgccacaacacactagcagatgggtcacactacattgtgaaggtgaatggcagaagacgctcactctttggtccttgctactttggcagcaacagctcgaaatcgacgctaagagttcctggtacaagcagactctgctagtcccatctcctctaggagctcattaatttactccaaatagccagactttctttttcatttactggtttccgaatcaggagaaaacacataaaggtagagagaaagaacaatgtgtaaacactctgcacatatcctttgccaaccctagtcacagcctctttccagatgagtctatgcagggtagttgaaaatagagcctcaaggacttcccatgttgagagattagcatagagtaggcacccaataaattacaaggtttctactgggcaaaacatttttttaagcagtttgcacaagccttctctaaatctggttgttttctgctgggattttatacactagcaagttccctggtcttcctacctataatacagagtcagtgcctcagtgccccatgctccctgctacttcctacaacgcacgtagcttgacaccctgtcaatgttcaccttcacctttctagggtatgctttactccacagacagcctgacctctctaaactccttgcactctgcctccaaatcctagtgatccttcaagaactgctctaaaacccaaacaccctatgaggctaccatcgctccacttccccagcactctagctcataatgagcatttccttttctgaatgactgttatgctctaccagcacaccatttagcatttaattggctagtatttgattatgtgacttatcttgcaatttatatattaatgttctgagataggaacagttttttattcttccagacaaaaccttttgtgctgggcatctagagagatatatgaaacagtcaaaatttaaacaggaagccagtgtggcggacaaagctcctctcagagggagcagtgacatgggcctccagacagctgcgtgtcatgcaatgcctgtgggtcctttctgaagacagttgcacatcacgcaacgtttgtgcttcctttcttttccctatccacctactcacactcccatccagcaaatagttatcatgggtgtatacaaataaatttactgtatgctacactgtgctgggtgctggggagatactaatctccaacagacagtcctaatcagagaagcaggacgtcaacagttaatatgtataaaattaggtgctaagatatgtcacaaacagtctgtagtcaaaggccagaggactgacaccgacaagcaagcagtcttactttgaagggaaaagaaggattatgaatggtcagaaagagcttcttcctgagaagagggacttgaaaatcagcaccagaaacaacaatctctacaatgcaaatgtaagcaccagccccagctttttaaggaaatgaacgcaggcaagccatgacctcatgatctgagacaccagctttctgggggtcactggtttcaggaagggtgaagcatcccttcctcccacgtacttttctcagtggcttcagcttggtctccatgatgaactcatacttgcagagctcgcagcagcgcgtgtcggagctcttgatccactgctgcaggcaggcctggtgcacgaagtggaggcttcctgtgcagtggcagggggtgatcagggggctctcatcatctccttcacagtggcagatcctatggtggaaggaaaacctgtcattccaaggacagtcccatgacagggaagctgacacttcagtggcaggttaatccccccaaaggaaactcagaaacgaacattacagaagtgactatgggcacaaaaacatacaaacacaaacgaaaacaatcactacaaactaaaaatgtctagcttaccgcaccaacatggaaagtctggagggcatttggcaacagaaaggaaaaaacgatgtaagaaatgacaaagctgtcattttttggtaagaaataagaacttcactgaaagatgaatttaaagcaacatggaatcattttccagaacataagatggtaaaataattagagggaaaatttctatgtaaaacaaaacctgcattccaacatccaaaaataccagtgaccttaaatgacgtttgctttttagctataatcactgactttaccttcataccccacaactacacatttctgtcgtctctcagcaagtaaacaaagatgacagtacctctctcctagacctaaaaaactcaccattacaagatgctgcaatttcatctctttttcttgggaccactaatagcaataagtgagaaattaatttgaaagcactctctatttccaaggaagtatgcaacaaggtgtagctactagcctgaaggaacttaacaggcttttaagaaacagaggggtcttttccagcagctagagaacaggttggggcactcgtcctggaaggagccaggctctcaggctgttttagtgaggggatctctgatccaaatgttagaaatgatgacagctggcactaaggagcggagactggagaaaggtcagaatgaggagggcacaagagtcatgacaaaaagtgaattatggaggccagacaaggatgctgcacaagggaagataaaggggggaaacagagttaggatgggacataggtggctacacctcagttaaaaagaaggaaggaaggagctactggagaacagccagtccccacacaccttttgggggtaggtagggagcaagggttaaaaaagaggctgggagatgcaacaatgcttaaaatctggaccatcaggctggaaaactgaagatactagtttctttcttccagtttctttatgcaaagtctacttatttttagtttagaagagtcagcttggcctttaatatgtgtagcttcttcctctttttttttttgttttgttttgtttttttttagacagagtttcactcttgttgcccaggctggagtgcaatggcgcaatcttggctcactgcaacctccgcctcccgggttcaagcaattctcctgcctcagcctcctgagtagctgggattacaggcgcccgccaccacgcccggctaatttttgtatttttagtagagacggggtttcgccacgttggccaagctggtctcaaactcctgacctcaggtgatccacccgcctcagcctcccaaagtgctgggattacaggcgtgagccactgcgcccagccagcttcttcctcttttatcatttgtaaaactatcttgggactcacatcataaaaattaagtttttcaaacgatattgatactccattcttctggagaaaaccatcaacccacaactggttacaacttcctattacttcattttcctgaaacttcacatactaaagcaagaggaggttcctgatgcgagcagagatggctagaatggcacttcctggcaaaccaacctgcagacatcccctgacgtggacacgggagatatggggggtaatttttcagagaagggagaaggacaatccaggtcgctgtccttttccgtggagcagaggggcgcccgcagaaccctactcttcagttttgcagatgtgctgtcctcaaagacatcgtcgtctcccatctcgtcagagcagaagcccatactccctgccagcccgctggaggacttggcagtgtgcaggcgagcagcgcagctctccagctcatggaacctgtgcaggctgctggcgctcaagccgtgcgagagtgagaacaggtactggagcagttgccggcttcgggacgtggcctcaccatccgccttctcttccagcagcaggccgggcctgccccccttgccagcttccacctctgaggcagttgagcgaccggcagaaaggcatgaaacacaagaatgtttggaattgccaagaggtttgtggttcagggttcttttttctttatgatgaaacctgttagttctgagacacgtatcttgagggagtattaatttcccttcagaacaagttctttccacataggcaaaactttctgaagtatcctgcgccttctcacccacatcattgagggaccttgagaactttagtgttcttctggctttggtattcttagcaggcttcaaggcctgggcccattctgaaccaaaggaatttctctttgacgcctgtaatgtgtccttacagataactgtcacagtgagcccttgtgtcagagaactctggcagtgaggagctttcgagacaacagcagactgcacggaactgtggtgacaacactcagaaaacactgcactggaactgcatgcagaacagtgggataaaagcacagaaagtaaaaacaattttaaaagagaatagacatcatagtgaagaaatgagactagcatgggtaacttggtgagcaaaccacacataaaactcgccaactgtttagaccaaaggcagattgattaagcaaatggaaattcaagaacctacagacactaatgcttatttctggctgcacactgatcatggcagcatctgaagcagagtgttacctgcagatgtcctggctggatggcgtgatagaagtgcgagagaaggaggacaccggagccggagctgatgctgacggaggactcccagcctgcaatgacagacctgtggtcagtgttcaggtaagagccaaggggattgtgtgcactgtctcctgaatggtgacagggagaaaccctagaaatgtctgctgcttcccgctgctcaacgagtaacacatattagatccttctaagccttggcaaaacaaatcaaatatcactatttttttcttatctgtggataaaagtgtaagaaatgtctaaggctatggaacaccactactaatctcttgcaggtccagtggccgtttattttctaagcatctaaattgagttagttcatatataagtcaaaaaacgaagtactagaaggtatcatacaaatgccaaagaaatatgaggctccaggcctgctggcactggcttccctagcactctctcctagttcccaagatcaacaaggctggtagatttaagagctctctcccacctcacaacctcatacatagtgccagatgctccctgagttccacaaaacctcactgccctgccacagctcttcacacaaaagggagtccagaccacgtcaccatgggggacaccaatccatagctcaaccaggggctgaggtagagcacagaatgctcccaacagatctaatcttgaaactgtaaattaagaaaaataatcaagaaaatttagatttgaaagaaagtacagcaagaggtcatgggatagaacagagtctctggggtggtgaatagtcaaacttagagaaaaaaatctaggaaggagaggaagcactgcagtgaggagagaaatggacagagagaaatagggacagtgagtggcactgagctgaggatgcaccaccaccgctagagggccccagactcccacgccagcctcggattccccaggctccacagccccacagacctatgcgtattcataaaaaagcattcttccctccttaagacagtaagcctgagtaagaatctgctccatgcaaccccaacagccccaggaaaacagtgccacgagtctgttatcaccagaaaggccatatcaccacccaccttctgcaggcccacctgcatggcccttggccctaactccttgatacaaaggagctccaccctggcccaccattccctggctgaggcctagtccccactctttctaagtaccatccccaagggtgcactctcatcctggaactccacctttgggacccccgacccttggtcaaccaccagaacagataaggccattgcctggaaactcctcctccccctacccctcacagcaaatgaagcagcctggagagagccaggatggcactcggattaaggcacccatcgcatggctgctcccactcccagtgcagagattcaacagcactttaatgcaagtccacctgaagaaacaagatccaagaagctctcatcagcatgcttcatgtgtacactgagatcacgctgtgccactccatgagcacatcttcgaattcaccaaagaatctacatttattttctaactgaatgtgcatatgggcatgaggtacacggtctttaaaagcattagaggtcaaagttcttaggaatcttaagtttacttggacacatgaaaatagcatccttgaaataaccctcccatcactacctttgtcaatattcttcctgaaacaaaatgaaagacatctagggatgcctgtggacactatgctgtgacatcccttgcatcttctaggcctgactgcataagccattgtcctttttctccaactgccttagacactgtcccctctccagcatcctcctctcggggcacccatcactggctccacctgccccagagacaagcactcaaggccttttagtacaatgggctttactgtttataccacaggggagcagattgagagggtatccatgctaaggtccccaaactcctacagtccccctgttctctgacatttagtcctaacactattctgggactgaaagccttcctgtacttattgctctcttcttttatttctgaggatgaccagctctgttcaacacacataggcaaggctaaaatgtgtcatgaagaccaaagcctgatcacggtgtattgcagagaagtaagcgtcttcatcacctgtccccaggtagactttgaggaagaaatacccagcaatatccacatgcttgcccctcattgctatgaggtcacttcttcctctgtgttgctgggtcaagcatactccctggaactgatgaggcattgaaggaagcccccttccttcaagggatggcagcagaggaaagtacctagtcaccctcctcccttttatcttagtaagagcatggtcctcttggaaccacgtgtactttcctgtattctgaagggaaggcaaaccctgttgggaggaggtaaggtcttatctggaaaatcgtgcccaatcaaggtcagtgtcctgggtccgggaggcaggtttctgatgggaaattaaagttctgaactccagtactaaactacaagtaatccaagtcaaaaagtgtactctggggtaacgattccatccttgcatgcccatgatgaggagcaaggcctgaaggtaggagggcagagcctcgtaacaaaacaaagcctggatcaaggaagcagccacaccaggcacacacacacgtcaggacatgtgttcacttccctgtgtggttccccatgtgtgtgcacttgtagcagatgtcaaggccagcatgacagtgacagcggacccaaggaggaagggagttctggcagggctggggagattctgccctgctcagttttacttaggaaataggaaacagcgttggcatcctctgcctacatttctgctctcatttcaccatttccaatcttatgaaaacattacaggatactctcagcaggtatgtccgatcctcatcaagcctcccaatgacagagaaagagtctctcttcttattagatcacagaatttaaagaaaaattttaaaatctacttattgttattttacataaatataaacttcaacaaatgctaactcttccaataaaagcaagaaaaccagtgagatctgtggggtcttcacagctcccagaagaggctccttctgtcacgatctaaaggacagcaaacatttcaaaggtcagaaccaatccataggcagaatggtcaagaaaataattttaaagagctttatttgttgctgctatagacctgagagaaatctatcaaccaacaaagacctaaaagactggcctgatcaacaacaaaatgaagctgacagcttcaaataatggttccatggtcagattctggaagccagtgtaatcaaaggccagcaatcccctcttaggagctctgcaggacagaaccttactagatgggacaggacctcactagatgggacaggaccagccgtcctgctctttctgaaagcagcaggcagtgtggcacgtgtgagccgggggcagtactagctccagagaacacctacactctcctctccataggatcagaccacacacgactcgacaattactaataaaagtgcaaatgttcatcatgcaaaaatccaaatgtgtcaagaaaacttaggccctctgttcctgaagttctttgcgggttgccaaatgacagactctccagtcatgaaaaggaatataaagcaatctcactacaaaaaaaaaaattcttgtaaaaatcctcccttcttcagatgttgtaattaattatgccaaaacaaacctctggatttctatccaagcctaaatcccagtttattttatttcttagaaatgataaatactttttgacaatttgttttgctacatccaagtcttttagtggctggctttgttatcaaattcaccattttaaatgattttaacaaggttgccaaagaacatacggggaaaaaaaacttttccatatatccttggcagaaactggcattccccttttctcagttcccttctgagagtgcctgctgtcgctggagcagctatagcagtgtgtttacccagttgatagtgcacacatccttctcactgcaggacaccagcgcaccttccttggcctctggcgccttctgccaggttactgcccagcctcctctattacccacgcccctcattttctgtgcaacccccaactgggcctccttttcactcatcagctaagctacttttaaacatttgggtctcaggcccctaacaaaagcaaatttgcccatctgatttatttcaaaagggagagggccacaggaatgatctgtttgagtgagcttgtttttaggcaaggaggaacgtgaagacaggctggataaggatggttaagaggccagaagagctcatgtttacaactcatcacaaattacagtactgcaaatcaatgacttaacagaaacaatgggaaaagatgcacagatggctctcaaaacatgaaaagatgcttcatttctctcacaatgagaaatacaaattaaaactacaatgagataccattatcagccaagaaaattaatcaaataatatgtgttggcggaagtgttgggaagcaggtatgcttatacattgctggtgggagagcaaatggtaaacctccacaggatgacaactgccctcaggatgacaaaggcacatatactttgtctcagcaattcttttaggaattcatcctcacacacctgcgggaagaggtttgtacactgcactagtttgtgacagcaaacggctggaatcaccctaaatgcccatcaccttggagctgaggcaacactgttccatctacagaaagaaatatcagcaatcattaaaaaaatgggaaaagttctcattatgtccagtaatgaacacacaaagtgaaacaagcagagagaggcaccactgccatctgtgctggtgctgcacagactactcaggagggagaccagggaacctggatggagggacatggacttgtcacagagacccacaaaaccataatgccactttacactgagcaacatttcccaaacagaaattcattcttaaaataacaggtgattgatgattttaaaaagtaaaacaaaactgcagaagcacaaccaactgcaacaactttccgactttgggatgacaggtaaagaaatcaatgtagtgggtgatgacctatgtttttaaaagtacaataaaatagaatatgtcagaatgtatctgacataaaaaggataaagtcttttgaggtaattttgtctctcagatgtgtatgcaaaagtgaactgggtttcaatataaaagctacttctggccaggcgcggtggctcacgcctgtaatcccagcactttggggggccgaggcgggcggatcacgaggtcaggagatcgagaccatcctggctaacacggtgaaaccccgtctctactaaaaatacaaaaaattagccaggcgtggtggcgggcgcctgtagtcccagctactcgggaggctgaggcaggtgaatggcgtgaacccgggaggcggagcttgcagtgagccgagatcgcgccactgcactccagcctgggcgacagagtgagactccgtctcaaaaaaaaaaaaaaaaaaaaaaaaaaaaagctacttcttactttggatcatggtcaaagtcacttgaaagtcactgcctgactgtatttctacaaagaaaataaaaattatcaaaaaaaaataaaagaagaagatggctaaatcaagagttcatgttggctgttggcccagaggctctagaagcaaatggctcttacagatctctagaaagaaggttttcctctacatggaaagcatttgccacccatataagaggtgtgttgctatgtaaacaaaacttagtggcttaaaactacacaaatgtatcacttcacagttcccacagactaggagtctacatgcgcatgctgagactctctgctctggtcagtctccctccttcctggaggcctggggaggactgcgtttacacattctctcaggttgttggcagaacacagctccctaaagcttgaggactgagggcccgtctgctggctgactccacctggggcaggccacatgcatctgcagtcacatgaccccttcccatcttcaaagcccacttgcggtatcaatctctctgacttccctttctgccaccagtcagagaacgttctctgctttttaagcacttgtgggattccattgggcctgtatttataaccccaaataatctcccttattttaaggtcaactgtgccacacaacacaacatgatcataggagtaataatagcaatgcattcccaggttccaggcaattgtggggacatttttgggggccgttttagaaatcttgctcaccagatcacttttttatttgtgcttcctgctcatgagattgctagcggttactgccctcccacttccaaactaagagatagggatctgctcctaacggtcaactcggcaggcctgacttcataccacagagccagataaactcacttggtgtttacatattgcaatgtgcagactgagattacatcttgacaaactttctgcttagcacagaagttactctgtcaaaccaatgcttcattatgagtaactctgctttcgataaatacccagttgtattcaacttcaaaaatgagccacaattaaaagaaaagaggccattctgtggcttttctgtggcttgctctgataaatacatgttgactcttatgaagggctgtgccaagaacaagctttcacaaaggcaattaattaaaactgaccattaaaaaagtaagtatatacaatatacttacagagaagcatgtacaattaaaaactactgaatgctaaaatgatatccattataaatgactctcattagcattgcttacgccaagtagcactaacatggaattcttttctacagtggccttttaaagggagtcggaattacttgagtagcaataaatccccagaacaatgaggggaatatattacagcactggtggaggggacagaaggccacagctgaagggactttttcaggactgtcttcctccatgctgcagctgaggatcttgcaaatataatttgttttcaataaattacattgaagacaatgatttctgagcaaaggtggcttcacagtcccagaaactaaagatgtaaccatataaaaatccaaaatcaccagaaataacacggtgaaaggggctgtgtttgtgagttacttatcactcacaaggaccctttaatactgttgatttcctttaaatattgaacttttcaaatatagtcgaaatacattttcattgccaagaggcaataaaatatttcctctgagagaattctggggcagtggccaaagcactggcttttgaccccaaagtcttccctctgtgttctggggccagtccactgagcacactaccgagcaggagtttaatcatttaaaaaatgaggtcaacaatctacagggctgctactaggatcaaataaagtcaagggagatgcagaaatgcagcacacaccactccaggcacacctccagtgtggaacaagacttccgtgtgactaccactcttgattcttgatgacctagagagtaaacctgcaggtctcatatctgctacaaaatgcctcattccaaccaaggtaaccaccgtccacccacctgggaagaaaacagcttctgctcaggctactcatctggccagccctggcccaagatgcacagaactctaagagcgaaccctgagccgcggagtatactactgacagaaacatggcaggcaggaaaaatgaccctcacttcctctaggcctaggccctcctttcccggcaactggtggcctttcccacccctcctcctcctcccaggaacactcccacattccaacccagcatgatggcccctcctcctttctgaggagaaagggcttttcatccctgttatcatatccttgtaccctattcatttctttcactgcacctatcaaggtttataagaagatgttactgggatatgttaacttagaagctgttgctgattggtctggtacacactaggtgtttagggaacatttgctcaatgaactaaacagctaccctctggggagactgtgcctctacaacagagattctcaaacttgttggccacaggacctccttaaactcttaaaaattactgaggccctcacaaaaagcttttgtttacacgggttccatctctccatctttgctatattagaacatcttaaaacacaggaacatattccaccagctaaggaagatgctatcctgcatgttgcttagcttctggaactccgctgtatacttgtggaagaatgagagtgaaaaatggaaataatcttggtattattgggaaattgttttaaacctgccccccttccaccttcaggagactgaaccaaacttcagccaaaaactaaactgtaacagtcagatgaaaaaatactgcaaagacagtcggttaaactttgcaaaaggggagctgaacggaaacactgcctcagtgctgtcaggattcgagtgaggctcagtggtgctgaggccacctgatgccatgaaactcctccaattcatcctttgtttttgtcacttaggaataaatatcctgttttgggacagctgttttcttcagaataaattaagaaagcacattttgccttatttgtaacccataagttttgagtaacctgagcgtgtcactggtcaactctgcattcagaaacagaaagaagcaaaccctggtcttgacaatcacatccaggtctgccctcgcgtaataaaagtgggtcagcaagaattccttgtaaggaatgtccctctgatacgtgacattctgctgtatctcatccctgtctaatggcaacaataaccggaaaatattcaggaggcctaggagggttagtgctcaaattcattgagatgtgcttgccaagcaatagagcaatcattgtaattgctcattaaacatgtccagtctgattctacccaggaatatttgattaacaagaggtacatatcacagtctgcaaggccccagccttgggcaactgccagagcctacagagccaggctggctagggggctggcagagagatactcgtgctacgggcttccactgccttctccctggggtaagtgctgccaatcatgaacttgctcaagaaattgtgtcacctggaccaagtttgattcccagggttgaatgagaaggcttccctggggataaaataacattgtgtctatgtactgccctttttgcaccacaatcttcctctgagaggcatcaagagaggctccaaaaagtccagcccctatgattagcctagcctaggccaattcctggtattaaagaaattccagctgaatagagtgggtttaagcctcctctgcgaatttcaatcagcctctataggattttaggccaaagtactcacatgaacagccacagtcaacacaatcttgtggttacagccacctgcaatagggtgccatgagagccatcacccccagccactgaagatgcctttcattgtccatctaaagtactggactttccaagcaggtgacaaatgatctttctactacagtttaacctcatcctggttggctcctttccacctctcacatctgctttacatgtctctcctgagccacatcttctctgagcagtccttcaacttgggttccctgtaattctctacctaagctccttactgttccctttgtaggaattctctccatccgtggtatcgtatagaggtctgcgtacttccctctgctgtttggttcagcattcaaagcacaatttctggcacacagttaggtgctggacaaaatctcaatgtgtgcaatcctcgtaaactctgcatggcctccttgtctccatgttagagatgagacatattgtcaaatggtaagacagcctgcaggtgggggcagtggtggcacaggacacaacgtcctgaacaggcagtcacctcacgtcacctgagtccaccctgaggccatgcccagtacactgtgcatcgcccctgccagccatactctatggcttcctggtaccccgagacaatggccccttgacaggcagaggctcacagcagagatggaaagttggcttgccccatccccacccctcccttctctctaccacacagcctcctgaatacccatctgtcagagctctatctcacaaagggccatcacaatgagtttaggtgatataatgaagaacatgctttttaatagttatattttcacattaaaaagttaaccaatcaaaatctagaggaggggcttcaagatggctgactagaggcatctggtacttacctcctctacaaagaagaaccaaaatagcgaggaagaatcagactttgaatagatcatctaacagagaacacgaattcaacagagaagtgacagaaaacacctagagcaggcaaggagagggcagtcaggcaaggcagccaagaggttccccagtgtggggaaaggggaagcgagcgatccccagcggtccacattcctaccatgcacttctgcaattccagccatgacagagccctagaccctcacaggccttgaggctaacagagggagctgcctggagatggcgagaaggcattgctccagggagggagctcgtgatgggtcccacacacccctggagtccaaggcagctacaagaagacaccatactgagagcccagtcctcaggagactgcatcctgctgggggcccaacagtccctgcttcttcacatccctggaaccccactgatattcctcaccacagccattgcagcagctagctgctgctgccagggatgaagtgcaaaccatttggcaaagaccctgctgcttccagcagtgaagccactgcacgttttcacaagcgccaaggacaaagtgagcaaagtgtgcactccctagccgctggcatacctattgccactgaaagcaaccccactctccccagtagtagggctgcagtatagccactgctgcctccaccagagcattctgccagggccttggaatcacccagcccctacctaagactgttagagcctgaatgcatccccggggggggctgaagtatgtcctacccagttcctgagtaaaccatcctgaggcctggggactgcgcagcccattccaccactattggaacctgagcatactgcctgggcatctgaggtcaggcccacccaacctgccattaccgccacatctagcactcaattgcgtacacatttgggcctgaagactggttcaaccagcccatcacagccgcaaactgcttgggagccagagggttgtcctgccactgctgctgccatcacccatatcatgcctgctgcccaggagcccaagaattcacccacccacccagttcgccactgccactaccagcgtttgagcaagctacaaggaggtcccccaaaaataacccacctgacctgctaacactggtgccagcatatactgcactgaggcccaagggcaggcatactcaccccactactgccaccactgggaccaaggacaggccaacctggtatccctgtccccagcaaaacctcactacagcctccaccataccctaagatactgaggaaatcacagacaccacaaacatgacttatagccaaagaaatcatacagagactatactactgcacacaatgagaatcaaagctaaagtgccctgcacaaccaacaccatagacacaccctcaggaaaaactcctctcctacaacagcaaattaagaaaactagaagagactgttacaccagacgtgcagagattaacataaggacacaagaaatgaaaaatcaaggaaatatgacacccacaaaggaacccaataattctccagcaataaattccaatcaaaaagaaatttatgaaatcccaaaaaaagaattcaaaataatgatattaaaactcagtgaacactgggcatggtgactctcacctgtaatcccagtactttgggagccccaggcatgaggattgcttgaggctaggagttcgagaccagtctgagcaacatagtgagacctcgtctctataaaaaatacaaataaaaattagctgggcatggtgatgtgtgcctgtaggcccagctactcaggaggctgaggtgggagaattgcttgagcacaggagttggaagctgcagttagctatgatcgcaccactgtactcctgcctgggcaacagaccaagatccggaagctcagtgagatacacaggaatacagacaaacaatacaaagaaatgagaaatgcaattcaggatatgaatgaaacattttccaaaaatacattataaaaaaaaaaacaaacagaaattctggaactgaaaaattcattacatgaaatacaaaatacacttgaaatattcaacaaatagatcaagtagaagaaataatttcagaacttgaagacaggtcttttgaaataatccagtaagacaaaaaaatttaaaaaaggaatagaaaagaaagaacaaagcatacatgacatatgggacaccatgaaatgaccaaatattcaaattttcagtgtctcagaagacaaacagaaaacaaaaaagatggaatatctaacaaaataatagctgcaaacttcccaagtcttgcaaaagatttagacatctagatataagaagctcagagatatccaaatataattcaaggtctcctccacagcacattatatagtcaaacagtcaaaagttgaagcctaaaaatagcaagaaaaaagcatctagtcatttataagtggacccccatcgaaccaacagcagacttgtcagcagaagccttatagaccaggagagaatgggatgatatattcaaagtgctaaaagaaaaaaaaaaggccagccaaagatactatatccatccaagttatcactcataaatgagaagaaataaagtccttcccagacaagcaaaagctgagggaattcaccaccagattggtcctataagaaatgcttaagggaatcctacacatggaagcacaaggacagtatttgccatcatgaaaacataccaaagtataaaacctactggtagagcaagcacacaaataagcaaaaaaaaggactcaaacgttaccactacagaaacccaccaaaccacaattataaacaataagaaagaaggaaacaaaggatatacaaaaccagaaattatttaataaagtgacaggaataagccctcacatatcaatagcaaccctgaatgtaaatgaattaaactttccactggaaagacagagactggctgaatggatttaaaaaaacattactcaactatatgctgtgtacaagaagctcatcgcacctgtacagacacatatagacttaaagtacagggatgaaaaaagatattccatgcaaataaaaaccaaaagcaagcaggactagctatacctatatcagataaaacagactttaagtcaaaaacagtaaaagacaaagagagtcattatataataacaaagggattaattcatcaagaggctataacacttctacatacatctgcaccctacaccagagcactcagatgtataaagcaaatattattaaatctaaagggagagacagacttcagtataataatagctgaggacttcaacaccccactcccatcgttagacagatcatctaggcagaaaatgaacaaacattacatttaaactgcacgttaggacaatggactaaacagacagttacagaacgtttcatccaacaactacagaatacacatttctcagcacacagaccattcttcaggataggccacaggttaggacacaaaacaagtctcaacaaagtttttaaaaattgaaatcatgtcaagtatctttctcagaccacaatgtttaaaactagaaatcaactagaaactgtacaattacatggaaattaaacaacatgctcctcaatgaccactgggtgaaggaagaaattaaggagaaaacataaaaatgccttaaataaaaatcgaaatacaacataccaaaacctgtgggatagagcaaaagtagtgctaacagggaagtccagagcaataaacacctacatcaaaagagtagaaagatttcaaacaaacaatcgaaggatgcacctcaaggatctagaaatccaagtaaaaaccaaatccaaaattagtaaaagaaaagaaataataaacattagaggagaactaaactaaataggagctaaaaaaaaaaaagatcaatgaaacaaaaaattaattttttgaaaaactaaaattgatagactagctagactaaccaagaaaaaaagatagaagacctaaataaaatctgaaatgaaaaaggagacattacaaataacacagaaatacaaaagatcatcagagactattacgaactacatgctatcaaactggaaaacctagaggaaatggatagacacataacctaccatgattgatcagaaagagacagaaaacttggacagatcaataagaagtaatgagatttaaagagtaataaaaagtctcctaacaacgaaaggtccaggattggatgacttcactgccaaattctaccaaactttcaaagaagaacaattcttctctattccaaaaaactgaagaagagagaattctccttaactcattctactagaccagcattatgctgacaccaaaaccagacaaggacacaacaaaaaataaaactacaggccaatatccctgataggcatagatgcaaaaaatccttaacaaaatacgaataaagcaaatccaattgcacatcaaaaagacagtacacgattaagggaatttatccctaggatgcaagggtctttcatcacatgcaaatcaataaatgtgacacatcatgtaaacagaatgaaggataaaaccatatgatcatctcaatagaagcagaaaaggcatttggtaaaattcaacattccttcatgataaaaattctcaacaaactaggcaaagaaagaaatactgcaatattaataaaggctatatatgacaaacccacagctaacataaatctgaatgggggaaaagtgaaagaaagccttccctctaagaactggaacaagataagaatgcccgctgatatgatttggctgtgtccccacccaaatctcatcttcaattgtggctcccataattcccacaggttgtgggagggactcagtgggagataactgaatcataggtgcagtttcccccatactgttcttgtggtagtgaataagtctcatgaaatctcattttgtaagggaagcccctttcacttggttctcatttctcccttgtctgccgccatgtaagtaagatatgcctttcatcttcccccatgattgtgaggcctccccagccatgtggaactgtgagtccattaaacctcttttactttaaaaattatccagtcttgggtatgtctttatcagcagtgtgaaaacagaccaatacagtaaattggtaccagtaagtggggtgctgctataaagatacctgaaaatgtggaagtgactttggatctgggtaacaggcagaggctggaatggtctggagggctcagaagaagacaggaaaatgtgggcaagtttggaacttcctagacatttgttgaatggctttgaccaaaatactgatcatgatatggacaatgaaatccaggctgaggtggtctcagatggagatgagaaacttgttgcaaactggagtaaaggtgactcttgctatgttttagcaaagagactggcagcattttgcccctgatgtgtggaactttgaacttgagggagatgatttatggtatctggaggaaaaaatttctaagcaccaaagcattcaggaagtgacttggatgctgttaaaaacattcagttttaaaaagttttaaaagcattctcagagaaacagaaaataaaagcagaaaatttgtggcctcctgatgccattgaaaagaaaaacccattttctgaggagaaattcaagctgggtgtggaaatttgcctaagtaacgaagagccaaatgttaatcaccaactcaatgggggaaaatgtctcaagggcatgtcagagatctttgctggcagcccctcccatcacaggcccagaggactaggaggaaaaaaaaatggtttcaagggctggtgcccagggcccccttgctgtgtgcagcctagagactccatgccctgcatcccagccactctaaccaaaggatacaagcagccagggtatagttcaggtcatggcttcagagggtgcaagccccaagccttggcagcttccatgtggtgttgagcctgcgggtacacaaatgtcaagaattgagatttgggaacctctgcctagatttcagagaatgtatagaaatgcctggatgttcaggcactggtatgctgcaaggatggagccctcatggagaacctctgctagggcagtgtgaaagggaaatgtgggttgcaagcccccacacagagtccccactggggcactgcctagtggagctgtgagaagagggccaccatcctcccaactccagaatggtgtatctactaacagcttgcaccatgcacctggaaaagctacagacactcaatgacagctcgtgaaagcagccaggaggtgggctataccctgcaaagctacaggggcagagctgccaaaggccgtgggagcccacctcttgcattagcatgacctggatgtgagacatggagtcaaaggagatcactttggagctttaagaatggactgacccattggattgtggacttacatggggcctttagccccttcattttggccagtttctcccatttggaatgagtgtatttatccagtgcctgtgcccccattgtatctagaaactaactaacttgattttgattttacaggctcacaggtggaagggagttgccttgtctgagatgagactttggactgtggacttttgagttaatgctgaaatgcgttaagactttgggggactgttgggaaggcatgggtggttttgaaatgtgaggacatgagatttgggaggggccgagggcggaatgatatggtttggctgtgtccccaccaaatctcattttgaattgtagctcccataattcccatgtgtcgtgggagggacccagtgggggataactgaatcataggggtggtttcccccatactgttcttgtggtagtgaataagtctcatgagatctgatggttttataaggggaaacctctttcgcttggttctcatttctcccttgtctgctgccatgtaagacatgcctttcgccttctgccatcattgtgaggcctccccagccacatggaactgtgagttcattaaacctctttttctttaaaaattacccagtctcaggtatgtgtttatcagcagcatgaaaacagactaatacacccactttcaccactcctgttcaacacagtactggaagtcctagttagagcaatcaggcaagagaaagaaataaaaggcattcaaattggaaaaagtaagttaatttgtccctttttgcagatgatatgattttatacctagaaaaacctaaaggctccattagaaaacttagatctgataaatttggaaaagttataggatacaaaaataaacatacaaaagttgatagtgtttctatacaccaataatgaactagcggagaaagaaatcaaaaaggcaatcccatttacaatagctatacaaaataaaatacctagaaataaatttaatcaaagaggtgaaaggcgttgcaaggaaaactacaaaacactgataaaagaagctgaagaggacacgaacaaattgaaagatatcccacgtccacggatcaaaagaattagtgtcattaaaatgaccatactacccaaagcaatctacagattcaatgcaattgctatcaaaatgtcaatgtcattttacacagaaacagaaaaaacaatcctaaaaccatatggaaccaaaaaagagcacaaatagccaaaacaatcctaagaaaaacaaacaaagctgcagggatcacactgcctgacttcaaaggatattacacaaggctacagaaaccaaaataagcatggtgttgttataaaaacagatacaggccaggagtggtggctcacacctgtaatcccagcactttgggaggccaaggcaggtggatcatctgacatcaggagttcaagaccagcctggccaacttggtgaaaccccatcactactaaaaatacaaaaattagccaggtttggtggtatgcacctgtaatctcagctaatcagggggctgaggcagggagaattgcttgaacccaggaggcagaggttgcagtgagcctagatagtgccactgcactccagcctgggcgacagagcaagactctatctcaaaaaacaaacaaacaacaacaacaaaacaaacccagatacacagaacaatagaacaaaatcaacaacacagaaataaatccacgtacttactgcgaactgattttcaacaaaggtaccaaaaacatgcgttagggaaaggataccctctcaataaatggtgctgggaaaatgagagatccatacgcagatgaatgaaactgaagccctctctctcatcgcatacaaaaatcaactcaagatggactaaacactcaaacataagacctgaaactatataactattagaagaaaacacagggattacacttcaagacattgatctaggcaatgattttatggctaagaccccaaagcataggcaacaaaaccaaaaaccgacaaaagggactatattaaactgaaaagcttctgcacagcataggaaacaatcaacagagtgaagacacaacctgttgaatgacagaaaacatgtgaaaactacccatcgaacaaggaactaacatacagaatatgtaagaaactcaaacaacattaaaaacacaaacaatcccattaaaaagtgggcaaaggacatgactagacatttctcaaaaaaagacatgtaaatgaccgacagctgcatgaaaaactgctcagcatccctaatcatcagggaataacagatgttggtgaggatgcagagaaaagggaactcttatgtattgttggtgggaatgcaaattagtacaaccagtatgaaaaatagtatgggaattcctcaaaaaactaaaaatagaactactatataatccagcaatctcactacagagtatttccccagaggaaaacaaattagtattatcaaagagatatctgtactcccatgtttattgtagcactgttcgcaaaagatatggaatcagcctaagtgtccacatcaatggacaaacaggtaaagaattcgtgacacatatacacaatgaaatactattcagccatacaaaaagaatgaaatcatgtcatctgcagcaacatggatggaggtcattagccagacacagaaagacaaatattacatgttctcactcacatgtgggagctataaaaatttgatctcatggaggtagaaagtagaattataggtactagaggctgggaagggtgtgcatggaggcaggagtgggggataaagagagattggttaatgggtacaaaaatacagttagatagtcacaataagttctaatgttcaataacaacagagtagggtgactacagttaacaatatattatatacttcaaaataactagaagagaggtttaaattgtttctgacacatagacatgataaatattcacagtgagggacaccccaaataccctgacttgatcattacatagtctatgcatgtaacaaaatatcagaggtaccccataaatatgtacaaataaactaaaaaaagaaaaccaatcaaatgtgatttcagatactacacaatgatataaaactttgagtttgttctttagaaaatgattaagcaaacagcagcaagggaagtacatagggtgaggactgagtgtggatggggcatctggggaacatcctccaggatggctcgtgggcccacatggtcaaggaccctgcggtgaggtgaaggtctgggcaagatgcatggcgatttcatgggggctgcattccagtgcccgtctttgtataaagcatgtcacctgtgggactcaaactgcctcaaacttctccaagcacccagtcaattaaacagatttttttccaaggggggacattctgctgcttctaaaaatataagattttctacacactgctatcattacaaactgtgataggtgctatgaagaaagagtaacaaaacccaaatgggtgataaaatttagactaaggggagggtgtcaagggtaagtgcctctaaagaagctaagaactgaaagagaaatgagttaggaattttagccattcatgcaaaaaaggggtaagattgggagaggcctctcggacagaacaaaaggtgcgcaaataggaatttggcttgtttgaaaatcatcaaggtagacaccatacctagatcatcatgaccaaggggatattgcacaggatcaggttccaagtggccaggcccaggtcaccttagatgtgacagctcaaggtagtgtaatcagaaacactgaagaattgaaaagagaagcattaggaattctacttactggctactgggtgctagatggtttgggatagattcttgagaagctactgcaggagtttaggaggcctgggcctgggaagtggctgggatgatgaagagggatgaaccaatgggctgggtatcaagtgtctagcagaacagcatgcaaacattgactcagcatgtactgacaacctccagggctccatcccatcactggttctgcagatttaggggtaaacaaagcatggctctacactcatgaaggttacatgtggggtgaaggtgcaatggaaaaaaattcatgaaaacccaggcagtgataagtgcgatcctgaaaaataaaaggaaaaggtgactttggaccccttaggatgttaattggaggtgacaaatttcatgaaatcccttggtaacagaggctcaacaaatgatatccattaacattgtactatcaatacaaaataagtattgggtgaagactttgccattgtaattgcttaaatatcccaatatgcttcttctattaactccttaaggggatcaaatccagctgcccactttgaagagaggcaagccaccacagacctagcagcctcataaacatctcatccaacctacctgcttccttctttgaaaatggagcctggtttttaaagtcaatatgcttccaatacacactgagacactttgtaataaaatctagatggaatactaggaggcatgattaaaggtttattttttacctcttttcaacctctaaatttacgccagcaagaggtgaactgcagaagcataaagcagactgcagtgactggctcatgtgctgaccccagctggggtctaaaagtcagcagaaagtctcctgacagagacaacggggatttcaggtagcatacagtatgtccacattgtggcctcctttaatctcaagagtatgtctgctatactgaagatacgattttacatgtcacggcctaaaactggcttcaaacagcaggttcatttaataaatactccaataaaaaaactgtcttctcaaaaacagttatcttccacagggggcctgccctcccttccttggtcccactgaactggttcatgtctaaccaccttatacagcatgctaactatcttcgttacaaaagggtacactttgcaacagaatttcacgttgacaggttaaccaggaagttctgtgagtaatcaaatgttctaaaggctcactccactcagatactctccaatgaccatagtaagcatcccggaactcactggacacactaagtgtccagtcgcaaacagcacacagtaaaaatgtattcaagaaggggccgggcacggtggctcacgcctgtaatcctagcactttgggaggccaaggcgggtggatcaggaggtcaggagtttgaggccagcctgatcaacatagtgaaaccctgtctctactaaaaatacaaaaattagctgggcgtggtggcacgcacctgtaatcccagctactcaggaggctgaggcaggagaattgcttaaatccaggaggcggaggttgcagtgagccaagattgcaccacggcactccagcctgggctacggagcgagactctgtctaaaaaaaaatgtatgcaagaaggaaaaaataatgtatggttctccattgttcagcaataaataataaagctaccattaaatgaactgtcctggcccaatcaacctaaggtcaccaggattcaacgaactttgacaagagtcaggtttgttggctcagtgtaatgggtgagctgccccatggttccatgcaaatgttaatcccaagactcggaacaaccctgaaggttgtattattaccctacttttttttttttttttttttttgagacggagttttgctcttgttgcctaagctggagtgcaatggtgtgatcttagctcactgcaacctccgcctcccaggttcaagcgattctcctgcctcagcctcccaagcagctgggactgcaggtgtgcaccaccacgcctggctatttttttggaattttagtaaagatggggtttcatcatgttggccaggctggtctcaaactcctgacctcaggtgatccgcccgcttcagcctcccaaattgctgcgattacaggtgtgagccaccacgcctggcttaccctacttttactgataactaaattaaagctcagagagatgtcctttttcaaaatcacatggctagtaaaccatcatccatgttaattccaaaacccttacaaagctcaaaatacccacaacccaagccaggacaatagcctttcctctagactttttaagatggtggtttgcaaacagttttttttaactataggaagaagtttcctttaaataaaatgtgactgaaatccatgaatgaacaggtacatatttaaagcataggatgtcctccttcagaactgcccttggctactagggcaaggcgacatacatgtgttactgagcgttttttaacacatttaattcaacttaagcaaacaggccatctgcagctgcaccttctcacttttctccgtgcttagacactgattagctcctttaaaaggtgcaaaaatgggcagcaatggtttaccactgcatagttctagcactgcagcattcctggccaaagggacagcaaaagaaaagaaatggaggttggatgggaaaaaatattttgtgaaaggcattcctatttttaacgcaaaattaagcggaagaataatataattagattacaaatatgcctaagaacagacaaatgtcttaagaaggtttgccagagtttacttttagtcttaaaaaaataaggtgacctgaatgaaaacatatatgtagtcagcacattaaaatggcatataatgtaactgttcatttcagagtatctaggaggcctgagacagcagatagactttgtcacttgttcaaatcctcccagctgaatctgtggtgtgtttggccatatgccaaaaacatggggaaaaggtccacccttacaaagaactttcatggccttaactgtatggcgaaggggttggccagagtcaatgtgtgggctgagagaggagcactgcctggaagcaagctcactgcatcagatacactctgctggttcccaggccataccctagcagccagtgtgctcctggtgcgctaaaaagaccacaccacaggtgaggagatgctgttggatggctgattcacttcccaagccctcctttccctagctgccttccagctagaggtggcctgtgatccagttctggccagggagatgtaagcagatttcaggcggccaggtgggacttgtgggacaacttttgccttcctgctgaaaatggtgactctcagctaacagacctgttaatccttgatcagtcctctaattcctgccaaggccacaaccgcaatgcctgaaggtccagctctcatcgtgagaccatgtgtcaagtaggagatagcacagagaggaaagagcctgggtccctggcaacatctgttacagggagccgaagacccatgggacgtgaccaactcagcattcccctggagactatatgatcaaacagcaaaccgttcatcatgaatgcaggatatgagcaaactcacgactgctccggccgactgctcctgccaacagaaggtttgctggaggcaatcactccctggcgccaaggttctctactgcaacatctagaaccttttgttcaaggaatgcagtcttgcaagcctactctagactgagcagctgaccccttcttccacccgccttctcactatctcttttgcctaataaatatggagggctgtgtaaagctcagggcccttgtccactagagccaagatgcctccttcttccaaatatactcttttgtctcttgtcttttattcccgccttcaccccttgttcagttcccctaggtccatgcgggttacacagtggcaccccgaacagccacagaatcgggtgcactacaatctgtgatcaactctgccctggatcacctgcttccagacaccttgtcaaatgaaccatataaatccataattatgtaagtcatcatagttagctttctgttactttcagtcaaatatattcctaattgtggcaacagactctcctgtgcctgagatttcttctgccttaaagtatatggttttctggaaaaaatggaattttctcccagaagtcacttcccccaacacacactcaaaattgccttaccagaaaaatgtaactgccacatacctcttatggtcccagaacagattacagaaatgtatcaagaactctaacgtcttttcaaaaaaaaaaaaaagagtataaacacatgtaaggcataagaacagaaaagactcaaggtaataaataacatttttcagtggcactctaccttagaaatgttgcttgaatgactcatgaaatgtcccaaagtcttctcattctgcaagaaaatcaaacaggttttaattatcaatctttgattaaaatatgcaaagaacaagtaattgatcacaacaaccctactgacaaatcattccctgaactagaatttgcaaagcacaacctactatatactagatgtatgtagccaggcagtaaatattgcacatttgggcaaaatgaatacacaatagtccctgtcctaaaggatttaacattttatttaagagatttaattttttattatcaggaaaaaataagagtttagaattcactgtcaaaataagatggtaataagtgtcttaagtcacatttcacgtgaaagttcagatggtgataagtgtcttaagacacatttcaagtggagaggctgcatgctcagttgtatgtgacacagtccacattatgaggagtcacggcgaaagagtgaagaaagtaggacagctgaccagtcctggggtgtctggctaacaaagtgctgaatactcaatcgggatatcacacagctcacatctccttcaactcagtttctcctcctggagcagggaaatctgggagccatgccagcctccttcctctcatgcccctccacattcagtcacatagtcttgtatcaaattcttcctcctctcaatcacaactcattttcatttttattgacaatgctttagtttagattctcttcatttctcagctagaattcttgaagaataacatcccacctggcctttttgcctttaggttgacctccctgatacacaactatcatgggctaaactgtgtattcccctcccttctgtgaaaatttagatgttgatgtcctaaactccttcttcctcagaatataactatttggaatagggactttaaagatgtaattaagtttacatgaggtcaatagtagtcccggctactcaggaggtgactctaatcctagtggactctaatccaataggattggtgtccttgtaataagaggagtttgtgacacagacacacacagataaaagacaatgtgaacacagagggagaagatggccatctacaagccaaggagaaaccagccctgctgccaccttcatcttggacttccagcctccagactatgagaaaataaatttctgttgtttaagccaccttccgtatggcaatttgttatggcaaccctcaaacaactacgatcatcttccatcctatgactttctttaaaaaaaaaaagtgaacactctaaacataaatctgatttttaaaaataaagtcattttcctgaatctactcattcttgctctaaacccaaatgagtaacaaaaactattgcctaaggaagagaagatcttagttgtatttccttgctctgtcacctaggctgggagtgcagtggcatgatcatggttcatggcagccttgacctcttgggctcaagtgatcctcctgcctcagccttctgaggaattgggactacagggatgtgccaacatgtctgactaaatactttttgtggagacagggatcactctgtcacccaggctagagtgcagtggcacaatcacaatcatgcttcactgaagcctcaacctcctgggttcaagtgatcctcccgcctcagcctcccgagcagctaggactacagacatgtgccaccatgtctgactaagtattttttatagagacagggtcttgctatgctgcccaggctcaactcctggcctcaagtaattctcccatctgagcttctcaaaggactggaattacaggcatgagtcaccatacctgacctgtttcttcatcttaaggcagtcaattagtaaattataaagtatgctcaaagtgttgggagaatgttaccaaagaatgtttctaaaagatcaagtttcactttgggaggctgaggcgggcagattgcctgaggtcagtagtttgagacccgcctgaccaacatggtgaaacaccgtctctactaaaaatacaaaaattagccgggcatggtggcacgtgcctataatcccaactactccggaggctgagggaaggagaatcgcttgaaactgggaggcagaggttgcagtgagctgagatcacaccactgcactgcattccagcctgggcaacagagcaagactccgtatcaacaacaacaaaaaaagaccaagtttaactagcaatttaattcaatcatattattcacacattcattcactgggaatgaaagccctctgtccagagaacaagtaatctgagtttcattcattagtcaagaatgtacttataggtaaacacagggcactgctgtgagtcccaattttaaggccaagctactggtgacttactattaaattttagtgtagtctactaagttcaaacaaagacaccataggccttggattatctgtacagaaagccaattataaccactgctacattacttactacctcacaaggaatggctggtttgacaccatctggaaatctacagagaagttcacaagtactaagagaagccaataaatcatatcctcagacctttttgacattaattattcaacagagaatggatattggggtgagggagaactacctgctaacttaacattataaacccagattgagagctaaagctgttccttaccctttaagaaataaatttgataatgcaagcttttattttgttttcttgttagaacaattcatattttacattggtaaaaccaaacaaataacaagccctagaaaacacaggggttttaaagcctgaaacctgtcaatatttagggttgcttctccactacttggtaggatcttaacagttcagttccagcagaccagatcatcttttattttcccccaataaacactgctctttttcttcttcttcttcttcttctttttttttttcttttttgatacgtagtctcgctctgtcgcccaggctggagtgcactggtgcaatctcggctcactgcacgctccgcctcccaggttcatgccactctcctgcctcagcctcccaagtagctgggactacaggcgcccaccaccatgtccggctcagtttttgtatttttagtagagacggggtttcactgtgttagccaggatggtctcgatctcctgacctcgtgatctgcccgcctcggcctcccaaagtgctgggattacaggcgtgagccactgcgcccagcctaaacactgctctttagatgtccatttatttggacttaaaatatatagtgcaggacaacatcagagatattttccagaaagcaagtcccaaaactcattcaaatcagtcattctttccacacttatttactatgcaactactatgtgtgaacaactgtgtcaggcatagaatatggaccaaaatctcactcctaaccatatgccaatgataatattgagaatcccttatttgaaatgcttgggaccagaactgtttcatatttctgagttttttggactttggaatatttgcattatacttacaggtggagcatcccaaatctgagaattcaaaatctgaaaggtgacaatgagcacttactttgagtgtcatgctgacattccaaagtttcagattttgaagcatgctggatttcgagtttgtggattagggacgctcaacgtgtattaccactgaactcctctgaaaaagtgttttggtgagaaatgtccaaactagggaagagcttaagaatgacataaaagaagcacatacataaagtatatcaaggtggaagtgtgacaccactctgccctgtagtcagaatggcatcttggttctgaatgagaagtaaagtttgccaagcatcaatgtaaagaagtggaattagacataccaaggagaaaaaagttccagttcaagcccaaactaagcttcaatgcccaagtaataaaaaccctggcaaattatttacagctctttaacacattcagtcactgcttactggataccaccaccttgtgaccccaggagagatggaagcctcgctgcatcttccttccttcctcagagaaggtactaagagatgccacacactaccctggctttcatctccacatctctctggtgggctcttttcatctacattcaacatgagagctcctcagaacacagcctcatgccctctagatttcatttgttttctcctttagccagtgcttttccaactctggacacctaatcatttagggatcttgctaaaatgtagattgtggtttgttaggtctaggggggactcagatttctgcatttccaaaaagctcccaggtgactcccatgctgctgtccccagaccacagtttgaggtgcaagttttcattccaaatcttgaaccagaaaaatcaataaagtctatgagttttgtttgtttgtttttaagacagggttttgccatgttgtccaggctggaggacagtagctattcacgagtaccatcatgtcatactacagtctctaattcctgggctcaagtgatcctcccacctcaacctcccaagtagctgagattacaggcatactactgcacccaatttatgactcatgttttaaaaagcaaatcatgaccattttaaaagtaaattcctatgtaaaagatggctgtgagcccacaattgagttaatacaaatcaatcaatcaggaaacacaatggtacagattgggaaagactgagtctgagggtgtgagaaaacaaagttttcttaatgtgagaagctaccagatcacaaagataaagagaagctctgctgaagaataaggcacattttacaatttaatcagtgctgtcaatgatgtttttcacaagtccacatgtggctcccaacagaatgtacttgtgggtagagccaaggcataaaactcacatagaccaaatacaccctggaaagtagaaaccaataattatcaagaagacaacgaggtgagatgcctaagcgagtttttgggattctgtatgaaagagtcaaacaataggacttcatcatgtggggttttcctgaaactctgaccaggactggtccttaaaaaaaaagacaaaatatgtgggcaatgaacaccgctaactacatactcaatacctatctccctttgtccccaccaaaagaaccctgactttgtcctgagcagcaacaaacccagctaaaagttctcacttttccacactactttgcagttaaggaaaactattaaatatataaaaagttcttttgaaagaaattaactaaagatttcctgggaaaacattttgctttcctgatattgccattgcccatttctctggaattcctcctccctcatccagcctggaatatagacgtaataccacgaagtaaagcagttcactttgggactatgaagaagatagttactagaagtctgaaactttttggtctcaggacccctttatcctgtaaaaaatgattaagggccaagcgtggtgactcacacctgtaatcccagcacttgggaggccgaggtgggaggatcacctgaggtcaggagttcgagaccagcctggccaacatggtgaaaccccatctctactagaaatacaaaaattagctgggcgtggtggcacatgcctgtaatgccagctacttgggaggctgaggcaggagaactgcttgaacctgaaaggcagaggttgcagtgagccgagatcgcgcgactgaactccagcctgggcaacaaaagcaaaactccatctcaaaaaaaaaaaaagaaaagaaaaagattaaggactcccaaaacctttggattatgtagggttttatctatgggtatttgcaatattagacattaaaactgacagcgtaaaaactatatctcttaattcatttagcattagtaataaacccagttaacataaataacatttcaatgaagtttaactattttctcaaaaaaaaaaaaattagtgagcagagtggcactcctgtacatttttataaatctcattgtttaatagaagacagctagattcctgcatctgtttatgtattaaatctcttctgatctgatgcttttgtgaggacccattcaaaactcagagttgacataatcatgattttaagctgaagacatctgatattcaatgaatgcaggaagaagccctctccatacttcccttatatgattaaaagcagaaactgtgacaaatgaggctgccataaattccctcttcaacggtttactcccaggaaggagatcaagagtaaacgtaccataattcccctgtctaggaggagttttatggccatgaagaagaggaaaagacactcccatctacacaaacattatcacaagctttcttatctcttaatttgttaggaggggaggggaggggaggggaggggatgctaggggaggggagggagacaggcaggaaggtggggaggggagaaaggaaaggaagaaaagagaaaagagaaaaaagaaaagagaagaagagaagagagaaaagaaaagaaaagaaaggagaaaggaaaagaaaaactaaaagcagcaggaaataaatgactcatcatattctccatggtacatgggaaccacaaaaagattaacagctgacttatcctcagaaaccagggaggccagagacagtggaaggacataaagaactcaaagaaaaaaaatgtgaaccaagataattatattcagcaaaactatcttcaaaaatgaagatgaaaaatacattcatagataaacagaaactcagagaattcattgcaagtggatgcacctgaaaagaaatactaaaggaagttctttgagttgaaagcatgtactgccaaacagtagtcaaaagtaactgtgtaactataagacaatataaatgcatatatattttgcatatatattttcctttcttaaataatttaaaaaggaattatataaaaactatgtttataattgtattgttaaacctataacataaagaaatgtaatgtatttaatagtaatacaagataagtgggtacaaagttgtcatcattatactaatatcagacgaaacagaattcagaaaattttaccagagataaagagggacttctactatgaaaggttggcataaggaaatgatatcacatggaaactctacactgaaacaaatgaagataataaggagtgctaactttaaaataacaaactgtataaacatataatgctctcctttcctttatgtctttaaaagacagttaaataaactaataactgctacaatgtattgttgggtttgtaacataaatagatatgtataaacaataattagtaaagaaatagaggtacataggaggaatcattctatgtcttacaggaattaaatcaatatgaatctgaagaagattctgttagaaaaatatatatatatatagtaaaccctcaaccattaagaaaataattttttaaatagcattagaaatcttttttaaaaatcatttaaggaattaaaatattacaatacaaaataatgcaaaagaaagcaataaaggaagaacacaggaacaaaaatggcaagacacatagaaaacaaaaagtaaaatggcaaacaagcaaaccatatcattaatagcatgaactgcaaatggattaacaaatcaacaggaagggttgtcaggatgtacaataacacaaaatccagttgtattctaagttcaggagatacaattagactcaaaattataaacaggattacagtaaaagaagcaaaaagatacatagcacaaaaacaaccaccataaaaaggggtagtcattatattaatatcagataaaaaagacttaggaaaattttactagagctaaagagggacttttactatgataaggtcaaccatcatgaaggtataataattataaatatataagcacctaatatgaaaaccacaaaatacataaagcaagaactgacagagctgactgaaaaacagataatacttgcagacttcaaaatcctgctttcaacaatgaacagccgagctatgtaaaagacttgaacagcactaaaccaacttgacctaacagacatccacagaatacaaaacccaacaacaacaacagaatatacattcttctcaagtgcacaacaacagactatagagtagtccacaaaacaaacatcagtaaatgtaaaaggactcaaatcatatacagtatgattctggctacaacagagttaaactttagagttaaatgttattgtttatcaacagcagagagaaactaccaaattcacaaatgcggaaattaaacaacaaaatctgaaataaccagtaaatcaaaaaagaactcaccaaaaaaaaactagaaaatttatttgagattcataaaaatgaagtcacaaaataccacacttacacaatgcaactaaaatagtgcttagggggatatttatagctgtaaatgacaagattaaagaaaggtacagagaaaacgcagtcatatgtaagtcagaaagaaaggcctaccagaaaccaaattttctggcaacgtgattttggacttcttgtctccaaaaatgtgagaaattaaatttctgttacttaagccacccagtctgtggtattttgttatggcagcctgaacagactaatacaaacatctactaaaaaactacaggtaacattatacttaatggtgaaagattgaatgcttactccctaaattttaacagcaattctatctgctttcaccatttctttttaacattttaattgtggcaaaatacacacaatgtaaacacaccatcatataaagtatgcataatataaaattcaccatcttaaccattttaagtgtacagttcagtattaagtatattcacattgttgcacaatctacagaactttttcatcttgcaaaaactgaaactctatactcattaaacaattccctatatcttcctacccccgaaatatttttaaaaatttttactttctgtttctatgattctgactactctagatactttatacaagtggaatcataacagtatttttctttttgcgattagctcacttcacttggcataatgtcctcaagattcctccgtgttgtagcatgtgtcagaagcctttttttttttgagaagtctcgctctgtcacccaggctggagtgcagtggcatgatctcggctcactgcaacctctacctcctgggttcaagcaattctcctgactcagcctcccaagtagctgggattacaggtatacaccactacatccagctaatttttgtatttttagtagagatggcatttcaccatgttggccaggctggtctcaaactcctgacctcaggtgatcctccctcctcggcctcccaaagtgctagaataacaggcgtgagccgctgtgcccagccagaatccttttctttttaaaacaaatgtgaaactatatgcaataaatgtaccatattttatttattcattcaccctttgatggacacttgtattgcttccaccctttggcactgtaaataatgttgctatgaacacaggtatacaaatatctctttgagacctggcttttaattctttggggtatatacccagaagtggatttcctgggtcatacagtaataattatcttttactttttaaggaactcctatactgttttccattgtggttgcactattttacattcctattagcagtgcacaatcagcgttccactttgttcggatcctcatcaacacatttttaaaatatatataacagccatccttgatggttgtaaagtggtatctcactgtggttttgatttgcgtttccctaattatcaatgatgttgaccatcttttcatatgcctactagccatttgtatatcctctttggaaaagtgtctattcaagcattttagaatcagattatttgttgctgttgagatgtaggagttctttatatattctagatattatccctttatcagatatatgatttgtaaatatctcccattccctaagtggcctttccaccctgtccactgtttcctttgatgcccagaagttttaaattttgatgtaatctaatttctgtatttttacttctgttgcctttgcttttggtgtcatatccaaaaaatttttgccaaatccaaagtcaagaagcttctttccctaggttttcttttaagaattttatagttttaagtcttagatccattttgagctaatctttctacatggtgtaaagtaagggtccaattgtattcttttgcctcttaatatccagacccctgccacccccaccaatatcatttgttgaaaagactgtcctttcctcactgactagtctcggcgccattgtgggaaatcatttggccaaatatgtgaggctttatttctgggactctctattctattccattggtttctatgtctatcttatgccagtaccacactaacttgtttactgtagctttgtaataagttttgaagtcagggagcatcacaccatcactttgttctttttgttcaaattgttctggctattcaggatcccttgtgattccatataaattacaggacagatttatctatttctgtaaaacaaaagtcactgagattttgagaaggattataccgaatatacagattgatttgggcagtactgtcatcttaacaatattaagttttccaataaacacaggatgtcttcccatttattttatgtcttctttaatttctttcatcaatatatagtagttttctgtgtataagtctttaccactttggttaagtttattcctattttatgcatttttgatgccattgtaaataggactgttttctcaatatcctttttagattgttcattattagtatatagaaacacagctgatttgtgtgtgtgtgttgattttataacttgaaactttgctgaattcatttagtctgattttttgtttgttttgcatggaaactttagggttttctatataaaaaattttgtcatatgtaaagagataattttactcctttccaattttgatgctttttacctctttttcttgcctaattgctcagctaggatttccagtaatgtgttgtacagcagtggcaaaaccaggcaaccttatcttgctcctgatcttagaggaaaaattttcagactttcgccaatgactataatgtcagctgcagacttttcatatatggcctttattatgttgaggtagtttccctctattcccagtttcttgaatgttttctactattctgatgcatcatagtgccaaaagttctagccaccacaattaggaaaataaacaaaataaaaggcatatatatcagaatgaaagacataaaaatctctatctgcacatgacatgaatgcttatgtagaaaatcctaaggtattaacaatagcaacaacaaagtcctcgaaggagtccagcaaagtcagaggatacaaaatagacatacaaaaattaactgcattgctatatatatatatacatatatataacacacatatagcaatgaacaaaagaactcacaattactattatagagccactctaaaaaaactgaagtatttaggtgcacatcaagtaaaacatgaatctgattgctgatgctgcaaaaaaaattgatcaaaaatgatctcaacatataaaaatacatactgttcctggaatgaaaaattcaatataatgtaagctgacaactcttccccaaattgataaacagcttaaacataattcctatcaaaattctagcaagttttttttttagatatagacaggttattctaagatttatatggataggcaaaggaactagaatacttaaaacaatcctaaagaatcctaaaagaataaaaaaactgggagaaatccatccatccaatttcaagaactaatatacagccagagtaatcactactgtgtggtactagtgaagaaccagacataaccatcaatggaacaagacagagaatccagaaatcaacccatacaatatgcccaactgatttttaagaaagcaattcaatagaggaaagagaattttcaacaaatgatgctggaacaaagcaatgaactttgacttgagtctcaaacttatacaaaaattaactcaaaatagttcatggacttcatgtataatctaaaaccataaaacattttaaaaaataggagaaaatcttcaggatttaaggttgggcaaagagttcctatactacacacccaaagcaggatccatttaagaaactgatcaattaaacttcatcaaaatcagaaacgtttgctccatgaaagaccccgctaaaaggctgaagataaaagctatagcctgggggaaaatatttgcaaatgaatatccaattaaggactagtatttagaatacagaaagaattcttagacctgaacatttttaaaaatccaattagaaaataggcaaaacatgtgaagggacatcttaatgaataggatactcagatggcaaataagcacatgagaagatgttcaacatcactggccattagataaatgaaagtaaaatcacaatgagatattactacacacctatcagaatggctaaaaatttttttttaaataatgacatcaccaaatgttgaggatataaagaaactagatcacttatatattgcttgcaggaaaataaaatgacagttatcctggaaaaaactttggaagtttctttaaaaattaaacatgaaatagctattgctctcctgaagatttaccttggagaaatgaaaacacatgttcacataaaaacctataggtgtctatagcagctttgttcaaacaaatgtccttcaacaggtaaacggttagaaaactgtggtccgtgcataacatggaaaactactccactagtaaaaaggaacaaactattgataaacacaaacctggaagaaatctccagagaattacacttaatttaaaaagccaatcccaaatggctacaaattattccaaacagtaaacgagaaagtacggtgctggcaaatatttgaagaaatttgttaaaattttcccaagtttggagaaggacataaacctatgcattcaaaaaactgaatgaactacaagaaacctatgcccaggcataccatagtcaaattaatgaagacaagaagaaatctggaaagcagagagaaaaaaaggatgcattacttatagaggaacaatgattcaaatgactgtgtcttgctcatcaggaaaccctcaaggccagtagtcagaagtaacatcatttttcaaatattgacaaaagagacctgtttacctaaaactaagtatgtggtgaaaatatatttcaggaatgaagggaaataaaaacagtcacagacaaagagtaacaacaagattagcaaccaacagaactgcttaaaagaaattcatcacatggaaggaaaatgataccagaaaacaatgtgtatatcagcaataaagaaagagcaacagaaaggctaagcattcagacaaaaacaattgactattctttttctcttgattctttacatttgacggctgaaagcaaataataataataataatacattctatgaggggctctgaaggtatgcaatgtagaatgtaagataactgtaacagaaagggggaaagtgaaagttgtgatatattttctatattttagcgaagtttctacactacaattgaagtagcaaaatactgattctaaatagactctgagaagtatgtattttgtaactcattttttaaaaagcaaagagatagtcaaactccaaatagataaatatagcaacaattaagtgtacataaacactgcaattacaggacacaaatgtggagaactgactttttaaaaaaacaaccaattatggccgggcacggtggctcacacctgtaatcccagcacttcaggaggctgaggcgggcagatcacgaggtcaagggatcaagaccatcctggccaacacggtaaaaccccgtctctactaaaaatacaaaaattagctaggcatggtgacgtatgcctgtaatcccagctactcaggatgctgaggcaggagaattgcttgagcccgggaggcagaggttgcagtgagccgagatatcgtgccactgcattccagcctggcgacagaacgagactccgtctcaaataaataaataaataaataaataaataaataaaataaaaactaaaaataaataaaaaacaaccaattatatgctatctataggaaactcgtttcattgatacaggtagtgtaaaataaaggaatgggaaaatatataccaagcaaacacaaataaaaatttccaaaaggtagaaacaactcaaatgtccatcaacacataaatggagagacaaaatgtggtattatccatacaatggaatattattcagtcattaaaaggatataaatactgacacatactacaatatgaaccctgaaaacattatgctatgtatgtaaaagaagccagtagcaaaagatcatatattatatgattccatctatataaaatgtcaaaaataggcaaatccacaaagacaaaaagtaaattcgcagttaccaaggattgtggggatgggagaatggggagtgactgctaatgggtagagggtttcattttcgggtgatgaaaatgttctggactggcacagtggtggcagctgtacaaccttatgaatacactaaaaatctactaattgggcactttaaaagggtgatttaatggtatgaaagctgtatctcaacttttaaaatatactaaggtctggcctggcacagtggctcacgcctataatgccagcactttgggaggccgagacgggcagatcacctgaggctgggagttcaagaccagcctgaccaacatgtagaaaccccgtctctactaaaaatacaaaattagtgggcaaggtggcacatgcctgtaatccaagctacttgggaggctgagacaggagaatcgcttgaacctgggaggcggaggttgcggtgagccgagatcgcgccattgcactccagcgtgggaaacaagagcgaaactccgtctcgaaaaaaactaagatccaaaaaataacctatgatgtataaaacactgtgctatacaccttgttttttctccagtgttttttctgtataagctaatcaatacaggacaccagctatctaattacaagccattagcacaaagctagcactggatattggaaatttaagtgaatggacactcactcagaatctaacaacaaaacaccatacagtatgaatttcattcttatactgtaaacatggtgaataaatatagccaattttctttctagatggtgtttcctaaatttaaagaggatactaatgactataatcagagctaaggatgtcaagattcatgttcgcgtatctggcatgtttaaaagaaaaatatgccaatttgctgaaaatactgtcacttttagcactagtatttcccttactgcgtccctcttcctcctgagtaggggcttatactgagtggccagagatcattaacaattccgacattctacaaaggtggccctacattctgcatttctacttttataagagacataaatttcattttattgctcatttcgagctgttaattatatatacaattaagcacttatgccttcttgcctttaatcaagatctcactgttcaaaaaacaagacatattattaatccagctactcctgaataagaaagaaggattgcctacttcacagcacaggatcaagacccgccttgatggctccctccatggctcagtttgtccctatcacaaatcagagtttccaacactattctctcctttaccttcccctgaagagccctaaacttctcagcattgactttcagtaggattgggtccccactcccagtcctaggggtagacactatcctaaaacaatccctgtggcaagagactgcctgacttcacttgtatctattaagccaatttcacatattagggtctgttacttgcaactacccagttgctatcgccaaattctgttacagttaagttgctatccatttatttgtttttaatcaataccacaggcttgtaattaatgccagatgtgatctagttactgtttaagccagaaaacttctgtttcccagcaacattctacccctactttttcccacagtgactggttgaagaacaagataacattaattgctttaggccaattagagccatctggagctacaggtgattctatcctattcaaaccacatggctgtgaaatttgggacctccaacaaattatttcccaatggggattcggttttatggtctggccattttataaaaatctctaatctttgtgaatggtttaatgggtgagcaactataaatagtctggtttgttagtttttttctgtttgtctatttgtctgttctcaccacgaatcaattaagaattcatgctcactgggaagagagcaactctttgacacggactgatgagttttataattctgtatttgccatggccccatagttgaaatttcagaattgaagtcataaactctttccgcatctgcgtgtctatgtgtaattcagaaaggctgttgtctttcaatgtgtgaaggtgcaataattttctacctcagaatgggattaacaaattagattataaaatctactacattatgaaatctcttaaagtaatatattctgatttactcatagaggtaaataagtacatatataaacagaatattcctaaatttcccagaaaataaggaggttgaagatctaacactttcaagaaaccaattattgagctgtattaagaaatcaagttcacataaaaaaagcaaatctttggaaatgggaccagtttaatatttatggtttaaaagaaacagttgtatctttactgatttatcaatattaagtataagcatagacttttattctatttgggtacgtcattcataaacctatacaggtttactgattgaataaactagcgttacttctacttaatgtctaagattatggaaaaggtaaatttgtgttcaaccaaacaaaatcattattctgatgaccttgtatttcaacagtaattatgtcttgcaatatatcagcttgaagacaaatttccaagatctttaggaaacttaaaaactcgaactggtatcaatttgaattaactaatgaatatgcactcaatactgatctcatttctaagtaagactgaatattgagacatttataactaagcataaatttaatattgtcacgcacgtccatgtgaagagaccaccaaacaggctttgtgtgagcaagaaagctttttaatcacctgggtgcagatgggctgagtctgaaaatagagtcagcaaggggagttggggtggggcagttttataggatttgggtaggtagtggaaaattttcacttcttttgtgattcttcagttgcttcaggcgatctggatgtatacatgcaggcttgggctcagaggcctgacaaatatacttgtttcttatttttatatgctacaaagaggctatgtctttggctcttttaatcagttaaatgtgttcatttttgccactcttgagacttgtacacaatgaaagtgtacacacagttaaagttgtgttagctctggatgttagctctgctagtttgctaaaacagtggcatgcaacagctcacaattatccactccctagttttctctgtgtaataaaagttactttggctaaaagttatcaataacatgtgaatgagactactagaacaatggtggcaggcaggtacaacactacgtgtgaggtagtaggatgggttttgtttattaaggaaaaaaaaatagttttgtcctaaaataaaagggctggttgttccagaacgagaaagagggttgtctcagtctgttcgcattactataaaggaatacctgaggctgggtaatttataaagaaaagaggattatttggctcatggttctgcagactatacaagaagcatggtgccaggatctgcttccagagagacactcaagaagcttcccattcatgatacagggagaaggagaacagagattacaaggtgagaggaaggacgacaggtcaagagagcaaggagggaggtgtcaggctcttcttaatatgatctcagaggaactaagtgagaatttatgcattacccagaggagggcattaagccattcatgagggatccgcctctatgacccaaacccctctcagaagaccctacatccaacattggggataacatttcaatatgaaatttggaggggacaaatatccaaactacatcagctgtaaaggacaaaaattgatatagaaagttgtagaagatttgagaaaagataattttacttgccttggccaaagttagctcagttttgaaaaaaaaaaaaaaagattttataaaagtgcttgtagttcctgtagtatcaaatattacactgatacaatactggagtttggttttctctgttgaaattagaaaattttcttggattattgatctgcccttagtaagagattgtaagatatctgctgtataaataacaaagattctgttttaccaaaatagttttctgtgcttttcatgttgattgtacaatgtccttgattaaatatttctcacttatgaaagagccaaatgctttacaatcatgtaaccttcactttattttcaaatgtttggatgtcactttgaaatgagtaggaaagtatttctcaggcacctatgatctgattcctaagtgttgaaatctcctggtaacttttcatttatgtctttacaaattcaaatcctaaatgtaaaataaaataaaaaatttgagatacttttgggactaaaactgtctctgagatttataagagggcccatgaaagaggacaaaaatttattctttcacagtaaaaaaaaaaaaaaaaaaaagtactggaaacaattgtgtttgttactattgatgaaactgcatgggaggaattagcaaatcagaagagatttgtcaatgctctcactgtcatgattagtttctatttatcaaagtcctgatactctgcactgtatagctgttatcactcttatgttttaaaatgttaacttggttacaacttcacttttcaaatgtgaatgcagcatcttctgggccagtggttttcaattaaggattcacataatttactatggagatggagtttcattaatatacagaagcttaggacccactccagacttactagatcttttcacttgatattctggatacattattggtacataatatctaggattattgctatatttcaagattcatttctctgtaaagtttatgctcatctgcttttataaatcagatataatattacatcctttaactatagagttcattattacattttaaattgtttaaaatttttttattgactttattatcttgttttgcatgtcacagaaaccagatttccttgtcagttatatttttctcaaactctcatcagatccttcattttttgaaaatgatcagtaaaaaattaactgcagccattttaaatgtttttatctgcagacatctatttgttgctgttttattctgatgtttccctcagagccttttcaatcagctacaggccagaaggaatcagaaccccatggaaaagggctatgccaggtactttggggcacaggcttctaaatgacattgcttaaacaactttcagaccataccagtggcctaagtcagaatttccaggactcttatgaggaagccgatgggttgataatactactaaccccacatccagtggaacaaaaattaactagatatggctgaatgagctaatgagggatgactgtagtttttgtctggaatattgttgatgctgtttgaatgtattttccagacatataaggaagccttttctctttcttcttaaagctatctataactcataacttagtagactctgcttttgtatactgaaatgaaacacttgtaaacatcttattctccctgcttgagccctccaaagttcagaaacgtaataaatattctattttcagggcaataaagttatttgcatagattaaataagaatctgtcctcttttttactaggacataagtggaaatattggttttgcaactaaactcacatttgaaaatgatgctcattcaatcaaatatgactaaacacttttaagtgttctggaactaaggaactaagactgcctttacagagtcatccttacaaagccttctttggaaaaactggcttacagagttcccagccttgcaggtgagtaagaaaagccacttcctgggaggcccatgagtcttaggatattttagggacctcaagaaatgaggaattcttataaataaaacaggtgaaatctgatatagagttattggcatagcttcctagccttaagatcactagtaacaagaggctttaaaaaatccaatctgagattcctaaagaaaacgtgcagcagagcaaacttaagaactttaaggaacttttaacactcttgctgtgcccagctgaacaacgcctgtaatctggggaaagaagactaaacatctcatacgtgcctgacttgaagagtagcgtagggagaagacagaatgggatagagtagtacagtctctcaaatttttaaacaaattctaacatcgggaggttggaaactagaattattcagcttacagatgctttcagcttgtgcacagagagaaggccatgtcaagacatggagagaaggccagcaagagaggccacaccagaaactgcacactgcgagaccctgatcttaagactttcctacctccagaactttgagaaaatgaattctattatttaagccatgcagtctatggtattttcttatggcagcccaagcagactaatacagttagtaaaatagatttgggaaaattatgacataatctacatctatctcaaacataaaaggaaaagccaagtcgtcttaaggaataacaaaaatggcataaagtaccattttacaagaagttcaattttgaaataaaatttagtacatattttagtcactaaaattttaactcaggaaaaaaacaattacatcacagaagtcaagacaggaaaatttatttcttataaaactatatttcaacaaactaaggtaatttatttaaagtaacgtcaaaatgcatcaatatttgtcttcagtataataatatagtccaaatttctagtaatgtgattatctgtttccaccactgctttcttttttaaacctcattgtggcaataatgaagttaacaagcaactagaaaatatgaaacaaccaagcacaagaccataacagccacacatttgttctaagccattcatctagggtctctggatttcagctttctcctctataaagtggactatgtggaagtggaaggaggaggagagtagagttaatgaagatgacccctttggttcctctgagagtcaaatatctatggggaatatgttgccctgcttagcgctgctcagcaccacacactgcagctgaaaattcacccttaaagttatgaaaaaatggatttatagttccccaagcctttctaatatagactgataaattaaatgctttttaaaagttacatataacatatgattagaatcataatattttagtaatgtactgaagaatacaatcttttccaaatgctttctccattaagtatttttcattttcattttctgaatatgaagtaagggtttgctaaaaacaaaggtctttgtattcattgctgactttttaaaaatcttaattatacattagtaaaatgaacagataaatttctgccattttaaaataatgtatccaataaatacacgaaaaccttgaaataatctatgtcaatataagtcagaattcatttgctgtaaaggttgttatagaaattataacactgtgccctctccctctccctctccctctccccacggcccacggtctccctctccctctctttccacggtctccctctgatgccgagccgaagctggactgtactgctgccatctcggctcactgcaacctccctgcctgattctcctgcctcagcctgccgagtgcctgcgattacaggcgcgcgccgccacacctgactggttttcttacttttttggtggagacggggtttcgctgtgttggccgggctggtctccagctcctaaccgcgagtgatccgccagcctcggcctcccgaggtgctgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgcctcttcctggccgccatcccgtctaggaagtgaggagcgtctctgcccggccgccatcccatctaggaagtgaggagcgcctcttcccggccgtcatcccatctaggaagtaaggagcgtctctgcccggccgcccatcgcctgagatgtggggagcgcctctgccccgccgccccgtctgggatgtgagagcgcccagccgcgaccccgtctgggaggtgaggagcgtctctgcctggccgccccatctgagaagtgaggagaccctccgcctggcaaccgccccgtctgagaagtgacgagcccctccgcccggcagccgccccgtctgagaagtgaggagcccctacgcccggcagccaccccgtctgggaagtgaggagcgtctccgcccggcagccaccccgtccgggagggaggtgggggtcagcccccgccaggccagccgccccgtccaggagggaggtcggggggtcagccccccgcccggccagccaccccgtccgggaggtgaggggcacctctgcccggccgcccctactgggaagtgaggagcccctctgcccggccagccgcccagtccgggaggtgaggggcgcctctgcccggccgctcctactgggaagtgaggagcccctctgcccggccagccgcccagtccgggagggaggtgggggggtcagccccccgcccggccagccgccccgtccgggaggtgaggggcgcctctgcccggccgtccctactgggatgtgaggagcccctctgcccggccaccaccccgtctgggaggtgtacccaacagctcattgagaacgggccgggacgacaatggcggttttgtggaatagaaaggggggaaaggtggggaaaagattgggaaatcggatggttgccgtgtctgtgtagaaagaagtagacatgggagacttttcattttgttctgtaccaagaaaaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggctgcagggtcctctgcctaggaaaaccagagacctttgttcacttgtttatctgctgaccttccctccactattgtcctatgaccctgccaactccccctctgcgagaaacacccaagaatgatcaattaaaaaaaaataaataaaataaaataaaaaagaaattataacactgtaactgcttcctacagtgctatatgagcaagtaacctttctagaaagacagttaatggtctttagtgcagaatgtactcattcagaaacacgtttattaaccacctactatgagccaggtacaggtccagcccctgcgaatgatgagtgaacaaaacaaagatccctgctgttgtagagcttatgaaaacagtgtagaaagagattgtccattttctctggttgtctcagagctcagggcttgtgttcaggggatgtttgttagagttttaaaactataaatgatatatttactgatgaaatagtgtattcaatttggcctggattccttaatactctggctcttttcatctttgctatttgcatgtccccacagctcaagaacatctcatagcctcagcaaagttaacagagacggcatccacaaaaaatcagacagagggagcaaatggcaacactggaacagccctgccaaatgaaattacatgtctggcttacacacacacgtgggaaataataccacaaaacagaacaaagaccctttgttctgtcttctatgcatttttccaccctatgagaagctaaaagatcttcccagaatgaatgctccagcagaaagaattggagtggcttctgaaaacaacacttcctctagaaaatagcaatagagcctgaaggtgcgttcattaaaattatgaactcagttgtctttctcagggtttttcaaagccataactccataatttaagtgggcaatattatatcaataaaaaagatttttttacatcaagaataagacgatacatttaaaaatgctataatctatatgtttaaatgcttactggcttaagaatacttttcgcaatttcaagaaacagttttgttagaaacaaagtacatcattgaaaatgaaattaaaattaaactgctaagtttttctggctgggaacctcaagagtgaggcatccttgagcaactctgggttctacacgtctgttccataaagcctaatggcatccctgaatcagtgagaaaccaggcacagctgacagggcacgtctcctacctgaagcttcattttccaacaagaatgcattggtgtgcgctcagtgcagcgcttccccgcaacatggtccctgtgcttgatgccggggaacaggcgctgcctgcacagcagctgccaccctacagctgccagcagcagcacatggctggctgtcgcagctggacttgtgagggcttgctgaagccctcagcataccactcctgccatcaaactggactacttcctccagctgattttcaaggaacgaggcagtgaatgaataattcatgacaagtccattctagcaaccaatttcacctctgcctatagtctccccatagcaatctgcaatgtaacgattctaagacttacttggtgccatacaaggaatgaaagctcagtttcccgtcaatgacagtaaatgttacaggatctgtttgctcttcctgtgtgccaacctgtcacccagacttacttgaaatattttttttaatgtagaaaagctaaatgattaaccacagatgtctgacagaacaaaacaaaatttttttccccacaaaacccaccctacataatgagttctggatgcagaaaaagcagcaaaatgcttgccctgtgatcagcaggtcagtatttacatttagtaaaagatcagttcctgcagaccatcatcacagggtgggggaggggagctctgcgtatcaatgccaggaaacaaactgcttcaaggaggaattttcctggtttcaggctataaataaatcgtccatctcattggtattcttctaggaagtacatgaatattcattttcaccaatttgtccatgcttacatatttccaaatgagtcatatctaaagaagtcaattttctgcaacttaaaatcatcattccaagacaaacttgaaccagagaagggaaggccaataatggtatcatctcaactgcacctgtaggcagtccaatcacctgtaatgttctccacctgtttcccatagccgtccttttttctcactgctgcaatgttttctcttctgaactcactgtaaacatctcaagcttttgctgtcactaaggtaatttttcagccatgagtattctgttcctcgctgcttctaatttatttgttgttctgcaacaaacaagttccccaagtgtttcttgcccttgtattttcccttttcaccttcttcttttcacctattttatcacttctgaacttatgttttataaacttctagttcctattatactattccacagtagataggaattctcttccttttttgcagggaaataatgatttcttccagtacagactctgcatcattccacaagcactgagcctttcactgtccggacatgtgtacagaggcctcaccaagtcccctcattgccttccacttcacaaggacattcgatctggcttgtgtgtgtgtgatgccgtgttgtctaggggaacccttcctcttccagctattgggagctgatgccgcattcaagcagctttctgcaggcatgctgcggagagggcagttcatggtgtgtggtaaagagacaaaggaaccagtctctattgaaagccctaactctgttctcttctcccagggatatccttttcctcaacattctgtaatcccctcaatgtcttacgagatttcatgtccaccagaaagtgtctagcccaagttgttctcttccccttttgaagtgacattcctttttctccaaatcctgaccacccactcccctaccccatcccatgaatgagaggataagagggcctatcacctgaggctcacaatgtgtcccttcttccacttcctgttctctacagagacttatttccttgatgttctcttttgccctgcgttctgctaactcccagtttcctgatgaagataatcagttctaaggttgatcactatgcttcttgtcttctctacttcattcccagcctagacacaagagatcactaaaacagtgatctccagtatgtttcattttgctaattattttttgtagagacagggtcttactatattgcccaggctggtctcaaactcctggcctcaagagatcttcctgcctcggctcccaaaatggtaggattataggtgtgagccactgtgcctggctcaaactgattgattattaagaatcaagtgtgggccaggcacggtggctcacgcctgttaatcccggcactttgggaggccaaggtgggtggatcacctgaggtcaggagttcgagaccagcctggacaatacagcgaaaccctatttctactaaaaatacaaaaataagctgggcgtggtggcacgtgcctgtaatcccagctacttaggaagttgatgcaggagaatcgcttgaacctgggaggcggaggttgcagtgagctgagactgcgccactgtgctccagcctgggtaacagaacaagactttgtctcaaaaaaaaaagaatcaagtgtggctaagagtgctcaaaaaaatcctcagaattaacagcgacataaagatcatttagtccaacccaatccagagcctcaatcctataaaatggcaaccccagctgtttctctcaacactcccagacagctctccagtcacctgccaaggcagctaaatctattcactctgctaaaatatatgtatgtacctccttattaacagccaggctcaccctttggcctgcagtatgtatgggaacactggattgtaaaagcaaattaaaaggacagacagtttggcacaatggtggcaacagtggtgagtagcacaacaagaagtcaaaacatggacaccaaatttccctggagtatcagctagttgacagtagagttgtgaatccactagcacttaaccaagttattaaaaacttttcttatggactatacacgtgaacaattctaccgatgttttagggcctccttccattccccatcccaagaatagtaatatgaatataatgtaaaaagagaacctcttaagaagggctcaaaatagtttggatatttgtctccaccaaatctcatgttgaaatttaattgccaatgttggaggtgtgacctggtgggaggtcgactggatcatgggggctgatccctcaggaatggtttttaccaccatccccttggtgctgtcctcatgatagagtgatttctcagaagatctggtcatttaagaatgtgtggcacctccccagacctcttgctcctgctctcgccatatgagacaacactctccctctgccttctgtaagcagcccaaggcctcaccagaagctgaacagatgccggtgtcaggcttcctgtacagcctacagaaccacgaggcaattaaacctctttatgaattactcagtctcaggtatttctttacagcaacaagacagcctaacataagggcttagaactgctataactaaaacttcacacaaaaagactctggaatacagtgcccttcacattttcttgtataccttcatgaaagtctatattctccatgtcctccttagcagactgatgtctgggtgaacaaatatataacacaggcaaggatttgcaatgttttttcatgacaaatgtcaaacaagcataagagactgctaggcactattaattgtaagtgataaactaaccctccaattttaagatgatcgtgatcttagcaatctatgtttcttgaatattttaagttaaaacttaatttttttgcattatcaggtacttctctcagagactaggcttcctggcagctaatacaagaggtgatgagtgcacatcgtatctcaggtgtctcataaagaattctggttgctcttggttgtctgagataaaaggcctgatgactatggaggggcaggctttcataagaattatcaatgaaggcaaggtgatggttatcaggcaagtccttccaaccttcagaagaactctgaattaaagttggactgacccctgagtatctgtgattctaccatcacagtgccacatcagtacagaaaagagagctccgatgacacagaacgcagtttgcagcttgatgacatgtgtattctcgcactgctgacattacaaccaagacctcagaactcttaagacaacagcaatggtatgtccttgaggcagcaggaaagtatcaacaacctacctgcctgcagttcacccattcatggattttccctgcctagactactgctctaaagactctgatctgaagaacttttgctttccatgatcttcaaaacctgcctcctcaaacactgcccaatactctagacgagatatccagtttgctctgacctttactgtacatgtttggtccttccagaatattaggagcttcctcaactcctaacagattgcccaagggagcatcctgtggaatggaaatccgtttccacattatctctgtaatgccaatcctgctgatctcagttcagcagcaaactgtaacccctggacactggtatggttctagagccctcttgtaactttcaagagcattcccaaagctaccagcatcctatcattgctcttggccagaatggctctaataaagcatgtatcatacactaatcaaaatggcttagcttttaaaccactgtacttgtgagaggacctagtaacaccttcgtaacacttcctttgtcagtgttacaaaagaagtaacaaggatcccaccaccttgtaaaagctctaaaagatatgctggaagggagtctacacacacaaaaaaacttctgacagatttcaccaactgctgtctttttcaatttgatcttaaaatgaaaatataaaatatgtgagtaaaaatttaaagtgccattcgtaaaggattgaatatatcttcattcaagcatgggtatcatgtggataccatccctttgttcatgagtaaggtatcatctgtacaataaggagttcctactctattacatgagataaacaggtaaacaactaacagatatgactatgtggcaaaactaaataaacgccatatcagagatacagatgctagtttcttgtatcctcccactaccacccatccatccacaatgagaacagaaaggaaggagacataagggaaggtttgggaagtcagtaagtagactactgcaataatctagatcaagggtcagcaaactttttctgtaaagagccagagaggaaatattttatgctttgcaagtcatattctctattacacctactcaattctgccattgtcagacaaaagtagtcacaaggaaatgagcatggctctactccaataaaactatatttatgaaaactgaaattttgatttcatatcattttcatgcatcgtaaaatattaatctcttgacttttctccaaccatttaaaaatgtaaaaaccgtttttagctggcaagtcataaaaaacagcagtggctggatttggaccatgggctatgatttgccagcccctgacctacacggctgcctgaaatacagcagtagcaccagggcagagaggaaggacaaagaaaacatttcagaggtggaatcagtaaaacttattgatgagtggcgcattaagagcaaagtcggcaaaaggagctccctagtttctagcccaggtgactcagagggaatgtcatgaacaaataagagcagcagctctccttcacctgaggaggacaacagcacctggagtgcaccactcactgcccaggtgatgagaactacgcactcagcagcagtgacccaagactcaaatcccacctccatcagttatcacatacccaacctttttgattctcagcttccaaatcaatccataaagtgatcatgaccacaacagtaatgcctacttcaaagggttgctgtaaggattcaatttagtgagttaacatatggaaagtccttgggacagtgcctggctcacagtaaatgatatgtaagtgttagccattattcgaaatataaaaattttaatccataaatgttatagaggcaatttataaataccatatgttggcctacttaaatacagtaaaaaacagtattcacagtaataaacattcttaagcatttaaaccatctgtgaatacttgacatagtatacagcattatttaagctaaataatatcaaattaagttcctttcatactggggaaaaaaatcaatgctgaagtagtgctggccaggataaactgtacaaaggtatgtgtggttcagggtaaagcaaagtcagtcttgagagttagaatgggacgagggtctaaaacaggtgacaagtacaactgtggcctgggctagtcaccagatttctgggggactccatcaggcgcttttcttatgttctaagaatttacctagtctacaagttccattctaccacacgagggggcgtgaagcaaataccaatgtgagattaaaacctgctgcaattactgtacttctaaaaacaaatcagtctgacagcaagaatgtaattacattttttattaggagatagaaaatacaaaatattttatgaggattaaatataattggaatattttctatgatttgataaaaagaagcattaactactttgttgaatgatacacatttcaactgaaagaaatcacaaaatacttttaactttgttctttatctgtaatatcttgaaaagttgctgttcaaaggtatattgctttctagttaattacccatcgtagcaactaaacctgtgaacagctaaaaaaaataatcaacttatctttaattacgttacattttttagaaaactattttcatcacttgaaactcactctgctttgcttttaagggtcttttccccaaaagttcttcattgaagaacaattgatggggaatgaagtcacttttataaatctacctatgatatatctgaatccagaatgtgcccaaataccttcattttgaagcctcttgaataagacaggaaaagataaactgcctaggcaggtataccatgatttgattaagcagtaaaaaagattacccaaaaccagtaattccaagtattcctttgtttgatgacctgatttttattccctagaacaatgcagcatagcaaaattaagagacatagtaaaatgtaggggcctttccttcttcagagtcgaaaactagctgctcagaaatgtgggtgcatgaacagttttaggctcaagtgtatgtggaaggtaaagatctgaaaatggagtcgttaaaactgcccatgcttctgctccttttggaaagtctgcctgtgcctcccagacatggtgcaaaccaatgtttacataagataacaaaaaatttggaattagatttaaaattatatgaatacctaggaagtgtgagataacttgcccattggcctttaaattatttcgtataatttactatttattattgtctactgcgacgctttcttcagctcactttcggcaagcataatcttttatttcccaaaacttttgatttgaaaaactttaaatctacagaaaagctaaaagaatagtacaatgaatacctgtctgtccttcacctagatgcatcaactgttataaaatctgcccatttactttttctttctctgatatacatattctgatgcataaaattaactgtaattctatcattattatctaatatatagaaaatattcagctttcccagttgtccaaaaaacacaccttacaggtatttatgtttttaacatgttccaccaaggtacacatattacactggttgtctttttagttttttataatctaagacagtcctcccacatttttctgtttttaatgataaacaactttttaaagtcaggggttcaaggttcaaatttcccccaaaaaactctgcatattaatttaataaaataattttttcagttattatcaaagttttgttggtaaaagatgctagccttgtgactgttagatttggggtgacaactctcagtggattggtatgggagggccactgaggcctgaaggacactatctgggagtggacacactgtgggagtgactatctcccacaaagtaaccatttcatctccaccactttccagaaaataagcagtctcctccaagttcagtaagaacccaaggtcacactgctaattagatgaaaagacctttgctctcagggaacagacatctacacaccttgggtaacaatcctggggtgtaatacaaatcagttgagcacatctttcccaatttgggtgtatgactgcttagaagtgctaattacgtacacagctagtaatacataaacactaccttaatcatcctaagcctaactcaaaaccaaagccctgaggcaaaagatgctattaagatgtccttgtaattctaccactgttcatgtattacctgaacagtgtgaatccaacagcagtgccctgctctgctttttaaaaaacaggcttctgaaatgtggtaaattgagttcttcagaaacaaacatgaaaaacacacaaattcggcattaggatgactggatgaaagggatgacagttcattccctatgcaaaagtggtatggaagatataaaacattccaagccaggtgtgatggctcgtgtctataataccaacacgtggccccccaagtgagctataattgcacccctgcacctcaacgtgggcaacagaatgagacccctgtctcttaaaaacacaaaactatttgatgcacaaatgaatgaaaaaatatgtgtgtgcagtctatattcatgtgcaagcatttttttagaggaaacaaaacaatatggaaaaaaatatacagtcaggcatttatctttggtgctgttttattcatgtgtaaaataaggaagtcatctcaataacatcacatatcaaaagccattaacaacgattacaggacactaggactgtagtattatttactgcaatctctgcattaaaaaataaattaggggcccaatagggtggctcacacctataatcccaacactttggaaagccaaggtgggaggatggcttgaggccaggagtttgaggccagccttggcaacatagcaagatctcatctcttcaaaataaaaaatttagccacatgtgatggtgtatgcctatagtcccagctattcaggaggctgggatgggaggatcacttgagcccagcagttcaaggctgcagtgagctatgatcatgccactgcactccagcctgtgagagtgagacccaatctctaaactaaataaataaaaacaaagagtgaaaaataaataaatatatttgagtggttttcttattttcaagttactgacagaaaatctgaaaaattatctgccacctagttgtccaattcacacaggacagctataagagagtagtgacaaccaagaaatcataatcatcaagtcctacagtgatacctagacaaacgtattcatacaccaccttgactcaacttatatgcaacacactgaaaccaactgcaaatgcttcacttaccgcacaaccagacaagactcttggttttacctagattatgtacactcttaactagcaaactctcactagaccaacatccacagaggtcagctacagttattctgtgcattccttccatctctaaactctaaataaataaacagcaaaccattaccagttctcaagttttacgtgagaattggctgatataggtaagctgctaatatataaaatagctggaatcgatattgttggctttttactaagaatatttaaaattgcaggacctcaaagttgcacataattttatctgcatttaagcttcaaaaatctatatatgcaaaagaaaatgtagatgtagccgttcaaatgggtcaacctgaatttaatgttttataacagcatactcttttttaatctctagaaaaacatcaaaacttctctttattctcaaagaaaacaagcctacaaagcagaaaatgaccatttagtaaagaagtcatctttggttcttaaatgttaagcatgctacaactttctatacatgtttgagccaactaggagatacttccaaggggtttcagagatcgctgtgattaccaaataggaaaaacacgcttggaagcagaagtgaaagactccagggagcaagaacaggtaaacaggtgacaaagaaattctggtttccaggtatgagaaaattaatctcttgtggcccttgcaggtaaggtagatggatgattcaagaagccacgcaaatgatctcacagatggtgatgcctaaccagacagtaatctgcaacaggtttattttaaagatgcatattcatctcttcatgaaaacatacttctataaaaaagctagaaatggtctaaaagacagtaactagaatgctgagagacccaactaataatacgtgattataagggatttttatcctgcagaataagactggcagttcctggaagcaaaaagtaaaagtgtcagtaagagaaagctacagacagtttggtcttatactgtatctcaaatctctggtagcccaaaaaaaaaagcacaaaacaaccgcctttcgaagtagtgggttagcatcagggctgatgccctaatggtgccctaaaaacaaactggccatgataatacagagtaggttcaagcattaaactgggagtttgcccacatggctctggagatactgcaatgttaaaattcaagaggttttctccaagttccttatattaggtttttattatttaaaagggaagaatttatctaatagagaaaagagaataatttttaagtagtaaaagtgtggtgattctgtctaaagatattgttatcacttgaacattgtgaggtcattttttcaaaagatgttaggtacaaatgaatacagtatgatctatcaatactcatgtgtttttagagcaaatacgaaattgtgtttactgaccatcatcctgatgctgcatggtaaaatcctccttttgacctcagtagcaggacaacagggccaaaactaggactgtttataaatatataaaataccacttttattttctgtgtagcttactttaaatataagttgatcattgaattaccttcttacttatcacctttcaggaatcctgggatacagatcatttctttcaggatccctttatcaaggaggacagggcagaaaattgaaaaatgtattttttggacaatcttgcaatttgggttccagacatgtagaagaattccagataattcatgtaaagactccaccttcaaggagggggagcacaactccccattctttaaagtgggctatgcctagtgacttccttccaaagaatgaagtacaaaaggggagaaaaagagtaactttatagtggagagacctgatagtcactatatcagccaggtggtcaagaaaatcagtcataaatcatgttgatagtatactcgatctgttgtgatgaactggtacattgtatctgtggacttccatcccaaaacctataaccctagtctagtcatgagaaaaatatcagacaattcccatagaaggacattccacaaaatacctgatcagtattcttcaaaactgtcaaggtaatctaaaacaagggaagtctgagaaactgtcatagccaagaggagcctaaggagatacaacaacaaaatgtaatatgctacatcctagagatgagatcctggaacacaaaaaggacattagttaaaaagtagggaaatctgaataaagcatggactttaaaactataatgtattcatattagttcactaactatgatgaatgcagcacactattttaagatgttaataatatgagaaactggaagcttggttcaagatggctaactagatgcagctagtacatgcctcttccatggaaagctccaaaacggcgagtagatattcacccttcaaataggtcatctaaaacagaacactggaattcaactgaaaagcaacaggaatcactgatcacaaaggagaaggaagcaaggcacgtgctcagccaggattgctgagagatgaaagaagcttctagatgctgggaaagggtagatgagagactcccagggctccacattcccaccatggacttttgcaacgctagctgtgggagacccccttgaccctcgcaggtctccagcctaatagagtgagttgcctggagattgacagaggcattgctcaaactcacatgggagtacacaggcttccgagccctgagcagctgctgctaccagccaacaagccaggctgaagagaggaggccaggcacttttacacaaccactgtgcttcttgtacagtctgcagaatagtgagccaaataaaatctcttatttataaattacccagccttgggcattcctttatagcacaagaggggacttcaacaccccactgacagcactagacagaccactgagacagaaaaaaaaagaaaaaaaaaaccccactggatttaaattggactgtagaacaaatagacctaacagatgtttatataacaagctacccaacaatcacagaatatacattcttcttattagcatgtggaacattttccaagacagaccttatcttaaggaatgaagcaagtctcaataaatttttaaaaaactgaaatcatttcaagttgtcttctcagactacagtggaaaaaacctaaagtcaattccaagaaggactctcaaatctatacaaatacatggaaattaacctgctcttgaatgatttttgggtcagtgatgaaattaagatggaagtttaaaaattttttaaacaaaagtagagacacaacataccaaaacctctggaatacagcaaaagcttatagtgttgactgtaaatggattcaagaaagaaaagtttatagcgttaaatgcctaaatcgaaaaaaatagaaagaccacaagttaacctgacatagtacctcaaggaactagaaaaacaagaacaaaccaaacccagaagaaaagaaatgatgaagagcagaactaaatgaaatccagatcataaaaacccaaaagataaagaaacaaaaagttgcttcactgaaaagataaacaaaattgacagcctactagctacattaaccaagaagaaagaaaattcaaataagcacaatcagaaatgaaaaagacactacaaatgataccacagaaatacaaaagatcatcagagtctaccatgaacatctctacactaacgaactagaaaacctagatgaaacaggtaaattcctaaagacacacaacctctcaagaatgaactaagaaagagaaagcctgaagagaccaataaccagtaagacttaaccagtaataaaaataaaaaaaaatctcccaacaacaaaaaaccccagaagcagatgaattcacagccaaattctaccagacatagaagaataggtaccaatcctattgacaacactgttcccccaaattgaagaaaatcctctctaactgaagccagtatcaccctaacaccaaatccaagcaaggacacacaaaaacagaaacagaatcaatcagtacccctaatgaacacagatgcaaaaacgctcaagaaaatactagcaaaccaaatccaacagcacatcaaaaaacatggtacaccacaatcaagtgggttatattccagggatacaagtagggtttaacatacaaaaatcaataaatgtgatctgccacataaacaggattaaaaacaaaaaccatattatctcgatagatacagaaaaagcatttgataaaattcagcattctttcatgataaaaaccactcaacaacttggtgtagtaggaacatacctcaaaataataaaacccatatacaagaatcccacagccaacatcatactgaatggggaaaggttgaaagcattccccttaagaaatggaagaagacaaggatccccactcttaccactcctactcaacacagtactaaaagtcctatcgggccagagcagtaatgcaatagaaagaaagaaaagacatctaaattgtaaaagaggaagttaaactatctctgtttgctgatataattttatacctggaaaaccctaagactcctccaaaacactcgtaaatttgataaattaattcagtagagtttcaggatacaaaatcgacctacaaaatcagtagtatttcttttgtttagttggggtttgtttctttgtttgtttttgaaacggtctcactctgttacccaggctggagcacagtggcgcagtcatagcttagcgcagcctcgacctcctgggctcaagtgatcctcccacctcagcatcccaagtcgctgggacttacaggcacgtgccaccacacccagctaatttttgtattttttgttgtgaggaggaatcagtagcatttctatacaacaatgatataatcaagctgagaaccaaatcaagaaccaaaccaagaagtcaatcccatttacaatagctacaaaaaaataataaaatactcagaaatacactcaaccaaggatgtgaaagatctctacaagaaaaactacaaaacgctgacgaaagaaatcacatatgacacaaacatgatcatgggttagaagaatcagtatcattaaaatgaccatactactcaaagaaatctgcagatgcaattcctataaaaatactaacattgtttttcacaatattagaaaaaacaatcctaaaatacccaaggaaccagaaaagagcctgaatggccaaagcaatggtaagcaaaaagaacaatacttgaggcatcaaattacttgacttcaaattgtactataaggctataacaaccaaaactattataaaaagagacacacaggtcaatgaaacagcttacagaacccaaattaaagacacatgcctacaggcaaatgatcttcttcaaagtcaacaaaaacatacactagtggaagaacaccctattctatacatgatacttgggagaattgggtaaccatatacagtagaatgacactggacccatatctctcaccatatacaaaaatcaacttaagatggattaaagacctgaaagtataaagacctgaaagatctgaaactataaagattctagaagaaaacctaggaaaaactcttctggacattggcctaaggcaaagaattcatgcctaggacctcaaaaggaaagctacaaaaatgaaaatagacaaatgggacttaattaaaataaaaagcttctacacagcaaataaataatcaacagagaaaacagacaatctacagaacaggagaaaatatctgcagactatgcatcttacaaaaagctaatttgtagactctacaaagaactcaacaagaaaaaaataacctttttaaaaaatgggcaaagggcatgaacacatattttgcaaaagatgacatacaaatggccaagaaacatttaaaaagttagaaatgcaaataaaagcgatgaaataccatttcacaccagtcagaatggctattactcaggtgtcaaaaaaatcaataacagatgttggcaaggatgcagataaaagggaatgctcacagactgttgttgggagtgtaaactagtacagctgctatggaaaacaatatggagacttctcaaagaactaatagaaataccatttgatccagtgatcccactactggggatctacgcaaagggaaagaaatcattatatcaaaaagatacctgtactcaaatatttattgcaggactactcacaatagcaaagacataaaatcaatctaagtgcccatcaacggatgattggataaagtaatccacatcatggaatactactcagctataaaaaaagaatgaattcatgtttttttgtagcaacatggatagaactggaggtaactatcttaagtgaaataactcagaaagagcaagtcaaatatcacatattctcacttacaggtgggagctgaaaaatatgtacacaggggcatagagagtggaataataacattggagactcagaaaggtgggaggatgggagtgggtgagggatgagaaattacctcatgggtgcttatgtgcactattcaggtggtgtaacaacactgcacttgtactaaatctataaataataacaatatgagaaactgggtgtcaggtatatgaaaatactccatcctagcttaacaatttttctgtaaatctaaaactagtctgaaataaacttttacttaaaaatgaaactgggccaggtgcagtggctcacacttgcagtcccagcaatttgggaggccaagatgggaggattgcttaagcccaggagtttgagaccagcctgggcaatagcaagaccccgactctacaaaatgaaagaaaaacttatccaggcatggtctatagtgccagctacttgggaggttgaggcaggaggatcatttgagcccaggagttcgtggctgcggtatgctgtgatcacgccactgtatgctagcctgggcaacagagcaagatctgtactcaaaaataagtaaaaaataataacaaaaatgaaaataaaactgaccgaagtgagggagaaaagcaaactcagaatagtcacacatgccaacaatgacagaaaagaggactaaaactgtcattatagctgttatttcatatactaaaaaagttgcatagagacatggaagatataaaaaagatccaaaacaaatgtctagtgataaaacatgtctgagatgaaaaacacactagacggaattactggcagattagatattgaaaaagaaaatattaatgaaattataaacaaagtaattggaatatccaaaataaaatgcagaaagaaaaaataaccttaaaaaattaaaagtgcagcagtggacaactttaagccagtcaatgtgtatactggagtccccaaagaaagaatggggggacagaaaaagtatctgaagaatagccaaaaagctccaaattctatgaaaattgtaaacccactgatccacaagcacaacttcagaatacaagaaacaaataaaaaatattttttaaataaagctgaaagaagtcattgtcagccaactcacattataagaaatgctaaagtcctttagacaaaagaaaaatgatagatggaaatacaccagaaatggtaattatctgagtaaacagatctttattattatttaaaagaaaagtatttaaagagaaagtatttttttaaatatattctagggtttaaaatttattaaaagacaataatgaaaaggccagaaggaaagaaatgaaagtatactattgtaaggttctcatactgtatttgaaataaaagatcatctccacagtgacatgacccatatcactgaaactgaattcatattcactcattcattcattcatcaactgtattgagtactgtataaaagtcattaaccctctgtagaagttatgggcttcagcgagggtgtgttaacagattagactaagcaaacaggtggattatttgagtctaggtaaaatgcaagggttcactcttcttatgggactcagtaggaataatatctcccaagcacaggaggatcagaaatcatagcaaaagattttgggttgaacctgtgccaggaaaaactgcataaataaaaatgggctccactggacaaaaatttacctttcaaatcaaacctgataccacaattgagaccctagaaacacaaccactattttcatcctgtgccattgctgctgaagctctcacggggccctgcaagttcctggttcaactgctcttccactactgccacctcatctgggctccacgacaccctgaactgtcaggctgccactgggtgttcaaaccatccccacactaaggtaagacagaatggtttctctttcttcccaataccaataaaaatccccattctacaaataattgattaatgctatttatttagaccttaaaaatcccatcaaatagataaattcaataaggctttattaaataaccacctacagtaaacctgcagtgagggtgtatatcaaaaagaatctcccttcctggcctaactgttggacattttcctttttctattccaaacaagtttgtatagcttccccatgtacacactattatggactaaatgtttatgtttcccacaaaacttttatgccagaactctaatccataatgtaatggtatttggaggtggggccttggggagacaattaggtcctaggggtggaaccctctccatgggatcagtccttctatatgaacagccacatgacagcttgcttccttcctccctctatgccatgtgaggacacagcaagaaggcagctgtttataagtcaggaagtaagacctcaccagaatccaaccatgctggcaccctgatctcagatttccagcctccagaactgtgagaaataaatgcttgttatttaaaccacccaggctatggcattttgttacagcagctagggcagactaagacacatattaagaaattccagccatctggtgtccaaatttcacactacgatgaataggaaactagcagcatcatgttctgagaatccaaagaacttagtcacagtgattaaccaaaaataatcaggtagatttaaccaatgaagataagtcatttataaccatttataaacagtagtttacaccaaaatctgaaaacctagaaatctacaaaaagacaattccttctgagtacaactatttgtgtgcttgtcagtatattatcagagaaaacctgacctttagagtttaagcactgttctaggtcatctttaataaaaatttaataaaaataatgaaactaaaaaagatactctcccagtacctgttcttccctctccttttctttggtcttacttctgtagactctagcagagatggcatcctgggatggaatggcagagatctgatgcagtggcatgctcatcccaacctcttatctggtcgtcttcttcacagaagagagtctccactggtagagtcattttgggccatggatttcaagctgagagaaaatgaagagagaataaacataactcagctaaaacactttaaatttccaagagtgagcttaacattttatacttatattcatatgtatatttaaataagttacggcaacataaatgtttggtcttcaaaaacaatagaagatgaatgtctaaggggaaaattctaacatttctcataataagatgggagcacctgaaagaggcaggtggatcacgtacatgtataatcagagatataatcttccattggctacttaggattaaaacaaagcagtgccaccatttattttaagaatatttttgaagttaaacttttttttttatcatgaccaagcatttgtcctgaaataagcagtgatctttccttaaaaccactgtctgtgagtccacataatggtgagatcagaggttaggaagtccaaattaaactcaaggtatctatgatccatacttaaccttccaaaagtagagactctacacgagctgttggcaaactattcctataaagggcaagatacatattttaggcactgtggtccaagtgtgttccagctaattaactctgccactgtagcatgaaagcacccatagagagcatgtaaatgggccgggtgcggtggctcatgcctgtaatcccagcactttgggaggccaaggcgggcaaatcacgaggtcaggagatcgagaccaccctggctaacacggtgaaaccctgtctctactaaaaatacaaaaaattagccaggcatggtggcgggcgcctgtagtcgcagctactcaggaggctgaggcaggagaatggcacaaacccaggaggcggagctcgcagtgagccaagatcgcaccactgcactccagcctgggtaacacagcgagactccaaccccccaacctcccccccaccaaaaaaaaaagagtatgtacatgaatgagcatagttatgttccaataaaactttatttacaaaaataggcagcaggctagatttggcccaccagactatagtttgccaaacactgccgtaaagggtttcctagggaatatgaagggtcaccatgacatgcctaagaaccatgagaaaggctgcctttaggtaaaataacagtgtatgcataaactgtcttcagtgattccaggtactcctgccctgtttctggttttctcttacgcatcccccaaaatgtctaataattgaattgtgtgttgttctttctccccacttacccactgagatctatcccactctgtatacaaaaccaattaaacgtaaattatccagaaggtttaatgtagtaaaatgtttcatgttgttcaaattttaacagaaaatggaagccttcaaccaaaagaatgaatctcgaatttggagattttcatttattaaccatgtgctggggtagggggtggggacaggtgaggcagtaggaaaaggtagggtaaacaacagggcctgacaaccccaaggtcacatttgataagcagtcacttactctacctctccccaaactctactctggatcaaaggcaggtgtttgtaaggctggtgccaattcttagtagtgtcactaagcaagcagaggagcaccaggaatcacgaaatggcttccttcacacaactctagaatcaatgaacaacaaaaaggaacaaaaactgggagggatcaacacatagaagaaaattagctaaaataataatctgtttataaagtctagttttacagtaagtgagtgaccattgataataacaacaaaaaaaggaaaatagaataggggatgttagtgtctaggtatcacacaccacctactctatttcaagcctttgatgaggctggcataagatggagcactactgtgcccaagaaacagtctgaatgtttgtattcaagcacgtcacacaaaacaagaggcacttactgcggagctgccttatactccctgggagatcacaatagtcagtggtaagcagttttttcatcactaatgcactaacgtcctctattacagatgacaaactccatggggcctcttggaatacttggtcaaactgacgatatccacagccctatacctaccatgccaaaagctacctgtggtgcttctgatataatcatcattattacatcattggtacatgcccatgacaagcctgagaagggctatttatggcacagaaacacagatgcaagagggtctcaaattttttacagttttgaaggacatccctcctcactgtcattgaagttagtcttttgatatgtaccaccacaacaaagcaacagacctataagtttgcctgaaacaatctccctcctatgccacacatatttaggataaaaatgagtttacaaacaaacgataaaacaggccatgccattttttatgtgaagatttacatgaaaaatacaaatcatatattacattattttctttgcataatttccaaacatcttttatatcaactaaattaatctttacacagaataacagttaaacctcagcactatgcctcacaatccaggcatgagggcttcaatttgactaatgctaacttgcaaaatacagcccacctaacatgaacattcacatctagaagagatactgccaaagctggttgttgaagaaattggaaatggatgtccatgttcatggatcagaagatttaatattgttaaaatggcaattcttcccaagttgacatagagagtcaaagcaatctctatcaaaaactgagctgacttctttacagaaatttgacaagctgatctgaaaatttatataaaattcaagggactcagatctgccaaaacaaccttgaaaaagaacaaagttggagagctcacatttccagattgcaaaacttacaacaaaggaacagtaatcaagactgtgtcatactggaatatgaatagatatatcaatggaatagaatttagggcccagaaataaacccacgtatctatagtcagctgattttcaagaagggtgccaagatcacttcttggggaaagagtactgttttcaacaaatggtgctgggacaactagatagccacatgcaaaagaaatttggatctcttcctcacacaaaaggaaaaacagacaaactacacatcatcagaataaaaacttttgtgcttcaaaagacaccactgagaaagggaaaacacagccagtcataatggttcacacctataatcccagaactttgggaggccaaggcaagagaatctcttgaggccagaactcaagaaaggcctgggcaatatagcaatactctacctctatttataaatgttaaaaaaaaaaaagtctaaagacaactgacagaagaaaaagtttgcaaatcatatatgtaataagggacttgtatctagaatatataaacaactctcttacaactcagtaacataagggcaaggccaggtgcaagtagctcacgcctatcatctcagcattttcggaggctgaggtgggaggactgcttcaggccaggagttcaaaaccagtgtgtgaaacatagcgaggccccatctctaccaaaataataataataataataataataataataataataataataataaagacaaataacccaatgaaaaatgggttaatcaacatcattagccatcatggaaatacaaatcaaaactattagatattactttaattatgttcataataaaagacaaacaagtgttagcaaggatgttgtgacactgaaaccctcatatactgctagtgaggatctatgcagtcgttttgaaaaatagtctggctctttctcaaaaggttaaacatgttatcatatgacccaacaacttcaatcctagggtatatacaccaaagagaaatgcaaacatctcctcatatgaaaacttgtccatgaatgtttctatcacattactcatgatagccaaaaggtggaaataacctaaacgtccatcaaatgataaacggataaatcaaataagctatatccattcaacggaatcatattcagcaataaaaagaaataaagtactgacacatgccacaatatggacgaacctttaaaaagttatgctaagtaggccaggtgtggtggttcgcgcctataacaccagcactttggggggccaaggtgggtgaatcgcttgagcccaggagttccagaccagcctgggcaacatggcaaaaccacatccctacaaaaaactcaaaacttagccgggtgtggtggctcatgcctgtggtcccagctactcaggaggctgagttgggaggatcgcttgagcccagaaggttgaggctacagtgagccggtatggcgccactgcactccagcctaggtgatacagtgagaccttgtctcaaaaaaaaaaaaaaagaaaagaaaaaaattatactaagaagccagtcacaaagaaccatatattacatgatgacagttgtatggaatgcccagaggagataaatctatagagacagaaagtagagcagtgcatgccaagagctggggtaggaatgggtaaacgggaggaagcagtggattcaatgatttatttttaggataatgaaaatattctaaaattgactatggtgctggttgcagaactttcgagtatattaaagccatagaaatagtaaaaggactaagatagatagagaaaattttaatttttcctttgtgttatccctaatctaactaatctagatgacatggagatggctactgttgccctatctcactcacccttccagttttaagaaggcgatagaaagagtacaaaggttgggttacccacaaagggaagcccatcagactaacagctgatctctcggcagaaactctacaagccagaaaagagtgggggccaatattcaacattcttaaagaaaagaattttcaacccagaatttcatatccagccaaactaagctttgtaagtgaaggagaaataaaatcctttacagacaagcaaatgctgagagattttgtcaccaccaggcctgccctaaaagagctcctgaaggaagcactaaacatggaaaggaacaactggcaccagccactcaaaaacatgccaaattgtaaagaccatcaaggctaggaagaaactacatcaactaacgtgcaaaataaccagctaacatcataatgacaggatcaaattcacacataacaatattaaccttaaaagtaaatggactaaatgctccaattaaaagacacagactggcaaattggataaagagtcaagacccattactgtgctgtattcaggaaacccatctcacgtgtagagacacacataggctcaaaataaagggatggaggaagatctaccaagcaaacggaaaacaaaaaaaggcagaggttgcaatcctagtctctgataaaacagattttaaaccaacaaagatcaaaggagacaaagaaggccattacataatggtaaagggatcaattcaacaagaagagctaactatcctaaatatatatgcacccaatacaggagcacccagattcataaaacaagtccttagtgacctacaaagagacttagacacccacacagtaataatgggaaagttttaacaccccactgtcaacattagacagatcaacgagacagaaagttaacaaggatatccaggaattgaactcagctctgcaccaagcggacctaatagacatctacagaactctccaacccaaatcaacagaatatacattcttttcagcaccacacctcacctattccaaaattgaccacatagttggaagtaaagctctcctcagcaaatgtgaaagaacagaaattataacaaactgtctctcagaccacagtgcaatcaaactagaactcaggattaagaaactcactcaaaaccactcaactacatggaaactgaacaacctgcccctgaatgactactgggtacataaagaaatgaaggcagaaataaagatgttctttgaaaccaatgagaacaaacacacaacataccagaatctctgggacacactcaaagcagtgtgtagagggaaatttatagcactaaatgcccacaagagaaagcaggaaagatctaaaattgacaccttaacatcacaattaaacgaattagagaagcaagagcaaacacattcaaaagctagcagaaggcaagaaataactaagagcaaagcagaagtgaaggaaatagagacacaaaagacccttcaaaataatcaatgaacccaggagctggttttttgaaaagatcaacaaaattgatagaccgctagcaagactaataaagaagaaaagacagaagaatcaaatagaagcaataaagaatgacaaaggggatatcaccactgatcccacagaaataccaactaccatcaaagaatactataaacacctctatgcaaataaactagaaaatctagaagaaatggataaagtcaattaggaaaagaggaagtcaaattgttcctgtttgcagatgatatgattgtatatctagaaaaccccatcgtctcagcccaaaatctccttaagctgataagcaacttcagcaaagtctcaggatacaaaatcaatgtgcaaaaatcacaagcattcttacactccaataacagacagagagccaaatcatgagtgaactcccattcacaattgtttcaaggagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccccatcaagctaccaatgactttcttcacagaattggaaaaagctactttaaagttcatatggaaccaaaaaagagcctgcattgccaagtcaatcctaagccaaaagaacaaagctggaggcatcacactacctgacttcaaagtataccataaggcttagccacagtaaccaaaacagcatggtactggtaccaaaacagagatatagaccaatggaacagaacagagccctcagaaataatgccttatacaaaaattaattcaagatggattaaagacttacatgttagacctaaaaccataaaaaccctagaagaaaacctaggcaataccattcaggacataggcatgggcaaggacttcatgtctaaaacaccaaaaggaatggcaacaaaagccaaaattgacaaatgggatctaattaaactaaagagcttctgcacagcaaaagaaactaccatcaaagtgaacaggcaacctacagaatgggagaaaatttttgcaatctactcagctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcaaagaaatgcaaatcaaaaccacaatgagataccatctcacaccagttacaatggcgatcattaaaaagtcaggaaacaacaggtgctggagaggatgtggagaaataggaacacttttacactgttggtgggacagtaaactagttcaaccattgtggaagtcagtgtggcgattccccagggatctagaactagaaataccatttgacccagtgatcccattacttggtatatactcaaaggattataaatcatgctgttataaaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgaattcatgtcctttgtagggacatggatgaagctggaaaccatcattctcagcaaactattgcaaggacaaaaaaccaaacaccacatgttctcactcataggtgggaattgaacaatgagaacacatggacacaggaagcggaacatcacacaccggggcctgttgcggggtggggggctaggggagggatagcattaggagatatacctaatgtaaatgaagagttaatgggtgcagcacaccaacatggcacatgtatacatatgtaacaaacctgcacgttgtgcacatgtaccctaaaacttaaagtataataataataaaattttaaaaaaatgcaagtgaaaatataaagcaattactaacaacaacaaaaactatagaagaaagaaaatgtaataatttggctttaaaatgaaacaaatttcaacacggacaatggtataaacattacaatcatataagcaacacagatataaccaaattgggaggatgggaagagggaacgttgggtaagaaaaggaagtcaacagataatagctaatgtttatgaacatattatttgaaaacatggaagcaactctcagaagatacatgcggctgcctatggggaagattctgtccattccaacaacaaggctttggactgtgccagagcaaaggactactgtttttcattctaggacattgggtacaccaagctcctaaccatagttctaaaattcagaaaactaccaaaattaaaattttttaaaaaccactctaccctttctttacttatttaacactaaaacttgattgaactcctaggccgggcgcagtggctcatgccggtaatcccagcactctgggaggctgaggcaggcagatcacgaggtcaggaaattgagaccatcctggctaacacggtgaaaccccatctctactaaaaatacaaaaaattagccggggcatggtggcgggcacctgtagtccccagctacttggtaggctgaggcaggagaatggtgtgaacctgggaggcgaagcttgtagtgagccgagaccgtcctaccgcactccagcctggtgacagagcaggacttcgtctcaaaaaaaaaaaaaaaaaaaaaaaaaagacttgattgaacaccctggggccaaaacctgacctgaactaacaggaagctattcaaaactatacttatgctacttagtgtaaatattatatatacttcaatgcagaaatagcgcatttgagtaagggatcttactccaagcctcgatgggagtatctgataatttatagtatatgtagcagagtactgtagcagactactttcctaaaaacctgagaatttctaaattctaaaatatttctgatccaagagttttgaataagagagtatgggcttacaattcatttttcaaaatgaaatgtattacttttattacatgtattttagtacacgtattacttttattttttagattttgaaggtattctgaagaattcaatggagagaaagtataaaaagaataacaggtatgagactcatgtgaccttaaacagatcaacatctaatgccacacactttccaaaagtggcattattcctggatcattatttaagataataaataaagaggttacattgtctaattagaaatttgaaaaagaaggcaagaaaacttcacttgactcctcattcatatcccactactgtcccatctatcctactcttctaggaaaaggtggtctacactcacattcaacatttcttcactttctatacacatttcaactaactacaatctggcttcagtacagtaaggtctacaatgctctctatattaagcctaaaaattgttttgcagccctcatgttatttgacttgatacttttactctcttcctagtcttaaaatactcttttctttgacttaaatgacataacaccgtcctagtgttcctcctgctccatctccacctctgcagatctatcccctatagcatgacattgtacacagatattcctcaaagttccatttaaccctctctgattctcattctgtgctcccttttcctgggtgatttaatccataactttggcttgaatgcccacctttgcagatgttatttaaaaagaaaatattgataaatcagactttattgaatttaaaacttttgcactttaaaagataccattaataaaactcaagataagccaccgactgggggaaaaatacttgacaatcatatatctgataaaagacttgtatctggccgggcacggtggctcatgcctgtaatcctagcactttgggaggccgaggcaggcggatcacaaggtcaggagatcgagaccatcctggtcaacatggtgaaaccctgtctttactaaaaatacaaaaaattagccgggcacggtggcgggcgcctgtagtctcagctactcaggaggctgaggccggagaatggcgtgaacccgggaggcggagcttgcagtgagccaagatcgtgccactgcactccagcctgggtgacagagtgagactccgtctcaaaaaaaaaaaaaaaaaaaaaaagacttgtatctagaataaagaactcctacgttaagacaaacaacataattttaaaataagcaaaatacattaacagacatttcatcaaagaaaatatatgagagccaggctctcatatgtgcctgtagtcctagctattcgggaagctgaggcaagagggtcgtttgagcccatgtgttcgaggctacagtgagctatgatcacaacactgtactccattctgggcaacagcatgagaccccgtctctaaaaaataaaataaaataatgaagacatatgaatagctaataaactcatgaaaagatgctaaaaattaaaaccacaatgatataccactatacccccactagaatggctacaaccaaaaacactagaatggctccaatcaaaaagacagtcaatactaattgtttgatatagaaaaaattagatctctcatgtattgctggtgagaatataaattggtatagatacttggaaaatagtctggcagtttcctaaaaagttaaacataaacttatcctatgacccaggaactgcagtccttggaattcatccaagagatatgaaaacatacgtccacacaaagacacatacatgaatgtgcatagcagcattcctcataatagcccaaaactggaaatattccaaatgtccaccaactaaagaatagataaaaatgtggcttatctatacaatgaaattctattcagcaattaaaaggaaaaaaccaatcatatacactacaacatggatgaacctcaaagattatgcaaattgaaacaagtcagacacaaaagtctatatattatacaattccgtttttataaagtgtcttgagaaggcagatcagtgattgcctcatgttgggtgtagttgtgggtactatctgcaaatgggcaagagggaactttgggggcaaaggaaatgtctctaactggattacaatgacactgcactacttcaaatttattaatcactgaattgtacacttataataggtgaattttatggtgcctaaattacacctcaagatgctcatttaatacagcttacaaggccctatgttatctatcccacctcattttgtactacccctctctctatagtccagcaacagcagtgttccttcagtcccctcagacctcccagcaccttaccatcacagcctatatatatggtattctctgcctgcaacactcttccttccccttttgggctaactaactcttcctcaaccatctgaccatcctgacagaggaaattccacattcatagttctttataggatcaatgaagaacctctacttcattaacaatgttcacagaatgttacatttattgagttctttaattaatgactttctcccctactcagccgtaagctccccaaaggcagcatatctcattttgctcacctttgtatctctctttctgtggcccaatgcctatcacataagatctattaaataaatgctggttggatcaatctccctgagacagcaggcaaaaatggctgagaatttcatttgtaactcaaactattaagcaacactgttctctgtctcaaatcctgatcaagtaccctagtggagatttggaaaaactaacaaaaattcatgtttgtcaacctggtacaattcatttcagatgggaagaaacccactgatctttaaatatctgcagcagattgaccacatcagacttagttgaaaattgaaatggatttcaaatatagtggaatgtaatctaagtatctttaagaataattttagaagatgacaagtataagtagttaagaattactgatcaaagcattttaagacagaggaaaacttgagtttcctaagttacagataagaaatttcaacctttgagtcaaaaacgcaatgctggatagatagcaagttatggaagcttgctatccaacagctgaacgagagcccaaatatgctactgcactagtatcacctcaaagccttcttcccttcactcagccaggaaagaaggctccccctgccacatcacatctcgccctctgtctcactctcacttaaccactggttagcaaggctaaccttaagctataaagctataaagattgccctgctcctgccttttactgaaacgaagaccaaaattaaacttgaaagctctgagaaatttcagggaagatgacagagaaacaccacaaggtctccatatgttacccactaaaaaacagtctgatgcaaattttgttatttgggcttggcctgttaaaactattagctttaaaaacagcgagttcattttaaaatataaaaatgagctgaatttttatttatttatttatttatttatttatttatttattttgagacagggtctcgctctgttgcccaggctggagtgcagtggtgcaatctcggctcactgaaacctccaccttcctggttcaagcgattgcgctgcctcagcctcccgagtagctgggattacaggtgcacgccaccactcctgtctaatttttttgtatttttagtagagacagggtttcaccatgttggccagagtgatctcaaactcctgacctcaggcaatccgcccgccttggccttccaaagtgctgagattacaggcgtgagccacagcgcccggtcatgagctgaaattttttaatgcaacaagaataaagcaggccaggagtggtggctcacacctgtaatcctggcactttaggaagccaaggcgagtggatcacttaagctccggagtttgagaccagcctgggccacatggtgagaccccatctctcctaaaaatataaaaaaaattgctgggcgtggtggtgcatgcctgtggtatcagctacttggtcgacagatgggaggatcacttgagcccaggggacagaggttgcagtgagccaagattgtaccactacactccagcctgggtgacaggaggagaacctgtctcaaaaaaaaaaaaaaagttaactaccagaaaatatatatgcaattaccaatagtgaagaaatcataagacatacaaacatatcccacagactaaagtttatccagaaacaaaagactgaagtttgttagtttttaaatctcctagagtaatttagagcattgccagttgcagtggcttgtatctgtagtcccagctacttgggaggctgaggtgggaggaccactttaggccaggagttctagactggcctgggcaacatagaaagaccttgtctccccaccaaaaaaattcagatcattactagaggtaataaagggtacaataaatgttaaataaaacaatagtaaataagcaatgctgaaaataagtggaaaataaaatccaaagcataaataatttaaacagataaagtatatgaagaaactaaaaagtataaaaatactgcctgtcaataataatggaggaaaaaactagatgaaagcatttgtaaatcttaagtattttacatgcatatttcatttaaatctcacagcagtgccaggagggagagaaacttttatctccctttcatgcatggcttagagaaattaatcaacttgcccaagctttcacagccatatttcaaggactctcagctgccagcatttgcttgaccttacagaaggtgtcaacaaaaagtttttatgcaactagaccataattatccctgactaagcggggattccaaggtgccaatttcagagatgttagaatggataaaaatgcacaacttatgcttgactaaatgtgatagtgtgcagcaaccgatcaggtgaacctaaaatatgtagcggtttttttgttttttgtttttttaatttcacagtggcactgctacgggaaggactaagataaaacataatatgttcctgtctttgttgtagtaaagaagagctattataatccctatggatatagaagacaacatggaattcacatttgaagtattaaatagtgacaggccttttgttgtcttttttgtctatagagggacaacttaaccaaagcaatggttatatctgcctaaaatttggcaaagataataaattagatatttcaaaagtgggttactttaaggcactaagatacccctcaaatagttaggtcgaattcatggcagatatttaactgtagcattttgagttcacttgcaaatttgtatcacaagccacagaaaagaaacactgcatttaaaaactatagcccacatccttatgttctttcatctttattctagtagaagatgcaaggtaattttccaacacataacctcagaggttgaagccaagagcggcagaatggatggattcaaggtgtgccaacaatgctacccagtaggaaaaaattccataaaaactgggcccctaaggaaaacaacaaagcctaatgctgaagtcctgtccaaatgcaagtgcttggctaagagagagcagtcaggctgtagactgaaaggcagtgtatgcaatttagaatccccagaagtagagtaacagagagacaccacagctgcatgagagtgagatgctaatgtggggcaggcaggactcggctccagacagtgcatgctatcaggacaccttccatgactcgggaagacctcagtacaaccaccggggcaggtacgtgaattaggtaaaccaggtgcaattaactggaaaaagggcctggactaatgtctgggctttctgaaagattttgcatctcagggaaattatggaatagccacagtattcccttggtaatagaatgcaaaaatactgaaaacactcaaagttaagaaaagggaaaagagaagatttgttagggttcttttagcatttcacgtctgagaaacagaacaggtgttttcaacacttggaaaacaccttcaatccatcaagcacagaaatagtctgcgtttggccaggcacggtggctcatgcctgtaatcttcgggaggccgaggcggtggatcgcctgaggtcaggagttcgtgaccagcctggccaacatggtgaaaccctgtctctactaaaaatgcagaaattagccgagagtagtggcaggcgcctgtaatcccagctactcaggaggctgaggcaagagaactgcttgaacctgggaagtggaggttgcagtgacccaagatcatgccattgcactccagcctgggtgacaagagcaagactccatctcaaaaaaaaaaaaaaagaaagaaaagaaatagtctaccttcttgagctcctacaagagctcttcagtgcttgccctgcagagaacagtgtctgatccctatagataacgaaagggggatgaaggagaggtcaaggctccagcagcccagcgttctccctgggtattcagcacatcattagagaataaacctgtttactttgctgcctccttgaaggctcagtaatgaagccatgattagaattgcagtcatggattccagccacttatcacaagatgttccattttctcttgctatgtaacaaactacccaaaactttgttgcttgaacagccatgatttcctatttctcataattccatgggttggctgggcagctcttctgctgcccttacctgacttacaaaggctgcttcgctgggctcagcagggaaggcagggccttctccatgtggccttttcttctaggcttcttcacatgttggcagcagcatcccaagacagttcacccactacacatggtgcctctgcttgcactgtgtctgctgattgagaccaaagtcaagaagggggaaaagagactctaccacttgatgggtcctgtggtttgaatgtgtcccccaagttcatgtattggaaacttaatccccaatgcaacagtgttgacaggtgggacttgtaagacgtgatcaagccatgagggctctgccctcactaatggattaatgctgttattgaggaagtaggttagttatcatgggagtgggttcctaacagaagaataagttcagcctccttcccttctctccatcccaggcacatgctctcttgcccatctgccttccaccatgggatgatgcagcaagaaagccctcaccagatgtgagcccctcaaccttggacttcccaggctgcagaactgtaagaactaaatctctgtactttattaattaccccatctcaggtactctgttacagcagcacaacacagactaagacaatgggagaaacaagtgaagtcatactgcaaacaggcagagctgggagcggggacagggggcagtgattcattaggagccgttttgtaacaatttaccacatgttgttttcgctgctttttcctctgataataatagtttttatcagtagagtgtttttataaggtgttttcacacctattataaattcaaagctaattatgatctttataatacggggaaaaaggtgctcaactctatttctactacagaataacattaataaagatccaaaaatattcccaaggtttagatacttgaattccttctagcaatccataccgcttgaagatctcacgttccttaacaaacacatggatcttgtgaagcatctttagtaggctgacagaggaagaaactgtggccaaagtttgtaacagaaaaatcgaaggcaattatacttcatttgaagtgcttcctgcagaaagaattctcagcatgtcattgtacaatgcagcatgtaaggacagtggcacacactgctctgcaccagtcagctgtcatctcaggccagaacaagcatattctccacatactgcagtaaaccagaaaaaccagagcagaatttgcctcactactcaccttaccccctgaccatccgagatatgtctgcccaggcaggacaaatcttctcaaggacccctgtacatgccatgtacaaccttacccttgttcattctgtcccaccttcttgggatgctctttcctctttgcccatcaggcccaaaattccctggccttcagaccacacctcaaagcatttcttctctacaagcaaaacatgttcccctttcccttctttacaacccatagcagttacccaatttctttacaggtggacattagtcacattaaaaacagtccttcaatataagtgatggttaatttcacatgtcaacttgactaggccacaatatgcagatatttggtcaaacattattctgaatgtttctgtgaaggtatttttaagataagactgacatttaaattggcagacttttttttaaggcaagaccggatttattcccattttatagacgaggaaacactcagagaggtcaagtgatccacctgctctaggtcaatacatgactcagctgaaacttcctctcctagatatacaatgagagtaatgccagacctgcttctcaaaacagatatgcacaagaaaactgttttagtctcattcttctgacaactagaaagtaaatattcaccaggccctccctgtgcacataacattatcataagtcagaagtctgtcattaagaacataaaatcacagtgcagattgggagtgggaagatacacagaaaggataccaagagtttctgtcaactgcccctggtttgagttcaacattttttttagagatgcaatttttttttttaggagatggggtttcactatgttgcctaggctggacttaactcctaggctcaagtgatcctcttgcctcagcctcccaagtatctgggactataggtgcctgtcaccacacccagcttctaaattggtggattctgagtaaaatatcctgctttccataatgtgcgtgggcctcaaccaatcagttgaaggccttaatataaaaatgactgacctcccctagaagaagagggaattctgccagcagactgccttcagccttgaactccagaatcaactcttccctgagcctccagcctgccagcccaccctacagattttggacttgttagtctccacaatcatatgaaccaattccttaaaataaatctctctctcccaatctcatctagctatctatctatatatataggtatatctgtacacacacacacacacacacacacagacacacacaccctattggttttgtttctttgcagaactctgactgatacaatatatcacatagtttagatcattccttgcagggtacaaagcctggcctacttaaaaggctatatgatccctggagtgttgcatattttttggcaattcctacagtcttctgtaccatcatgtttctttagtattccctacggtgttccatacagagcaggggtaaaaatattccaggaacttgaatttgtgcttccttatgactaaactttgtatccttccagtttcctaacctttctgcaccattgactgtgatatgtatacatactaaagaaggtgaaagaaagaaaaggaatactgctcccattttcccatggtgaaatcccaaaggtggttaatgtctattaaaaactagtagttttattactaactggcacacaggtggtagaatttaaaaaaaaaaaaaaacactataaactattatttgctttatgatcctggaatccattcttttcaattttctccacctagaaaacatcttttagtgaaaaaactataataaaagcaaaaaaatgttttagtcaatcatcaaaataataacccaagaccaaatttaaagtaatataaacgtaaatcaggaatagtttttaaagtcagctatcacgtcttagagatttttagtttattttaaatccctttgggaagacctagaatatttcattcatttaacctaagcaaacaaatggacaaggacgtattctcatagtctgacccaattttccgagcatcttccaagtgccaggctcctactaggaactggaaaattttagaagtgaactggtgctatcattcgtccctaaaatagattagtgaatgcccagaaaataaagaatgctcacatttaagctactctctaacaatgtgcatatttctgctactaccagttgaattgtgcacattatcaaaaacctattgtttcatctccaaacctgtttatgtcagttgtactcattctgcaatggtataatttaattgaatactatataaactgatcacaaatggacaaacatgtggctacaaaagtaagaagttactatttctataaaacctatgttgaatactttggaaagcatccatacaggcatattactttccttaaaattttttgacaaattgagtatatataaaacaactataaaagactagaaaacaacactaaaataccagaatcctggctaggtgcaatggctcatacctgtaatcccagtactttgggaagctgaggcagaaggatcacttgaggccaggagtttgagaccagtctgggcaacacagcaagaccccatctctacaaaaaaaatttacatttaaaaaaaaagatagaattctatgctctgactgcttcagatgttcctaaagtctcaatctactttaaacagagtgaaactagaaaacacagaagctactctataaatgtggtttttacaagaacaataatacagaactgagaggacccataatactcaaagaaagattactaccctagatcacaagactggccttttgcatcctccactattcccagaacaatccatcagtagcagtaacattacgcttgaatacttcctgaagtcaagttgttttatttaaaactgaaatatccctctaaaagacaacaacaacaacaaaaaataagtatgtatatacaaggtattcactgcagcactatttctaacagcaagacactaaagacaatccaaatgtccattaatatgggactgacaataaactggtaaattcacacaatgaaatagacaaaaaggcatgacaaatgtctctatatacttctatggagtgatcagcaggaaaaataggaagacaaaaaagcaagaagaaaattatacatagtgtgctaccattcacctaagacgggattaggaggcagaaactatacgtgtgtgcacatgcatggacatgcacacacacacacacacactcttgctcatgttttaaatggaatgcaggaaaaaaaatagagggaaccacaatcagagatggatttctctgattctgccttgttttacacatttagctctggaaccatgtatatgttttccataattgtttaaaaaataattgaaaaactgtcatctctaaaattcaaaagcaaaatgaaatgaccctaaatatttgttgaattggtggtataatcatgcaaaaaggaattatttcaaatgatttaaaacagttttaccagacatccctataggaatctatcctaaaaatgaaaagaatttgggaaagtgcttttaattcttaaactattttcagtaatcatattgttagcagtaacactgacaagtaatggtatcaatatgattatgatcaagaaccaaaatttttagcatgagacaaagataaaattaaagaaattcaacaaaatcatctgttcctaagtttataatggaaaaatcagtatgaaactcataaaatattttaccttaaaaataacgtatttcctagccccattcactgaaaaggcctagaagtaacaaccaatctgtagtttccagactgtggtcactaaatacaatttccctctgaaaggaaccagggctggttaaagaaagggataattccagatctatggctgttaatgtacaagatgagcctggacatcttgtcacacaagaaagcaagaagccatcagaagcacccatgccaaaatgacccaggagctaatgtgaaggcactcccattggccaaagaagagacaatgtggaccaggtgcagtggctcatgcctgtaatcttagctctttgggagactgaggcagggggatcaccggaggtcgggaattcgagaccagcctgaccaaaatggagaatcccatctctagtaaaaatataaaattagggccgggcgtggttgcccacacctgtaatcccagtactttggaaggccaagactagcggattgcctgaggtcaagcgttcaagaccagcctggccgatgtgataaaaccccgtctctactaaaaatacaaaaattagccaggcgtagtggtgcgcacctgttgtcccagctacttgggaggctgaggcagaagaattgcttgaacccggaggcagaggctgaagtgagctgagattgcgccactgcattccagcctgggcgacagagtgagactctgtctccaaaaataaaaataagaaataaaacattagccgggcgtagtggtgcatgcctgtaatcacagctactcaggaggccaagggaagagaatcgcttgaacctagaaggtagaggttgcagtgagctgagatcatgccattgcactccagcctgggcaacaaaagcaacactcttgtctcaagaaaaaaagaagggacaatttgatcattaataagaataactgtggctgggtaaactggtttgtgccttatagtcccagctacctgggagggtaaggagagaggatcacttgagaccagcctgggcaacatagtgagatctatcattaattaatgtaattaactcattaaagaataactgcaatgaacttaagaaatcatcaaacatattaaattcacatgctggctgggcgtgatggctcacacctgtaatctcagtactttgtgaggccgaggtaggaaaatctcttgagggccaagagttcaagaccagcctgggcaacacagtgagatcccatctctccaaaaacgatttcttttttaattagctgtgtttggtggtgcatgcctgtggtcccagctacttgggaggctgaggcaggaggatcgcttgagcccaggaggttgaggctgcaatgagccatgattacaccactgcactccagcctgagcgacattgtaagaccctgtctcaaaaaaaaaaaaaaagaaaaagaaaaagaaaagagtatgtgtttataatgatactttttaaataaaggaaaaagcactggccatttttggaaatgctagggaccctccaagagttgtaagtaaagagaaagagtcactcatttaacctgacttccctgtataagctatacctctgggtaactgaacagtctgtaaaaagagtcttctctgtactagtattccagcgaataaatgaaaaaggaatgatgaaattagaattgcaacatcttgcatgcccatgattaagtaatggatctatgtgaagaataagtggtcactactgtttcaaagcaaaaaaatcatttcgcaaaattcatatataatagtatgagcaagtgcacaagataaacggcatgattttttcagtaaataacatttcaataagacagaaaataaggaaaacctatagcttaaaagatattgaagaaaacctatcaaccgaatgtaatgtgtagaccttgtttacatcctgatgcaaacaaatcacagtacacacaaacacacacacaaaactgtgaaataactttgggatgatagtggtattgtgtgattcattctaagaaaaacagcccttatctttcagtgaaagtactaaaatatttacagataaaatgaaaagaacaagaatgtacccccaaaaatggactgggagagggatataaagaaacaaaagacgctatgagtggatgccagctagagccaggcacaaggcggttcacggtattcttcctttacttctgtgtatgttttaaattctccataataaaagttttgaaactttgatgtatgactgtatgtctgtatgctttaataataaaatgttaatggcatataaaatttttcaggatttcctgctttatgttaaaacggcttctccggttctttccacaaaagaggcatctgggggtcaagtcccttatttctctgaattatcaacttaaagcatagggcctgctacccaggaagtgctcaataaatgttaaatgaacgaattctgtttgctatacttctctgctctgctaaaccttccaaaaccctaatctagtgatccaacttgtagtaaaggatgagtaaatagaatcaagtattaaaaagacaaaaaatccaaaaccctgtatgtacttaaccttttaagtctatgttccataaaaaaatggttgtttttttcttgtggtaaaaaacacaaaacataaaatttatcaaattaactatctgtaagtgtacagcattcaacagtgttaagcatattcacatggttgtgaaacagatatccagaattttttcatcttgcaaaactgaaactatacccattgaacaacaaaaggtgcctattctttttttttttttttttttttttttttgagacgggagtttcgctcttgttgcctggactggagtgcaatggaacaatctcggctcactgcaacctccgcctccctgggtcaagcgattctccttgcttcagcctcccgagtagctgagattacaggtgtgcgccatcacgcctggctaacttttctatttttagtagagacggggttttgccacgttggccaggctggtcttgaactcctgacctcaggtgatccacctgcctcagcctcccaatgtgctgggattacagacgtgagacaccacgcctggcccaaaaggtgcttattcttaatacttcctacccattgtctattctatcctacacagacctctagctaccacagctttcaaagtattattttctgacaatatacattgtggatcaccagcacaataacatcaaatagaaaacaaccagtccttaaagaaaataggaagggtcttaagtctgactgtgaacagaagaccatacgacctcctgtgcagaggaaatgaagatagggctggaatgtggtttcagggtcactctaaacggaagtgaggaaccaaaacaggaagaggcaggcccacagctaagaggaggccacacgggctgcagaaggactcattccatgtctgcatttaacaaaggcttaccactgcttaggcagccccataacaatgatggaaaggcccctggtaagcacacagactcacaggtgccttaggtcaggtacctggggaagcactatgcaagtctcattcaacagacttttagttaaatatgcttatgcaggcctgcaaaaaaaatgacttagctataaatttggtaataataacttagtatattatgtaagaaatgtcaatgatcagtatcagtgaccagtgatcactgatatttttccatgtgttactatagttctaattatctttggtaatagatgaacgcttagtcaatcactcctttttcaaaatcattttcatacattattcttcagaagcatgactcctagcctgagtctgcactgggacaactccaggaaagatagagattttgtacatgactgaggataatagcagagtcaaggcagacaaggacctgtttaccaaaagcacctagaaatctccagggggcagggatcttggggaacggacattcattctacagcaagagttcaggttaatccaaagaaagccacagaccatgagaagagagtagtggcttggaggacaacatggtatctgtcattcacactatcctacataaaagcaagggatgatagtggtattgtgtgatttgttctaagaagaacaatcaaattaaaggcattctcaaaaggctctgaagaacagtaacacttcaaggaatcagcagcacggaaagcagcagctgttgccacaggactgacagcagcgtgggtaacaaggaacatcctgatggccacagccatgacagttgacctatcaaccaaacgatctttgcactgacaacagtggctgcacttctggtgccaggcgcacggtggtggctctcagttctgcctccagcactagcaggctgtgtgtacatacaaacatacatatgtgtatgtatgtataacacccagctactgacagtgagaccggagagcatgcggggagaaaatgggagcagaggtacaaaggatctttcacctcttcaatattaactgttttataattatgtagtaccacaaataaaacttctattttgaataaatagaacagaacacattgaggcctaaagggaagaaatatgtagtaaaatcagaaaaaagaatttataataaagtcccacttgtgctttgacaattcttgccttttaaaccaagtaatattccaagtaaatacatctttaaagaaagaaaaggtatagtttaagatgtagtaatttatggcaatttcaattattcaggaggaatatgtattttaggaaaggaatgaataactttagccctgtcatcatctggaaattagaagttggtaaacataccgtaaatctaacctgcctgtatgcttttcaccttacggctctgggtaagaatgaatgccataacatatgtgaaaatcacttgcaaactatacggtggtatgtacatagatgatagttaagtttctaccatcacaaatgtgctataatttttttatctgactttatattacagaacacagtataatgaatttttaagaaatacaatggtccctaaggctacttccttcttttttgagacggagtctcactctgttgcccaggctggagggcagtggcacaatctcggctcactgcaacctctgcctcccaggttcaagcaattctcctgcctcagcctcagctgagattacgggcatgcgccaccacgcccagctaatgtttgtattttttagtagagacgggatttcattggccatttcttatattactaattcatacacataagaatttgttttcatttaattgaagatgctcttatgtatactgatatttaaataaacatgaacattaaatctttgagattaaaacctgtataaatataactggaaacctgcaattccttcttggctagaaacccataaaaaaaattccaagtgtgcattagactcacaatagttttcatacaagtatgaatggcataaaaatttttaattcaccaaatatatttctgcaactgggtcattcattttctaagttagaggccttttatttttatatcctttgtggcttcaaaaagaattttaaataccttgtaagtatacacactaagtatacatcacggcacccttccaagggagcgggcctcggcagtgagatttgaacacagaatccttcctccccgcaacacacagacaggcagctgctccaaggacagccaatctgctggctgggaagaggctaattaggtaagctggcaaattaggcactaaaagggaggtgaggctgaaagaatatataaaggaagatcctcaaagattcacaagcaaagatgaggtgagagggagctgagaaccagaaaaacgagatatgaaatagagaaaagataatgttgtagatgaggaagccttctggctgtaggagatccatcagggtggtaggaacaattgcagaacgatgcaaaccttcttggaaggccaagaggttttataaaagctttggaaaacgatttggctgaaggcagctagactctcttatctggtgcctgaaagcttaggttagataacaaggggatgtaaaaaaactgatctagataagttagtttacttaggcctccgaacctggcctttcatcatccgcacacaggactgctcactccggggagggcgaccatgttgattacccacaagtgtgttgactcaaagccattgtcattaaatccgtgctgaataaatgcccacagtgccagcttgtcaaggccgcagctgctgactctttacagcaccctcctcggggtctgtgagcagcccggtcccctagcccgctcccctagctcactgtttcattggatacctgcatgtgagtgcattttttctcctgtcgttcagccagggtctgcgggtcggaccccacatctgtcctcgtgggaagagtgtagcagacatgaagagaacagcagaaatgcaataagcagtaagtgtagctgctccctagaactgtgttggatcctgaaagccattcagctccagtttccttgtgatctgaaaataaacactttattcttaaagaacactgatgtgagtttctgttccttaaaatcaaaaaagcctcgtataagatacatacaaggataagatatgtttaaacatgcaagggaaataaggcaaagagagaaaggagtacaaaaaaggtaacagtcctttcccagttctttatgataaaactatgtcatctctatacacaggaaaagaatttcagttctctatgatggcagggcacctgtctagtgcattcaaatatggtaataatgaaatctgtcaaaaagggaataaaaataaatctggaaaaataagctcacaataaaaaaattactatatacatagagaagtaaatatgagtgagagcaagcagaaagaacaaacatcagatactgccttcactatcatttcagataatgtaattatgaaacagaatttttttttttttttttgagacagactctccatctgtcacccaggctggagtgcagtggcatgatctcggctcactgcaacctccatctcctgagctcaagcaattcttctgcctgagcctcccaagtagctgggattacaggcgtgtgccaccacatccggctaatttttgtatttttagtggagacggggtttcaccatgttggccaggctggtcttgaactcctgacctcagtaatctgcccacctcagcctcccaaagtgctggcattacaggcgtgagccaccacgcccagccgaaacagattattaaatagcgaattatgtaaataaagaaattttaggccaggcgtggtggctcaagtctgtaatcccagcactttgggaggctgaggcgggcagatcacaaggtcaggagatcgagaccatcctggctaacacggtgaaaccctgtctctactaaaaaatacaaaaaattagcagggcgtggtggcaggtgcctgtagttccagctactcaggaggctgaggcaagagaatggcgtgaacccaggaagcagagcttgcagtgagccaagatggagcctctgcactccagcctgggcaacggagcaagactccgtctcaaaaaaaaaaaaaaaaaaaaagaaattttaaaatgagcaaacaacaaagtactaaaaacagccagtttcaaacaataaaacattgctttcacaaattaaaaatctaagtattaaaatgaaaaccaaatgagttaattaaatagcatattagtcacagctaaggagagattaccaaactacatgccaaattggaataaattactcagagttagggaaatgaaaaacactaaagagattaagggacataaagaatagactgagatggactcacacatgactaatttaagtcctagtgggaaacaatacagagaatagaagagaagcaatacatgaagaggttaagggctgagaattttcaaaaacagataaaagacttaaatctagatttaagaagcacaacatacacctaccaatataaacaaaaagaaatccacccctagactcacaggcattgtggtaaatcgcaaaataaagccaaagaaaagattttaaaacacagagagtaaagacagaagacagactactacaattagctcagactatagaattctcaccagtaacaagccagcagacagtagaatattatcttcgaagtatcaaggaaacttgtcaactgtcatcatatgcacaacaaaactatccttcaagaacaaagatgaaatcaagatattcccagctaaagtaacagagtttatgaccagcagatgatcactaaagaaacctcgtccttagataagcttattttttttaaaaaaaagaaacttcaaaagaatatactgtagcaaaacagaaaatgagctcagaatagagatctgagatgtcagatgaaatgacattcaagtattaaacacgcaagtatgtgtcagcaaacattccccatgctaaaaataataataattagcaacaggatttaaacaacagtgagaaaataaaaatctcaaaaatcagtgtttaaggtaagggcatgaggaaggggaggtcattaaagtacagttgaccctttgaatagtacgggtttccactgtgcaggttgacttatatgtgggttttttttttttaaaccaaacatagatgagggatgcaaaacccacatatatacagtctctctccctccctcccttcctctctccttcccctcccttccaagacagagtctcactctgtcacccaggctggagtgcagtggcaccatcatagctcactgcagcctccaactcctgggctcaagtgatcctactgcctcagctttcggggtagctgggactacaggcctgcaccaccatacctgggtaatttttttattttttgtagagacactgtctcactttgttgtccaggctggtctcaagctcctggcctcaagcaatcctcctgcctcggcctcccaaagtgctggaattacagccgtgagccactgcgcccagccccgatttttcttaaagacaggttctgctgggtcaacagcatgatatgagtatatgcaggctgtagtatacgcaagggttctggaaccaatcctctgtatatatgagagatgataaagtctttgtcttagcaggcaattaagatattgataaggttcattcagctttgttaacgtaagtctatgataatatctcaagaataaaccacaaaaatacttccaaaccaattcagaggaaaaataccataagaaaaaaatcaagtgaaaaaaccttaattgtatttttaaaaggaacaaaaaagaaaagagcacggaaagtgtcaacagaaagcaaaaagtaaaatggcaaatattcattacaaatatatcaataaccataatctatgtaaatgaattaaacttgccaattaaaagacaaataagattattttataaaacataaattaatttcagttacatattatttacataagacatacccaatgaatagcacaaaaagtttaaagtgaggactaaaaaggttaagtaagcaccagtcaaaagttaacaagaattaccatatcagaataaggcttatttcagctattacccaccaaaagtaagagaaagttgacaacacatggtcttattgagcaaacaggtaggaaatctcagcaaagaaataaaaagtggctaggcgtggtgtctcacgcctgtaatcccagcactttgggaggccgtggcaggtggatcacctgaggtcaggagttcgaaaccagcctggccaacatggtgaaacactgtctctactaaaaatacaaaaatcagccagatgtggtggcaggcacctgtaatcccaactactcaggaggctgaggcaggagaatcgcttgaacctgggaagcggaagctgcagtgagcagattgtgccactgcactccagcctgggcaacagagtgagactccgtctcaaaaaatataaataagaagtataaaacagaaccaaatagaaattcaaaaacagaaaagactgaaaattaaaacaaaaaatgcactttatgatcttaacagtagactgaatatgacacagtcactgaactggaaaacaaaccaataggaattacccacactgaaaaacagaaaaaaagactggagaaaaatgaacaaactctcacaaacttctgagataatatcaatcattatgacatgtacataatcagaaatgcaggtggaggggaagaaagtgaaactggaccagagaaaataattgaagatgcaataaccaaaaacttcccaaatttagcaaaaaatactgacttataaatccaaaagactcagagaacactaagtaggattaatacaaatagaaatacaactgagcacactgtagataaactgctgaaaaccaaaaggagaaaaatattgacagtaactaagaataaacaacaacaacgacgacaataacagtaatatgacggccagctgattttttttttaatcagaaaaagaagccaggaagtaatgcaacaacatctataatgctcaaagagaactatcagcccagaactccacatgcagcaaaaacatccttcaacagtgaagacaaaataaagacatggtctgataaacaaaaactaaggaaattaatccccagcaaataacatataaaaactaggatccactaaaaaaaaaaaaaaaaaaaatactggaagtgttaaatgtgtggataaatataaagaactatttttcaatttattctcttaatttctttagaagacacacgctggctgttgaaagcaataacaacactgtatcatggggcttataacataggtgtacataaaatacatgacagtaggctgtcatctctgtaatcccagcactttaggaggccaaggggggtgaatcacttgagcccaggagttcaagaccagcctgggcaacatggtgaaatcccaactctacaaaaagtacaaaaattaaccgggcctagtggtgcatgcctgtagtcccagctacttaggaaactgagataggaggatcgcttgaacccaggaggcagaggatacagtgtgccaagattgtgactgcactccagcctgggcgagagagtaagaccctgcatcataaaaataaaaataaatataaacatatatgacaacaatagcacaatgactgggtagggaatggaactgtgttattgcaattcttaattttatgagaagtggtatgttaattctaagtaggcaaggataaggatgcaactgcaaaaaaataaaaaaaaaaagtcattacatggaatactaaaaaatattcaattagccctaaagtagaaaaagagtagcaggaaaaaaaaaggacaccagaagacaaacagcaaactagtagacctaaacccaactacagtgaattctccttattcatagtagttatgctctataaagtcatcatgaacactgagttaccaaatatggaaccactgctcttgggaaaatagtattaagtccgtgcaagcctctggtcctgctaccttagtcagctgagcaatacataatcttgttttatatgtgtttttgtttaaaacacctcatttaatatctattgttaatttacttatattaaacccatggccaacagcactacaattcttgtctgagtgaagcttatctaatacatgtattttctccattggcacatcacagcctcttgcacttgggatcaccaggtggcacatcggccctacacttgagggtcattttaaacagcaaagtcaccccaaaagaagtataaaaatgtggaaaatgtggcactgaacagactggaaaagaaccctttcttagatttctgtgggcacacagtaggtgtatatatttatgaggtacattagatgttttcatacaggtaagcaatgtgaagtaagtacatcatgaagaatagggtatccataccctaaagcgtttatcctctgagtttcaaacaatccaattatactctaagttattttaaaatgtgcaattattattgactataaccactttattgtgctatcaaacagtaagtcttatccattctatttttttttgtacccattaacaatcctactttcccttcagcaccccactacccttcctagcctctggtaaccacccttttactctctacgtccatgagttcaattgtcttgatttttagatcccacaaataagtgagaacacgcaaggcttgtctttctgtgcctggcttatttcacttaacataatgatctccagttccatccatattgctgcaaatgactggatctcattatttttgacagctgaatagtaagtactccactgtgtatcacattttctttatccattcatctgctgatgaacacttaggttgctggcaaatcttagctattgtaaacagtgctgcaacaaaaacaggagtgcaggtatctctttgatatattgatttctttctggcggggggagggggggagggtatatacctagcagtgggattgccagatcatacgataggtcaatttttagttttttgaggaacctccaaactgttctccatagtggttatactaatttccattcctaccaacagtgtatgagggtttccttttctccacatcctcaccagcatttattattgcctgtcttttggatatgacatattaattaggtgagatatctcattgtagttttgatttgcatttctctgatgattgatgttgagcaccttttcatatacctgtttgccacttgtacatcttcttttgagaatgtctactagaatcttttgcccatttttaattggattattacattattttttcctatagagttagtagaactccttatatactctggttattaagcccttgccagctgggtagtttgcaaatattttctcccattctgtacgttgtctcttccttttgttgactgtatccttcgctgtgcagaagctttttaacttgatgtgaccccatttgtccatttttgctttggttgcctgtacttgtgggttattgctcaaggcatttttgcccagaacaatgtcttgaagattttcctaatgtttccttgtagtagtttcatagtttgaggtcttagctttaagcctttaacccattatgatttgattttttatacagtaagagataggggtctagtttaattcttctgcatatggatatccagttttctcagcacgatttattgaagagactgtcttttccccagagtatgttcttggctcctttgtcaaaaatgagctcactgtacgtgtgtggatttatttctgggttctcggttctctattctgttccattggtctatggatctgttttcatgccagtaccatgctgttttggttactgtatctccatagtataatttgaagtcaggtaatgtaattcctccagtcttgttcttttgcttagaacggctttggctattctgggtcttctgttgttccataaaaattttgggattgttttttctgtttctgtgaagaatgtcattgatattttggtagggtttgcatttaatctgtagactgctttgggtagtatggacattttaacaatactgattcttccaatccatgaacatgtaatatttttccattttttggtgtcctcttcaatttcttgcatcagtgttttatagttttcattatagagacctttcatttatttgggtaattcctaggtgctttattttatgtgtggcttccaaatgggatacttttttatttctttttcacattgttcactgttgacaaatagaaatgctactgattttggtacgttaattttgtatcctgcagcttcactgaatttaccagttctaataattttcttgtggagtctttaggtttttccaaatataaaattacaccatctgtaaacaacgataatttgacttcttcctttccaatctggataccctttatatccttgtcttgtctgactgctctagctaggacttctagtactgcattgaataacagtggtgacagtgggcatccttgtcatattccagatcttggagcaagggtgtccaattttcggtttccctggaccacactggaagaactgtcttgaaccacacataaaatacactaacactaagccaggtgcagtggctcacacccgtaatctcagcactttgggaggccgagacgggcagatcacgaggtcaagagatcatgaccatcctggccaacgtggtgaaaccccatgcctactaaaaatacaaaaattagctgggtgtggtggcacgtgcctgtaatcccagctactcgggagactgaggcaagagaatcacttgaacccaggaggcggaggttgcagtgagttgagatggcaccactgcactccagcctggtgacagagcgagactgtttcaaaaaaaaaaaaaaaaaaaaaaaccactaacactaatgatagctggtgagctttaaaaaaattgcaaaacaagccgggtgtgctggcttacacctgtaatcccaacactttgggagcccaaggcaggtggatcacgaggtcaggagatcgagaccatcttggctaacacggtaaaaccctgtctctactaaaaatacaaaaaagccgggtgtggtagtgggcgcctgtagtccgagctactcgggaggctgaggcaggagaatggcatgaacccgggaggcggagcttgcagtgagccgagatggcgccactgcactccagccggggcgacagagcaagactccatctcaaaaaaaaaaaaaaaaaaaaaattgcaaaaaaaaaccacatcataatgttttaagaaagtttacaaatttgtattggactgaatgcagcccttaagccatggattgaacaaacctgccttagacaaaaggctttcagtttttccccatgcagtgtgatattagctgtgagtctgtcatatatggctttaattacgttgaggtatgttccctctatccccagttttttgagggtttttcaacataaagagatgttaaatttcatcaaatttttttcagcactaattgaaatgattatatggtttttatccttcattctgttgatatcatgtaccatacagactgatctgcatatgctgaagcatccttgcatcccagggataaatcccacttggtcatgttgaatgatctttctaatgtattgctcaatttagtttactagtattttgttgaggatttttgcctcaatattcatcagagatattggcctgcagttttctttttttgatgtgtggaaaaggacccttgtttttcaaagtatgagagctgaaacaggagggcagagcgtcaccttatttgacctcagttgggaaaaaatgtgtgaagatgactcaaatttttcgctactctgtacatgtctatgaatgaccacgggaacacttcaagtattgatttaggggttacaaataaaatttgcaattttcacatgtatggaatcctcaaataatgaggatcaattgtgtatcaaggagactaaatattccaattaaaatgtagctttttttcagattggggagaagaaaaaaacaagacccaattatgtctacaagagataccttttgaatataaagacacgggttaaaataaagaggatggaaagataaaccacacagcactaataatagagtgaaaagcacaacactttccacaactgacacaagataaaacttttaaaatctaaacagccatgtatttattaagttaaaatactcagcctacccttttacaaaaagaagactcaaaactcagatggtttcactggtgaagtctatcagacacatgtggaagaaaataaaggagtaaacaattcccaattcattttagaaggtttgcataaacccattaccaaaatatttttcatttataaaaaaactataaaacatgaccataggtgattaacacagatgaaaacatcctcagcaaaacaatggaaagatcaaaatcagtaacttacaaaaagaataatatatcatgatactgcagtatttatcccaggaatataaaatttggattcacatataaaaggcaatttcatttactataataccagatgcaatgaaagcatttgacgaagttccatatccattccgggttaaaaaaaataaaaattttagcacacctacaaacagaaagaaacttcctctatcatataaaccttcagcaaataatgaaattctgaggactttccctcaaagattggcaacatggcaaagatagtgatagaaatcgcagcaagtctactcaacattatattatatagaagatcctagccaatgtaataggcaaggaaaagaaatactacgcataaatatttgaaacgaagttataaaactttcttttcagaggcaatataattgttaacaaacaaatttttaagaattatgtcaatctaacaagattcatttaagtaagtttggcaaagttgcaggatggcaggtcaataaacaattgtatttctatattccaccaacaaaatgaaattttaaaaacgtttctcaataccaaaaagcagattacttaagaataaacttaacaaaagatatggaagccccatatactgaaaaccacaaaacactgctgaaagaaatacctaagtaaatgaagatatataccatgtttgtaattcgaaaatttcaacactgtcaagatgttgattctgcccaaatcacaattccaaccatattcccaccaggcacttttatagaaattaggcttttgattctaaaagcctatgaaatataaaagtatatgaaatatgaaagtatatgaaaattcaaaagacctagaacggccaaaacaatcttaaaaaagaacaaagttgaaggagttaatgtcaggcctctgagcccaagctaaactatcatatcccctgtgacctgcacctatacatcaagatggcctgaagtaactaaagaatcacaaaagaagtgaaaatagcctgtttctgccttaactgatgacattaccttgtgaaattccttctcctggctcatcctggctcaaaagctcccccactgagcaccttgtgaccccgacccctgcccaccaaagaacaaccccctttaactgtaattttcctttacccacccaaatcctataaaatggccccaccctttctccctttgctgactctctttttggactcagcccacctgcacccaggtgattaaaaagctttattgctcacacaaagcctgtttggtggtctcttcacagacgtgagtgaaatttggtgccgtgactcggatcggcggacctcccttgggagatcaatcccctgtcctcctgctctttgctctgtgagaaaggtccacctacgacctctggtcctctgaccaaccagcccaagcaacatctcaccaattttaaattgggtaagcggcctctttttactctcttctccaacctctctcactatccctcaatctctttctcctttcaatcttcgcgccacacttcaatctctcccttctcttaatttcagttcctttccttttctggtagagacaaaggagacatgttttatccgtggacccaaaactccagcaccagtcatagactcaggaagacagtcttcccttggtgtttaatcacgcggggacacctacctgattattcacccacatttcattggtgtcttatcaccgcggggacgcctgcctttgtcattcacccacattcccttggtggcaagtcaattgcagggacacctgctttggctgctcacccaccccttctccactttcctggggggcaagcaccccttaccccttctctctgtgtccccaccccttctccactttcctggggggcaagcaccccttaccccttctctctgtgtccccaccccttctccactttcctggggggcaagcaccccctcaccccttctctgtgtctctaccctctcttttctctccactttcctggggggcaagcacccccaccccttttctccatgtctctaccctctcttttctctggacttgcctccttcactataggcaaccttccaccctccattcctccttcttctcccttagcctgtgttctcaagaacttaaaacctcttcaactcacacctgacctaaaacctaaatgccttattttcttctgcaatattttcttctgcaatgccacttaaccccaatacaaactcgataacggctctaaatggccagaaaacggcattttcgatttctccatcctataagacctaaataattcttgttgtaaaataggcaaacggtctgaggtgcctgacgtccaggcattcttttacacatcggtccatccctagtctctgttccccaatgcaactcgtcccaaatcttccttctttccctcccgcctgtcccttcagtcccaaccccaagcgtctctgagtcttttgaatcttccttttctactgacccatctgacctctcccctcctccccaggctgcttttctggtagagacataggaaacgtgttttatccgtggacccaaaactccagcgctggtcatggacttgggaagacagtcccaagtctttccattttttcctcagcctccgccccgccaccctacaatccttttatcacctccccctcctcacacctggtccagcttacagtttcgttctgcgactggccctcccccacctgcccagcaatttcctcttaaaaaggtggctggagctaaaggcatagtaaaggttaatgctcctttttctttatcggacctctcccaaatcagttagcgtttaggctctttttcatcaaatatgaaaaacccagcccagttcatggcccatttagcagcaacccttaagactctttacagccctagaccctgaagggtcagaaggccatctcattctaattatgcattttaacacccagtcagctcctgacattaaataaaactcctaaaattaaattccggccctcaaaccccacaacaggacttaattaacctctccttcaaggtgtacaataataaagtagaggcagccaagtagcaatgtatttctgagttgcaattccttgcctccactgtgagaaaaaccccagccacatctccagcacacaagaactccaaacacctgaactgcagctgccaggggttcctccagaacctcctcccccaggaacttgcttcaggtgccggaaatctggccactgggcgaaggaatgcctgaagcccgggattcctcctaagccttgtcccatctgtgcgggaccccactggaaatccaactcgcccagcagccactcccagagcccctggaactccggcccaaggctctctgactgactccttcccagatcttctcagcttcgtggctaaagactgatgctgcccgatcaccacagaagcctcctggaccatcacagatgctttaggtaactcttaaagtggagggtaagtccatccccttcttaatcaatacagaggctaccaactccacattaccttcttttcaagggcctgtttcctttgcctccataactgttgtgggtattgaagaccacgcttctaaaacctcttacactccccaactctggtgccaacttggacaatactcttttaagcactcctttttagttatccccacctgcccagctccctgaataggtcaaaacattttaactaaattatttgcttccctgactattcctgggctacagccacacctcattgttgccttttcccccagttcaaagcctccttcacacatcctccccttgtatctccccaccttaaaccgtagtatagtatacctctactccctccttggcaaccgatcatgcacctcttaccatcccattaaaacctagtcacccttaccccacttaatgccaatatcccatcccacagcacgctttaaaaggattaaagcctgttatcactcacctgttacagcatggacttttaaagcctataaactctccttacaattcccccattttacctgtccaaaaaccagacaagtcttacaggttagttcaggatctgcatcttatcaaccaaattgttttgcctatctaccccgtggtgccaaacccatatactctcctatcctcaatacctcccctccacaacccattattctgttctggatctcaaacatgctttctttactagtcctttgcacccttcatcccagcctctcttcgctttcacttggactgaccctaacacccatcaggctcagcaaattacctgggctgtactgccacaaggcttcacagacagcccccatcacctcagtcaagccagtgttcttacacaagagctgggaccgcgccctgtagcctttttatccaaacaatttgaccttactgttttagcctagccctcctgtctgcatgtggcggctaccgctgccttaatactttcagaggctttcaaaatcacaaactatgctcaactcactctctacagttctcataacttccaaaatctattttctttctcacacctgatgcatatactttctgcccaccccactacctctcagcaagccaaactcattgccttaacttgagccctcactcttccaaaaggactacacatcaatatttatactgactctaaatatgccttccatatcctgcaccaccatgctgttatataggcaaaaaaaaaaaaaaattcctcactatgcaagggtcctccatcactaatacctctttaataaaaactcttctcaaagccgctttacttctgaaggaagctggggtcattcactgcaagggccatcaaaaggcatcagatcccattgctcaggacaacgcttatgctgataaggtagctaaaaaagcagccatcaaaaagtatcagatcccatcgcccaggacaatgcttatgctaatagggcaactaaaaaaagcagccagcgttccaacttctatctcacagagcagtttttctccttctcatctggccactcccacctactcccccactgaaacttccacctatcaatctcttcccacacaaggcaagggtttttggaccaaggaaaatatatccttccagcctcacaggcccactctattctgtcgtcttttaatacctgtttttctcctcttattctgtttagtttttcaattcatacaaaaccatatccaggccatcaccaataattctatacgacaaatgctccttcaaacaaccccacaatatcacctcttaccacaaaatcttccttcagcttaatctctcccactctaggttcccatgccgctcctaatcccgccctgagaaacatcgcccattatctatccataccagccccaaaaattttcgctaccccaacactttaccactatttcgttttatttttcttattaatataagactacaggaatgttaggcctctgagcccaagctaagccatcatatgccctgtgacctgcacatatatatccggatggcctgaagtaactgaagaatcacaaaagaagtgaaaatagcctgttcctgccttaactgatgacattaccttgtgaaattccttctcctggctcatcctggctcgaaagctcccccaatgaacaccttgtgacccccaccaaagaacaacccgctttgactaattttcctttacctacccaaatcctataaaatggccccacccctttctccctttgctgactcttttcggactcagaccgcctgcacccaggtgattaaaaagctttattgctcacacaaagcctgttccgtggtctcttcacagggacatgagtgaaatttaaactatctgacttcaaggcttcttacagagctacaataatcaggagagtactgtgctggcctaaagacaaacaaacagatcaagagaacagaatacaaagtccagaaacagactcacacatatacagttaaatgattttcaggggaggcatcaaagcaattcaatggggaattgcttttcaacaaatagtgctggatcagttggatatccaatacagaacaatgatgaacttcaaccccatctcacaccatgaataaaaaataatttgagattgatcatagatctgaacctaaagccaaaactataaaacttctagaaataaatacagcatatctttgcacagagtgtaggcaagatgcaagaaaagcatttgatgaaattcaacctaaggaagatgcaagaagtaccaccccctcatggtgttagaataacactggtagaatcaatatgaaatcatattgttaatagttgttaatatatgtgtgtatacatagatgttgctagggtatgaacgtgtccccaaaattctcatgttgaaacttaatcacgccctggtgtcctggctcaagcctgtaatcctagcactctgggaggccaaggcaggagaattgtttgagctcaggaatacaaaactagcctggacaacacagtgaggcttcatctctactacaaataaaaattaaaaaaaaaaaaaaaaaactagccaggcatggtggcaagcaccttaaagcatcccagcttaaaagtcccagctacgcacgaagctaaggtgggaagatcactggagctcaggaagtcaaggctacagtgagctacaattgcaccactgcactccagcctgggtgataaagtgagactctgtctctaaacaaaaagagaaaagaaaaaaaaaaaaaaaagaaacttaattgccaatgctaatattaagacttgaggactttatgaggtgattaaatcatgagggcagagacttcatgaatgggattagggactcatcaaagagccagagggtgaaataagccaggcacagaaagagaaacatcacatgttctcacttatttgtgggatctaaaaatcaaaacaattgtactaatgaacatagacagtagaaggatggttactggaggctgggaagttaatggggggctgtggggaaggtggggatggttaatgggcacaaaaaaaaaattgaaaggatgaataagactcactatttgatagaacaacaggatgactacagtcaatagtaacaattatacattttaaaataagagtgtaattggattgcttgtaacacaaaggataaatgcatgaggggatgtataccctatttgccgcgatatgattatttcacattgcatgcctgtatcaaaatatctcatgcacctcacaaatatatatatacctactatgtgcccacaaaaattaaaaattaaaaatattatttaaaaaagggctggaggagctagtcagcccttttgcccttccacttttccatcacacgaagatacagcaagaaggccctcaccagagaatgaatgctggtgccttgaacttcccagctgctagaaccataagaaatcaatttccactgtttataaattacccagtctcaggtattttgttatagcagcataacgaactaagatatataaatttaaaataagtatctgtaatcctaccactttaaggaggccaaagcagaggactgcctgtggctaggagttaagaccagcctggagaatacagcaagatcccatctctactaaaaattttaaaaatagctgggcatggtggcccatgtctgtagtcctagctacttgggaaaccaaggtagggggatttgcttgagcccaggagttcgaggttacagtgagctatgatcataccactgcattccagcctaggagacagagtgagaccctgtctctaaaaaaattgtttaataaaaaattaaaatatggatatacatatatctatttacacacaaacaaacatatcctagctgtggccactgagtaggcctagaaataatgacacatcagtcacaataagcacatcatatatccagatcttgatttccaaataccattttttcctcactaatagtaacaatactcctcgaagaaaagctgatttgaggggtgggccatacaaaatgagcccagatcatcttgttgcaccagaaagtaaataggtactcaaagaattctggagacatatgaaaacacagaagccagtttgaaagagtttacacagaccaaatttgggatgattttagtatcaagataataacagtaatgagttacagaccactaaataagaatatgtatatgaatcattcaaataaataattgaacaaataaataaatgggatgtggagggaggagggaaaggtcttccttacagtagaatgccaatcaatagctacagaaggaagcatgcagttggaaagtcatcactggacgctaaaactagtgggtgaaagtttgatgaggaacaggatattaacacattgtcaacaaatattaacttcaaagagaaaaacagtatcatggcagtagagaaatctggcagataccaactaaaccaactgtttgatgttatcagcaatattagaacaaactgacatcaggttgctcctaatatgctgcactgagaaaaataaaaatcacttttttgttatccttgcataaaatgcatgaactgaatctaaccatgaggaaatttcagacaagtaaaaagtgagggacattctaaaaaaataactgatctgtactcttccaaaagatcaatgtcaagaatgacaatgaaaggttaacaaagtactccagattaaaggagactaaagaaatatgataatttcatggcgattcaggactggatactggacatggaaaacaaaagggcaataaaggacattatagggacaactgttgaaactgcactatgaattagataacaacaccgtaccaattgttaaatttcttgactgctaattttactgtggttatgcaagagaataccctggctcttagaaatacatgttgaagtattcttaggacttatacaacttaaactcaaatgaatcacaaaaaatacattcacatatatgcataaaaagaaagggggaaagagtgataaagctaatgaggtaaaatacaaacaactggtgaatcttagtaaattatatgtagtaattctctatattctttgtgtattttttctgtaagttacacataaagcaaaagacataactagaaaactaggtaagctttttttttttacaaaaatgacagacaaaaagtcactacctttcatatataaacaagctatataaagcaaatttcttttaaaaagcactataacccctccaaaagattaacaggaaaaggacatgtacagccaactgcacaaaagaagctaatgaagttttaaaggaaagcaaaaacaaaaagtcaatgaaagatgagatgttttccacctgttaaatcggtaattttctttttagaaaacatcaacattggcaaggatgtcctaaaatggccactcaacaccttgctagtggaagcattaattagaatcttttaggaaagcagttcagcaatatgaatcaagagccttaaaaatatccacaccaggccaggcgtggtggctcacgcctataatcccagcactttgggaggcagaggtgggtggattacctgagatcaggagttcgagaccagcctggccaacatggtgaaaccctgtctctactaaaaatacaaaagttagccggacgtggtggcgggcattgtaatcccagctactcgggaggctgagacaggagaattgcttgaactcgggaggcggaggttgcagtgagccgagatcataccactgcactccagcctgaaagactccgtctccaaaaaaaaaaaaaaaaaaaaaaaaaaaatccacagtattctacttcatgacactatctgaaagaaataatctaaactgtggactaaaatttatgctgaagatattcatcaaatgataactataatagcaaaattcttaaaataatccacattaaacaatagcgaaatcattacgtaaacaacttaggatataaccacaaaacgcaatatgcagtcattagaagttatttaaaatcaggaaatatgacataataaatgttaagagaataaagtttacaaaatgggcagttaggatgatcttaagtaaaaaaaaaaattcataaagctcagaacagacatattataaacagtgactgtttgaaaatgaaaataagtagggaatatgaacacctgtcccagtctccagtttatgagatctcacccctcaccatctgtgaactaccaccgcttacatgatggtgcctgtctcactccctgtgcactccaagtatttcttgaggccatggcaccatacctggctgcattcagtaaacatttgctgcttcaaatttacaaactctcccacctcatttcatatatgtaaaaaatgtatctagctatttaagtcacctgaaaactgaaactatattgaatatgaagttcgtcaagaaccagtttcacttttctttgcttctttcaaataaaaacattaaggaggaaacatgcttggagctttcgttaacaacagactccaaggcaggcttgagacaatataaagataccacatacctgattagtattgtgcgctaggaccaccggtggtattgtcagtttattttcatgtcaaagatcatttgctttagcagtctaatcttagctaccacaaaaaaacacacccatctgtgtgctgccagagcttagcccctacccagggccacacctgactccagctctgccctattccccactgattccaccttctacttggcaactttctgcctaattagctaagcagagcacagtcaggtaagaggaggctgtgagcaaggctgggaacacggagaaaccagacaagagtaggaagaccttaaccatggcagaggaccagctgagcggtattcgtaagtctgtggttctcaacaggggcagtttatcaccccaggggattttgccagtgtcttggagatatttttagttgccacaattgtggtggtgctaatggcacctagtaggaagaggccagggatgctactgaacatcctacaatacacagaacagttccccacaacaaagaattatccaaccccaactgtcagcagagctaaggtcaagaaatcctaccacagactgatgcatccactaatacagtggagtctactgcacagtacaattcagcaggaacaagacacccagtggttagaggagacctgaggtagttcaggaaatgtaaacacacacattacctcctcactcagatgctaaggtgatcaaaattctacctcaagaattgggaatgagggcattgtaattaattaattaatcaaataaaactagtaagaatgcttttttccccaagggcttgctcctataaatatcttatatttcttcaaagactgcttcacagcagaaactgtaagaagataatactatcaaaattgcccagactggtaaacatctccagaaaacttggcaacacacccacataatcaatgacaaatttaatttagctgtgtatctcaacaggcccttcctactaggtgccattagcacccccacagttgtggcaactaaaaactcaaactcaaagttcccagcttagtttacggggaaagtgtcaagctttcaaagatcactcaaaaagaagaaaagggctgctttcccagatgaatcatcaagaactacacaagacttaaaggagtaacattttcaaaactgagaacagtacttaggcacttcaaccaaaaaaaaaaaaaaagcagattttcaaaaaagtatatgaatcatcattattataatttggttaaagtaatgaccaatgagtcacgccacaatatgttttttaaaattattttaacaaccttatcatgccataatgtccacctatgggaggccaaaaggttagagaagccatccagtactatccctggctggctgggacttaaataacttcaacctgtctctaaagcatcattttgcctatctaccttgacctctgtcctttcagtgttaggaaatacccaccacttaaggtggcccccttcaatgttggacaggaattaactgttaggagtgtgtccattatgctgaatccagagcacctcccgttcaactacagctattagttttgaatcacatgaaaccagcctaattattctctatacagcagcccttcaagtttccatattatcttgtctttctcatccaagcctttttcttctccaagttgtaaaatgcactccccccacaagctgttacagttagctatttaagtgatacaattaagattaaacaggagaccaaaaaaaccagaatggcagaactgaaaggaatcagagaccagccagttcaaacccaatcccatttttataaatgagtaaacaaggcagagagaggtgaggcaaggctgcttgccagaggtcaagctattcagaaaagtcaggagcagaattcaagtttcctaactctttcgcccctcagaactgtatcaagttgtacagatgttgtgtgaaaggattgacagtttttgttttataaaaatataaatactgagagaaaagatgatccatctaccaagaatctgtattaaaaagtgatgcaggtgaaaaaaactaggtaacttaacttaaaaaatacataagaaaggaaatgtagtcatagactactacctggctttgcagatgaatagttaagttgtcactaactaaatatttcttattgatttcactaaaaatacggatgtaaccacagtcagagagtgggaaatggtaaatgaggagtttaagatgtccaaatcctcacctatcaaactgggaaggcaatgcataatatttaaagtggataaacaaataacagtggaataaaatgtttagaaatattaaaaataggtattataacaagaatagagtttgcctctatttttcattgcaagactttatgctcgctatttttaaacaatgtccaagtattattttgataaaaatttcaacattaattttaagatacagaaaaataagggatcggtaatagataatgttgtaggcaagtgaataggggaaagaacaccaaaacaccattagtgggagtacagactgaaataaaaacgggacaaccaattgccactatccaatttaaatctcctttgaccaggcaattccacttctagggctctagactaagaatacacccataaatgttcaaagatatatatatgagaatgatcactgtgacaccattttaaaagatacaaatcagagcacactaaatatcaactaacaggggaagggctgaataattcatgaatatatgtacccatatattcttcacactcatcccacaaatatttattgattgctaggtactaagtatagaatagtaaataaaactcaacctgcaaaggaatactacatcattattaaaagaatgcggatctgtatgtattgatctaggtgaaaaagcatatttcaaaatatagtatgtagtatgatgctacttttattaaaatacccagtataactagatgagactttttctttatgtacttacagtatttgacttttttagcattgtgacattacctgtgtagctcttttaaagacaataaagacatatgcttgtcagattggataaaagcagtaacaaaagaaagcaaaaaagaatggagggaaggtgatggcacgcgcctgcaatcccagctactccggaggctgaggcagagaattgcttaaacctggaggggcggaggttgcagtgagccaagatcgtgccactgcactccagcctgggtgacagagcgagacttcatttccaaaaaaaaaaaaaaaaaaaaaggaggaaaggaaagaatctactttttgtaagtctatatagtaaaacagggaagatgcacatgatttccacttctagattctaccaacatatatacaatcatatatatatatatatatatatatatatatatatatatatatcaagaaattctctcacacattcacaagaactaagaaacaatctaaattttcatcaatgaaagaatgaacaaattgtgatctattcatacaataaaacaccatacagtagttattaaaactcaaaccacaaaagcacaaatctgagggaaaatctcacatgttagagaatacatacagaataaaattatttatgtaaaactttttaaaaagcaacaaaataaaactatctttacttatggataaatatggacccacagattatggacccacagattaaaaacaccatgagataccacttctcagcctaaatatctgacaatattaagtgacaatattaaggacatggaacaagaactccaatgtctgctaaggtaaatgcatactggtaccaccactatggaaaacaacattatatacagtggtagtcagaaatctaaagatagtcctccaagattcctgcccctggttattcaaacactaatttgagtatagctgtgaaaggaccacggagataaaatagagtaatctagattatcccagtggacccaatcaaatcatatgagcccttaaaagcagagaatggtctccatctagagaaggaaaaaaatatgagtcagagagattcaaagcatgagagagattcaacctcctattgccggctttgaagatgaagaaagaaagaggatcacaaggcaagaaatgtatggcctgtagaagctgagaacgaccatcagctaacatccagcaaggacacatggacctcagtcctacaaccatatgaactgaattctaccaacaacccaaataagtgtgggagttgatttatctccagagcctccagaaaagaatgcagtcctactgacaacttgatttcagcctcctaagacccagagcagataacccagccaagcctactgcatttctgacctataggaccatgagattttaaaatgtgtgttgttttaagcctctaagtttgtggtaattagttacacagcaacagaaaactactacttctagaaaagttgaagaaatgcattatcctacaacccagcagctatacacctgaccatacacaaagagaaactcttgcccaagagcataaaaagacatgcacaatgttcacatcaccactgctcatgatagaaaaaaaatggacaatccagtcattcatcagtactacaaaggacaaattgtggaatattcataatgtaacacaataagacaaggagacaccaatgaactacggccatacaaaaatatgaatgagtctcaaatctcatacggaataaaaaagcaaatgaaagaagtttacccacaatacaattctagtcataaagttcaacagcatgcagggcaaaacaacacagcttagagatacaaatgtggtaaaactatagcaatgaaataataaaaacaaaattcagggtagcagttatgtctctgggaacataacagaatgggatcagagaagagagatgaagggcatcaaaagtaatgtagattgttcctaactggtgattacagaataacagcacttacattctatacataatttataaatattgtaatatctattcaatatttgaaaaatgaaaacatctagataatcaaacttctacataacaaaaaaaacttcttttctttggcaaagatgtgttcattgaaaggaataattcaaatgatataaagagtccaatcatttttttaatcacctaaaattctcaccacctggacataattagtaacaatttgcttaacatccttctagacatttcctatgagtatacatacatttaaatattttacataaaatctcagtatatatacacataggtatatgttcagtctgtaaatgctttttagaccctttttaaaaacaactctattaagacataatttacataaaataaaatgcacccatcttaagcataatgtgaagttctgacaaaagtgtataaaaagtgtatacgtagtataaccaccacccaatcaaaatacagagtaattccatcaccacagaaagttctcttttgctcctctgcagtcattccccacccctacctataacctcaggcaaccactaatctgctctcttaatgttttggtggttctagaattacacatcaatcaaatcatacagaatgtagtgttttgtctggcttcttttgctcagcataatgtttttaatttcatatagtgacactgtgcaattcactccttttttctcctaatatcccattgcagacttgttgaaagattatactctttccggtgttaagcactgagtacaagtcatttgtgaatttaaggttttattttacacccaggggtgtaaatgtctaggtcatacagtaagtgcatgtttaagttaataggaaactgtcaaacagttttccaaagtgcctgtacattcctatcagcaatttatgtaaaattctgattgctctacatcctcaccaacacttggtattgttagtctttttcattttgacccttcttgtaggcaaaaagttgctcataatttcctttaataaatatattgggaatttttagtatgtctactagaatttcaaataccttattttgtgaagttgctccacaaattttttttttaccgattttgcaatttgagttctctagcttcttcttaatttactgaagttctttatatatgctggataaaagtcctctgtcagatacataaattgccaacatttgctcccagtctatagtatactgtttcttttccttaacatctcctaaagtgcatacgttttaattttattaagtccaatttaacatttttaaaatgttgtagttagtgctttttgtaccacatataagactaaatgctttctccctcaaattgacaacaggacatggacatctgctctcaccacttctatcataatattggacttgaggtcctcatcagtgtcataaggcaagaaaaagaaatagaaagcacatgagtggaaaggaagacgtaaaactgtctttattcaatgactgtatgtggagaaaatccaaccaaaagactaccagaactagtaagtggattcagaaaggctacaagacacaaagacaatatacaaaaatcagctgtatttttacacattagcaaggaatacttgagaaatgattttttaatcctatttacaatgacattaaaaatgtaagatattaagatataaattcaacaaaatatgcataggacctgtacactgcaaaactaaaaaacatgttgcaagaaattaaagaactaaataaatggagagctataccatgttcatgtattgaaaggttcgatgacattaaaatagcaattctccacaaactgatctatagaaccaagacaatcccaattgaaaccacaagttgttttcttttttaaaaaacctaacaagctgattttaaaatacttttgaaaacacaaaggacctataatacccagaaaatttttgaaaataaggaacaaagttggaggatttacactaaccaatttcaaacctcatataaagttatagataaagataatatggtaccgacataagaacagacagcaaaagcaacaggagagagtccaaaagcagatccacacatacatcaccagttgactttcaacaaaaatgccaagagaactcaatgggcaaaggatagagaaaggggaagaaactcaatagggaaagaattaccttttcaacaaatgatattaaaaaatgtatattagaccagctagcttgagcccaaggcctcctcggacaaaaaataaaattaaaattaaaaaactgtgtattcataaaggaaagtaaagaacctagacccatagctcataccaaacaccctatcaacccctaaaaattgatcatgaaccttaatagtggagctataaaacctctagaacataggagaaaattcagtaggctttttttcacacaatatttcagctatccttacatgctaataaatatattttttcattttgtcaaaagtaaaaaaaaaaaaagaaaatccttacaaactgtgaaaacatgtcttcatttcttaaatgaaatttcgaaacactttccttatccatacagtcatacaacatttcttcaactgaagaacagaaatattcaaaggaaaagaacaaaaatctttttaacctcctttcatatagttcctacaagaacgggttggcttctatgagacggtagttttgccttgatgattcttttttgagtgcctttgctgaagtcataaataaataaatctcccaacatattaataccacttatgttttaaatataaaagttaccagaaaaccataccaatatgtgaaatgttatgtactgctatattgtcttaaaattgcctgttttggttgataaagacttgtattatacagagattacacattttttcaaactgtaataaaagaaattttagccattttaagtataatttatccccaataattggcaggatatctcaataaatgtatcattgactattggttatgaattgtggttaacaaaataatgaataaaagaatccattataggccgggtgcagtggctcatgcctgtaatcccagcactttgggaggccaaggtgggtggatcacgaggtcaagagatcgagaccatcctggctaacacagtgaaaccccgtctctactaaaaatacaaaaaattagcctggcatggtggcaggtgcctgtagttccagctactcaggaggctgaggcagggagactggcatgaacatgggaggtggagcttgcagtgagccaagatcacgccactgcactccagcctgggtgacagagcaagactacgtttcaaaaaaaaaaaaaaaaaaaaaagaatccatattataatttagtaatttaatcaccatagttttccagaaaactaaaatttaaaaaatacacattgcaacactgctgcttatgagtgtttactgttgcacacaagttaacccaaaactcagtagtttaaaacaatggacatttattacctcatagttaccataggccagaaatctaggcacagcttagctgggtacttctgggtcaaagtctatcatggggttgcagtcaagctgctggccaagctgtgggatcctctgaaggcctccatgtattaaaaggatatggttcccatctcagtcacatggctataagcaagtctcagtccctaccacctaggattctccaggaggcatacaacatggcatctttgttaaaaaaaatttccttctttccactaatagcttttttgcaggtgtgcaattcaatagtttttagcaaatgcacagaactgtacaaccatcaccacaatcaattttagaatattttatcaccccaaaaagaaacctagtcctctttagctgtcaaacccccatttttccccaccccctaccccaacaccagttctaggcaaccagtaatctactatctaattctatatttgtattctggacattccatataaatgtaatcacacaatgtgttgccttttgtgactgtttcttttatcacttagaatgttttcaaggttcatccatttgtagcatgagtcagtacttcattcctttttattcctgaataatagtccactgcatggatagaccacattatttaaaccattcatcagttgatatatgtttgagttgtttcaactttttggctattatggctaccgctactgtgaacatgtacatacaaatattggcataaatatatgttttcatttctcttgggtatatacctaggagtggaactgctttatcatcccttatcccaaatctagccatttcaagaactgccagactgtttctcaaagcagttgctccagtttacattccaacatgtagattccaatttctccacaacatcaccaacacttattattacctgtcttttttattatacatagccatcttagtttactaagatggtcacttagacagtcacttagtaaccgtcttagttacttcgttggtgtaacatggtatttcactgtggttttgatttccatttacatggtagctaatgatgtaaaacatcttttcatgtgcttactggctatttgtatgtcttatctgaagaactgcctattcaaatcctttgtcgatttttttgagttccttttctttttatgactgaggtataagagttccttaaatactctggatacttactctggatactagacctttaatagatacatggttttctcataccaaacactggggagcatgtagacaggataaaaacaggaactctcccactgcttgtaggacaataaaaccgtacagctacattggaaagcaatttgtatctagtagttactggtgtacgcacctgacaaacaacaactccaatcctagatgtatattccagagaaattcttacctttgaagaaaaacatggatgaaacttagtaactaatttaaaaagttgcaggaaaaaaagtccacatagcatgatgccatttatataaagtttaaaaatatgcataagcaaacaatattttggggggatatacatatacaacgtaaaataacattatcaagaaagcaggccaggcgcagtggcttatacctgcaatcccagcactttggaaggctaaggcaggcagatcacttgaggtcaggagtctaagactgtcaggcctgagcccaagctaagccaacatatcccctgtgacctgcacttatacatccagatggcctgaagcaactgaagatccacaaaagaagtgaaaatagtcttaactgatgacgttccaccattgtgattggtttctgccccaccctaactgataaacgtactttgtaatctcccccacccttaagaaggttctttgtaattctccccacccttgagaatgtactttgtgagttccaccccttgcccgcaaaacattgctcctaactccaccaccttataggtgttgagaaacctataagaactaatgataatccaccaccctttgctgactctcttttcggactcagtctgcctgcacccaggtgaaacagacagccttgctgctcccacaaagcctgtttggtggtctcttcacatggacgcctgagacacagaccagtctggccaacatggtgaaagcctgtctctacaaaaatacaaaaattagtagggcatggtggcgtgtgcccatagtcctagctacttgggaggttgaggcaggagaattgcttcaacccaggaggcagagttgcagtgagccaagatggtgccactgcactccatccagcctgagtgacagagcaaaactctgtctcaaaaaaaaaaaagcagcagcagcagcaagcaaagaaatgacagacacagaattcagcatgctggttacctttgagaggaaggaagaagtacacaggaggtctcaatgctattggtaatattctacttttttcaatacatactcttatatgcgtgacacatttaataaacattttttcaaagagcttcactgacaactgaaggtctttctaatacagaaagacaccagagcagttcaaagtaaatataaaggagatgagagcatcacagtgaaccaaacaccacacatacacaatattgtaaagtattttaaatccagcaaagtgtatgctttgtagaactgagaagacagattccttgcccttatccacttctttccaccgttctgtccacctctgtcttcctgatcccacctctacttccatgtccagaatccacttctacctcctccagagattttcttccatatatcaatctgaagggcacccatccttcctctcaatttccatagcatttgtacctcttcaaagccttcatcatattatcctcagattacacgttttaactcctctatcagaaattagcacctggagaactagaacaccagtcacatcatcaacctggctctccaaacacaccaaattttttgttgactattgatttaaaaaatgaattagaaaattcaggcatttccaagtgagttaagaaattggtctggacaagaaagaaagaaagagtttaaaattacactccttgaaaaagaatttcaaaattgaaaacccttcaatacagcaaagacaaagctgacaacagtcagataaaatataaaatgtttatagtgtatacagtgataatttttcatattcacagggaacaaaattagaagccataagaataacttcctgattacttggcatcagaacagtccacggctttagaaaatgtcttgcagtcaaccacaaacctagggaacaggtagggttgtaaagtgtcttttacgggggggaaaaagcacataccatttcaaggctcgaaaaaatgaggttacttttagaaatttcagcaatatttttaacttgctttcagatattttaaactacttaccaccagaagtataaacctaaacattatgtgattatagcagaaatggaactactacataagggaaaaagaaacaaaccacaagtgaatcaacgacaaccctcaagaaccagacgctactactgacaaccattagggtttcttggctgcttgaatcaattcattcccagctctgctttgagctggcactaatttaaaggagacaaaaatgttggagctaaggctgccagatttaggaaatataaatacagcaagcccagttacactttaatttcagacaaacaacgaatcttttttttagtacaagtatgctcccacgtaatatttatagtaaaaatttattttaaaaattttacaaaaattcactgtttatctgaaattcatatcaactaggcatcctgtattttatctggcaaacctagctggagccaaaaggtagaatagtaatcaatccaatttcctcatttttcagcagaaactgagaaccaaagaaaggaactgacttgcttaagcttaagccaaagatcagggaagtaagttggttttgaaaagagaaaacctttccactaggtcaccttgggtaccacttacagtacattccacttccaattcttgctcaactcacagaagcaccaagcagacaaggtgtaaaagagtatggtttccctcttgtaacattaaacttcaagtttcagtacatctcttaaaaccctagtctccaaaatcaattaggaaactatgtgctactcttaaaaaaaaaaaacctgataattttgtctacacactaccacctcatactgtttatattttcactcaccatatgaaacaggacatccttctctcctgaactcagttctctcaaaatccaaaattctcttgctccagggtctcaagatttcacacaagagcatgttcacattatttcatgactctcaacgacttgagttcgtatactccttcagttttcatgctttttagcgttttcatgtttttcagatatgtcctaacccattcggttggcctcaaaagtctcccattcccattctgtatcggagcaactaaatcagcaatgaggaatgaagtctcactattataaacatacacttacttccccagggactgggatgcaaggaaacatggaaagagaaacgtctttatcagaaattttggggccaaaaaggccccgaagtatggtatgtgagggttatgctagctgtctaattacatagcatgcaatcgaacaaaataaagagaaaaataacagaaaactccacacatgcaaagaattcattttccagatcccatcaaattaaaaaatacacaaaacatttcctcaactccatacagagctcctcaacctatgacttgcaggggtcctcaagggtagttagcgtggggatgggtggtgagaatagtgatagtgaggcagaaaagggttccatttttatttatttatttttacaatttgggcttccaaataggttttaagaaaaaaaggttttgttgcattaaagaaacatgaaaacggtaacataaaccattataacccccacccaataagttttctattaaaaacttcacccaggtggacaggaatacgaatcgtttaagatgaaaacagatttaaagaccaaagaaaagttagcaattaaaggacaaaatagttacctatgctttccttctggcaccccgaatgtacgcaggtctctcgagatcacacgtcagacgtggaaggtcctcacggatcactagtccgagcttccattttacagatgtgcacactcaggccaaagacgacggctgacgggccaacgtctcacagccggtcagggaaaggaattcacctggcacccggggcggccggcctagagccctgggcgctgaccgtttctgcgattcctggttccgctcggcccggccccaggggcagacgcgagcaccggggcagagagacccactgcctggagtcgcgctgcctctccgcgggctccacgccgggcccgcagcgcagggatgggtccttggcggccgcccccacccagcccagcccagcccagcccagcccagcccacctgtagccgacgcgctgccggcagccacaccccctgcccgggccgggggctcggccgcccttattggcggccagcggcggcggctgcgcgcggcgtgggggactccgatcctagaggccgcaggagttacctcaggtgggctctgagctggcggcgctaccgccctggcccgcctcgagcatgcccgagacgtggacgcagcaaggccgcacctcccccagcgcgtcgcctgtttacaccctacgcccctccgcgggaggacaccgag

SEQ ID NO: 2125 - DNA, 71945 bp, Homo sapiens; identical to SEQ ID NO: 2123

SEQ ID NO: 2126 - DNA, 71945 bp, Homo sapiens; identical to SEQ ID NO: 2123

SEQ ID NO: 2127 - DNA, 137539 bp, Homo sapiens; identical to SEQ ID NO: 2124

SEQ ID NO: 2128 - DNA, 31381 bp, Homo sapiens
aatgacccaagctcctgtttgttgattgtgatgaaatgcatgctgaggcacatgccttgggagctaagtggcagctatacttcactactatggcagtaaagatgactataaagactggcgggggatggatcctttcaaatgtacctgagctgggatgcccagcttgtggaacgcacagcaggaggtgagcagtggccagtgagtgaagcttcatgtgtatttacagtccctccccatcgctggcattaccatctgagctcttcctcctgtcagatcagaggcaacattagattctcataagagtgtgaaccctattgtgaactgcccatgccaaggaagtaggttgtgttgcccttatgagaatctattgcctgatgatctgtcactgtctcccatcatcctcagttgagactgtatagtggcagaaaaacaatcttgggcttcccactgattctacattatggtaagttgtataattatttcattatgtattagaaagtaataataatagaaataaagtgcacaataaatgtaatgcacttgaatcatactgaatttatcctctccatccatggtctgtggaaaaattatcttccatgaattcatcctcttcctttttttgctgcccaggctgatctccaactcccagcctcgagcaatccacccttcaaagcctccccaaatgctgggattacaggcacaagccacaatactaggtcaaaaccacgtttcttaaacaaaataaaaacttggcgggaagattgcttgagctcagaaggttgaggctgcagtgagtacttatcacactactgcactccagcgtaggtgacagagaaagatgctatctcaaaaaataaaataaaataatcccactctgcccacatcttaaaaaaatatattgtccgtatcttcatgactctcattcctggcccttaaaattctcctcacactggacctttgtattcatccacttgtttgaccccttctgggacctgacctgtcccaggaagagtccccattttcctccaatgcacttgtctttgagtctacctggccagacacccaagagttaccttgaggtgttacttttctcccttcccacatccagcctagcaaggcttgctgattccgccctgaatacaaatcccagaccataccccatcttccttcactgccttccagcgctcagtcaaagccatgccacagagcagccaggttagtttcattggaagtaggaggtgaagcctgtcattctctggtctgccatctgtagtggcttcccactgtacctggaataacctcacagcccctgatcgggcctgtaggggcgcgggtgagctgtgccctgctgttcctctgtcatcccatcatcccctctgtggattgcttgctctgtgccagccaccatggtggtctgtgtacctttcttcctctcaagtcacagcctcctgcactgtcatgctgaggggtggtgtttgtggaatgctctttctttagggctttctgtgcctctcctttctatttgtgtcacagtttaaacatgaccatattggagaggtctcactgagcaccatcacacctcagccttgaggctcgctgaactcatcatccttttattttccacgaagcagtgctgactgacatttttcctcttactgtagcacagtaaaaaacatccaaggtgaaggattagagctttaaaaagtttggtagtgtccaggcacagtggctcactcctgtaatcctagcactttgggaggccaaggcagatggattgcttgagctcaggagtttgaggccagcctgactaatatggtgaaacctgtctctactaaatacgaaaagttagccaggcgatgtggcccgtacctgtaattccagctacttgggaggctgagataggagaattgcttgaattgcattaagctgagtttgcaccactgcactccagcctgggtgacagagcaagactcagtctaaaaaaaaaaaacgcgagaaaagagaactttggtagtatttaaggaaagcatacagagtgagtagaagtttgccaggtgaagagtcaggaggatgatatttagcagaaggaaaatttaaccagattgtgtgtttggcagaaggaacatctgaaggaacacctgatgaggctgcacccttggcggaaagaacacctgacatggctgaaagcttggtggaaaaaccacctgatgaggctgcacccttggtggagggaacagctgacaaaattcaatgtttggggaaagcaacatctggaaagtttgaacagtcagcagaagaaacacctaagaaaattatgaggactgcaaaagaaacatctaagaaatttgcatggccagcaaaagaaagacctaggaagatcacatgggaggaaaaataaacatctgtaaagactgaatgcgtggcaggagtaatacctaataaaactgaagttttggaaaaaggaacatctaagatgctcacgtgtcctacaaaagaaacatctacaaaagcaagtacaaatggtaagatgcttgagtgaactttgtaaggtttattggcatttcaggtttcttagtgaaaaaagtgtgatatgggagtagctgggaatgacttgaatatctaaataaggcaagcttaggcaacactttttcatagtatagaaataagtagatattattccgtaggccctggaaaaattctcacaatacttctggctgtaaatactaagtgaactaactaacaatggctaaaaccataggaaccaaagttgttttggtggtacagggatattataggatcccacatttttttgtttgtttttcatttgagacagagtctcacagtgttgtctgggctggagtgcaatggcaagagcaatctcggctcactgcaacctctgcctcctggtgattctcctgccttagcctcccaagtagctaggattacaggtgcccgccaccactccggataattttttgtatttttagtagagatggggtttcactatattggccagactcgaactcctgacctcatgatatgcctgccttggcctccaaaactgctgggaattcagccatgagccaccgtgcccagccaggactccacttttggttggctaattagcaacagctccaatcatcatgctctctcaagacaatatttaaaggctggaagggctgcttttgttcacatgtttcttttaaatagggagaaaacttggaagcttgcagtaatcttcctgtgacattttattggctggattataccacatgctcatttctaaaccagtcactagcaaagcaaatgtaattactgtgattagcttagaataatgatttctctttttgagatgggatggggtagtggaataatgaatatctaaataagcttgtgtttctgcagcaagaaagaataatgtctttgcataggaagccagcaatgttttctgtagggattcattggaaaagtttaagcaagggagtcacaagattagatttgagtatcagggcatactggtcatggtataaggcagagattggcaaacttttcttgtaaagtgccagataggaaatacgttaggctgccggacatggtggctcacgcctgttatcccagcactttgggaggccaaggcacgtggagcatgaggtcaggagttcaagaacagcctggccaacatggtgaaaccctgtctctactaaaaatacaaaaattagccaggtgtggtggcatgcacctgaaatcccagctactcaggaggctgaggcaggaggattgcttgaacccaggaggcggaggcttcagtgggctgagattgcaccaccgcactacagcctgggtgacagagcaacactccatctcaaaaaaaaaaaaaaaagaaaaagaaatatattaggccatgtggtctctataacagctattgaactctgcattgtagggtgaaagcagtcatagataatgtgtgagcaaataggcatgattgtactccaataaaactttgtataaaaaaccatttggtaagctgaatttggcctgtggcctatagtttgctggcccttcatataaaagatagatggagggtaattacataaaaagatttaaagacaaagtaagcttgtgtagtagttcatgctatagtctcctttttgtttttttgtcaccaatctgtggcctagtatcaatctattatgaaagtttgacccatccaggataaaatgaatcaagttcagaagctcagtttacacatttaaatatgtaagtctttctttgccattattttattttgatttgttttactgaaatttttttaacttaaaaaataacagtagtaactgttagggtttctttttccctgtgaaagccatcagttaaggggccatgtctaactaggcaatataaatataaaatagtttgtatttccagtggcactggaaagataaagcaaaggcagaaaagatgtacagttaatatggtttagtgattattgagtttaaaaagctaggggacagatacaatctcaggtcattcataagtttccagattgtgcatgagcatttacaatgctcatggggaaggagtaggaaattgtcaggttaacagagaagagcaaacagtcatgggacagaccagcagttttctttacataatgagtttaatgaaacattcatgtgggatattttcagtaggtaattggattataggcatttctagctggagatagaactctggttggagatgtaggcttaggataattttattataattattgggcaaagccatagatctcaatgagcttatccgtgatgcagaagatatagaataagaagaaagccattgacaaaaccctgggaatatcaacatttcacagagtcaaaggacttggtaaaggagactgagcagtggctaaagaaaagtaggagaggagtcagagaaagtgatgttgcaaattttttttaaatgtgagaatttcaagcagtaagattactgaaaagtgaattggatttaacttacaagttcttcagtggtaatctgttcaaaagaattattttagagttgttaggtatactgttgatgtggttgatatttctgttgtccaagaagaaatctcccaagatcctacctaactttttgtaactaaagcagcatacatacacagggtctgggaaattatctagactggtgagtacacctgccaacatttttccagaattgtcaaaacctaagcgtcatgtgtgaggaaaagtgttgtcttttttatctgtttcttgtggatagtggagatctgtgttgtgtgtgtctctcacacgaacacacacacccacgtacacaaataagtacagtaattcacccttatccatggggagtattttctaagacacccagtgaatgtctgaaattgtggatagtatgaaaccctatatatacatgttttttctatttatgcttatttatgataaagtctaatttataaattaggcacagtaagaaattaacaataacttatgataaaacaataacaatatattgtaatcaaagttaggtgaatgtggtctctcaaagtgtcttgtattgtactcactcttctttttcttgtgatgactgtgagatgatataatgcctgtgtgatgagatgaagtcaggtgaatgaggtaggagttgtcatgtggtgttaagctattaattatttctggctatctgactacatatcagaaggtggatcatctgcttcatgtggatcattgagccatgataatgttgatggttggggttcaggaacagaccattttgatgactaatgggcagatagcatatacaaagggatgattcatgacctgggtgagatggaacatgatgtcttaatacttcatcgtactctttagaatgacacattatttagaacttatgacttgtatatttctggaattccccatttaatatttttggactatggttgaccatgagtaactgaaatcatggaaatcaaaaccatggctattatattgtgaaacatatgtttggtcttcaacactgttttctggcataaaactcataaaatgtttagaatctccaaagtgatgtctttgtatgctaataattgagtgatggctggcggtccctaggtagcttcaggataggagctggtcacaaaaaagaacaaggcatgattagagtgttgggactttcagccccacccctcaacctcctaggaggtgagaggagatgaaagttaggtcaattaccaatagccacagatttgttcattcatgcctatgtaataaagctttcttaagaacacagaaggactgggatcagagaccttccagatagttgaatgtatggaagtgtttggaggccgatgtgccctgggagggcaaggaagccccatgccccttcccctatatcttgccctatgcatctcttcatgtgtctgctttgtgatacccttcataataaactgttaaatgtgtttcccttagtatttggggcactctagcatgttaatcaaacccaaagagggagtcatgagaaccccaacttgaaaccagctggttagatgtttcagagacccagatttgcaactgttatgggagggcagtcttgtgagactgagccctccgcctgtgggatctgagactatttctagatagacagtgttggaattaaataaaggacaaccagctggtttctgctacagaattggttgcttacttgttggtggagaaaatcctccacacatttggtcgcagaagtcttctgttttgatgattgttgtggtgtgagagcagagggaaatcatgttgtgtgtgtttctttctacacatagagcagataaagagtgactactgtatactctgttctaactgcttctagttcatttgtctagaaattgtagtttctaagattgacactgtccacttacactaattctgctaataatacaattttctgtcagtcttatagggttctgtttggattatgactattgtatactgtagttcacttgtagataccaaattgtgataaattctatctttgcttgcacttgagaactataaaggagtggaaataagagttgttaatgcattaatttcctaccaatataatgcttaataataattttactatagtctcaatgtatggtctcaaatgaatgctttatgacaaatcatctgagtctttgtaacaaagtattggagtattatgcttttttaaacaagacctgaatcatgcacgaaagtgtgcatgattcttttaaattaagttgaagtctcatgatgtctcccaggctgctttcagactcctgggcttctcaggtgatcctcctgcctcaccttcccaagtagctgggattacaggcatgtgccatcatgccctcttatgtttttaatattctgtattttttatttatatttgttgatttaatatattttactttttttctttaatagtggatgtgagttctgtagagtctatattcaggtaagactttccagttttttaaaacatgtatgttaactcagaaaatataaagaaaccagtatcttttgagtgttctactctgggatagacaacatgtgcttaatatgtattatctcacatagtcatcacacagttttgcaaagcatctgtgctactatcacctactttgtattaaccaggcaaatgtggttcagagaggttgattaattggcctatgatttcacagctaaaaagtagctgacccttgagtttgccatcagcctaccttgctcccaaatcccttctcttgccccaaggcatagattgatggagacctgtgcatcactagaatcaaggtacaggtccagatgggatcaattcacaaagtcacattttgttatatgttacctctttttagagttttcccttagaacactggttaatccaagactttgttctaatatgtttaatagtcaaagtgataaccagtaccttgtttttattaccaaagtttttagagcagaccttacttagctgtggccacaagacataggtttttgtttcataagcaagacctggtgaatcctatagatgaattattttactcttagtggagaatatctacatatagatatgttatattaatcatatttagaggctatttcttatagatttctctatttactgacttcccagtttagtttttcttcaaagcagtaccctgcctagttgcatgcactcttcatttttttttagagtcttttttcttcttccatgacttttctatagtcttttcctggttactttcttctctgctttcctcggtgttcttttcgtgtatgattttattctttccaccagccccatttttctatagctaaaattaaaagcacatggaattttaggattgtaaggactcttggagactaatcaaaatactttcatatttcaatctgtatttaatatcctggaaaaatggttgttcagatggagaatctgaaactcaaagtgacttatttaaatatcagaggtagcagaagtaatatttaaactcatttcaaagcccattactcttgtttttataacatcatgtgagtgagtgtttgaataatagaaagaaaagggaatgggtctaattaaacaaatggaaagggataagaatggaattagctggagaacccagtggaagtagataagaatggaattaccagggaaaggccaagtttgaagagaaacaatcccaggactggtaggagtaaggattttaccaaagagatcagaatattggatcttatgacaagtttgatgaagataaattagaggaacaaaaacacagatgacattgggagttatctagaaactcatactaaaatagggttcaaaggaagtcctgaataggtcgctgctttttcgcttctttaattggagaaatggacacacttcatgctttctattgaaagattaaaaaaaaaagccactgcaaaaattctctgcaagcagatagaaatgtcctattgtgttctttcaccccaaatctcacaggagtggcttagagccccttgagtgctaggggattgaaggttgctgaattacatagatctgtggcccagggcaggtgtcccctcccctttgcctctttttccaagcctctgatgtcttacccatgtacatgtaaagcaggggtaagattggctgtcaaataagtcatggttcagttgggtttttgataacatgcttacgctggaggtgaatgactgactgagactccatttagttgttttccaggaacaggtaaatacagagcttctaggttggtcattgagtttatcttttcagtaatctgtgctttgatgagcagaatatttaaaggttggagactgccatgaagctctgcagaagaaagatctggaagtgggagacacttttactatatatagtggctcccacttccagatctttctctctgtgtaaatatagtatttagagaaatccaactatcaggactcagtttttctagcagtctctctccttgggtataagtacctatgaagatttttaaggcttttctagtttatgtagacctgaataaggaaagacaagtacaaaataagtaattagattttattatttttaatgtttcaatttttgttgagaaaaacattcccaataacaaatatacatttgtgttttgacatttgtaggttcagcttttcaacatttcaaatatttcagggcactctctgcagtgttttagggtgaagggaagcaacagggccttcttaagtggtttttatgctgaaaaacaaagaatgtcattttccagtgacacagattagtctttgaatcagagatagataatggagaagaaacaaggtaaatgtatctttctacctcattttaggttatcaagtttgttccagtttagatatcaaaagttatgtcagccattaagtagattttcagttaatcattaaggacagtttgtgaggacgaattatactcagggtatgccaattatattggctgtcactacttattatggaactaagagtcagtcttcattggatgttataggttggggaggtagagtcaaaaataggtaactaaaatcttttttaaaaacagagggcatattttaattataccaagaagcatgatttaatatacaaagactgatttttcccagattttggtttttgttttcattttttggagtgagcaccaagatatgaactagcagattttctttttaaatatatgaatttgcttatttttgttgtatctttttttctctaaaatctgttcagcaaactgactattgaaaattcacagtctacaaaacttaaggaagactttaatcttgctaccaatgtaaaatggtctcttgtgaagttgattttctcagttggaatctagttctgtatagtatttacttttcatgtttagcagtggtgtaattaccattatttcatgttggtaatataaagttggtcagataaaaacattttatggaaatatgagtagttgatttaacgtttttttttttttactttagtaaataacaaatgattggtaaatattttgagggtgtgagtgccaacaaaaggaatggactggagaatacatagtgataggaacattatattagaaaaaacttttccacaatacagaatatataaaatctggtaaaggtttatttggataagtgtacttactgtgacttttaaaattattctattgtcacttaaaaaactcatgcttaaatttatatttaatggatccagttacttactatagtaatcaaggaatctctctgatactgttcagttccaaaactgtgccacatagcatatagggttttttttgcacgtattattttgatatcatgtagtttttaggagagagctttttctcagtttctcttcttggttctttaattacaccaaaataatattagaaattgtgaaaattttgggggcatggtggtacatgcctgtagttccggctaccaaggaggctgatgcaggaggattgcttgagcccaagagtttgagaccagtgtgggcaacatagcgagaccttatctctaattttattttttatttatttttttgagatggagtctcgctctgtcacccaggctggagtgcagtggcacggtcatggctcactgcaacctccgcctcctgggttcatgccattctcctgcctcagcctcctgagtagctgggactacaggtgcccaccaccatgcccggctaatttattttatttatttatttatttatttattttgtatttttagtagagatggggtttcaccttgttagtcaggacagtctcgatctcctgacctcgtaatccaccctcctcggcctcccaaaatgctgggattacaggcatgagccaccatgcccggcctatctctaattttaaaaaataattgtagaaatttagaaatgtaaattctctttctcagagtctgtattattaaggcatgccagtgtgttttctaaattatttcattaaaagtatattttacactcttcatctcaatgaagaatgcaggttttaccccaagtaaacaaccagtgtatggaagcagagaatcttactaagcatatggtagaattttaatttcagaatttttaaattgcaatttttaaacatattgttaaaagattttttatcacatttgaaaattttaaattttggaagattttgtattgagttgtttaaataatcgttttgaagttcttgcatcactataagatactgcaggttagaaaacatacttgtgtgcagcctagtgtacccagaatacagtcttgcctataaaaagagttttaaaagttttcaatgtgaataaataagcagaaaaatgaatttttatgtaatgaaatgttacaagtaagataatatgcataatatatcttataataaaatctaatgcatttccaaaatatggcttaaatgtatattttcttttaatatttagaatgcataaattcatgtgagttatcttgagaaaatatgtcttaaataagacaataaatcagaggtatgtagtaaacaggaaagaaggttacactatatcctccaagtggagtttagattaaaaaaattttaatatatttaaatatattttagtctcaactcattttttttttttttttttttttttttttgagacagagtctctctgttgcccaggctggggtgcaggtgtgcaggtggcatgatctcggctcactgcaacctccgccttctgggttcaaacaattctcctgcctcatcctcctgcgtagctgggactacaggcgtgtgccatcacacccagctaatttttgtatttttagtagaaacagtgtttcaccatgttggccaggatggtcttgatctcttgacctcatgatctaccagcctcggcctcccaaactgctgggattacaggcgtgagccaccgcacccagccgaaactcatgttctattaaacatatcatttcaaggaatacattactctttagaattctgattaccaaaactttcttcaggtgaaaagtttacgaaacattcctttttaaattttgtctctctgtagtaaaaatgttctagcttttaggtattggctgaagaccatgtttaactaattgagtgtcttattatataataatgaaattaaaatctttattacacaggtattaacaaaataactaattgtaatgcaaatactgaccagcattataggaatatattatgaacagaagtctgtattttacgtatttcatcacatgtcttatatagtagttgtttttccttttctttcatgactgaagctcatacttgattgactggttatgtctcttgtttgtttctccctcctccttcacctttttaaaaatgatttaccccagacttttttctcacagaatacatttcttcagtgtctgctttttagggcatctctgtctcaattgtcagcatatttatttacaggtttctatttagttgctatgtattattttcattaatcaatcattgccgccccccatgatttattctttttttctctgtttcttggaagaagcagaatttatacaattatttatacttagctttttgccacacagaatagaaacaacctatgctatttcaatgcaaacccagttaaataaggtactattaaaaactaagctctcacacttttccatacaagaggtaattaatacaactgtaaattgtgaagagatatttcaaaatataacatgtaatttaacattttaattatttctacaattctataatctatgtaatggtaaatttttgtcctaggttattttggttaaaaaaaaatctaatggataccaccatatttgtataataataaattagatgaagggggatgaaaggaaattattcattgaagaagggtaagataaacatagagactacatgagagagtgaagatgagacagactattataaaaacacagcaaaaatagtggtttaaatgagagcaggaactctctagaataaaagatataatataaattatttaaaataaaaattaagaaaacatagccaggtaataaaacactgctcaggtgtttttgactgacttatagctgattttaacaaaaagctgaaagaaaatataaggacgagtataggtaagagcaatttgttgtactctttaaaatacctagtagagaatagtttgaatgtttctagcataaaggaaagataaatacttaaggtgattaatatctcaactattctgatttcattatgtgaatgtattaagttattatatgtaccctcgaaacatatacatttatattgtgtgaacaaaaaaattattaacaaggaaagaattctcacttcttttagtaactttatgttttatatttaatctagtcatacttatattaatgcagaatgcaaagttaaattggttttaggccttgtcagctttattgtgaattattaatttttgactctttggtttctggtttaagatttctaacttaatgtttgacatattcttaggttatttaactaatttatcctactctttgatataaccttggtagctgttttgaatatttttgttaatagagtataaataaataagcattttatttaatcttattaaaattaaattttctgatcatatgaacaaggtttttaatctatatctcttaaaagagaaaaatcttttttcttgagaccatcatggctaacatggtgaagccccgtctctactaaaaatacaaaaaattagctgggcgtggtggcgggcgcctgtagtcccagctactcgggaggctgaggcaggagaatggcgtgaacctgggaggcggagcttgcagtaagctgagatcgcgccaccgcactccagcctgggccacagagcgagactccatctcaaaaaaaaaaaaaaaaaaaaaaaaaaaaaaaagaagaatcacttttaagctacaacactctcaaagaaataaatgtagaaattaatctctagaaatattctgacatcttttgctcataatatctgtatgtaatggtattatatgcacacatcaaatgaatgtaatcaatctttgtgaattttttaaagtaaagtacctattattatagaatcatatgtaaggaaaattgttaacagagtaaacaaacttatcattggaagaatttttttgctcttaaaaatatctcttgcaatcgggatattttatattatttccaggaagccttaacttagtcttcataattattaaaccttgcacatatatttgtttatttctaaaactcaggaatcctgtcgacttgaattttgtagtttctttcttcacttctcctgtaaatactggatcctgcttgacaatcatagatgtatgtaaaaactattaaatcttcaacttgaataattattggttaattttctttatatgagatcttttctccaattttaaactaccatcctatatggtgtaaataggcaatgtgagctagcattctattgtttacaggaacataagaaaaacatgtgaattttaaaacagggtttcacatttctatctcactttataatggtaattaaaaatgcctcataattctataattaggtaagcatttctcttgtacaattaaaaatttcaaagttaatttttataaaggttcttttgcagaatcttggtgttttagaattaaatgttttcattcaattcaaagatgcatattgcaatatttcagaaatatttacctatataaataaaattattttcttgaaacaaatttggaaatatataactgagaaacttaatcccatgtttttgtctctcctttgattttcttttttttttttttttttttttttttgagacagagtctcaccctgtcacccaggctggaatgcaatggcacgatctcggctcactgcaacctccacctcccaggttcaagcgattctcctgcctcagcctcccgagtatctgggagtacaggcatgcgcctccacgcccagctaatttttgtatttttagtagagacggagtttcaccatgttgcccaggctgggctcaaactcctgacctcatgatccacccgcctcggcctcctaaaatgctgggactacaggcgtaagccactgcacctggcccgatttcactttcaaaaattcaacagtctgcataggttacttaattctacccatttagcctatcttataaatatttatcttatcactatgtaattttcctcatgtaggtcatctactcatactccaaatgtatttatccagatctttcttccaagccccttgggtgccccaaatcttataggtctcaaactgaaagcatcatttttattctgttcctgttttctgactcttcgtaatctactctgtcatctggtttccccatcctaggaaataacacctaggaagtagcggtgaaacactcaagcacttaaacctgcacttcaaccctcccccacatcctaaacttcaacccttttccatgtcacccatccagtcacacacctaattttgtattttctaccttcttataattttccatatcttattaccataattaactctctacctataattttgaagtactcctttctagttttgccccatctccccatgttcatctatctttacatcgctggaagggtcacctttctaaaatgtatttgtaatgatgtaactcatctgcatattgagtgaatacccattacacgaaggggtaagttcacattctagcgtgacacatatcttatatggtttggccccattttatctcttcatctctttcctctgtgttccagttttacgacatcaccttggcacccctcaattgccatgttgtttcatgccttattattttacacatgctattgcacctagagtctttgtatcctgactctgcactttgtctgtccttcccaatatggccccattatggcagcattttctatgcttttcagataaaactgattgttctctcctttgtgcccttatgtattatattgacttaaattgtagaactggtgaattatacttttctgttcttatttgttttcacgtctctaacatttcttgaatataggccagaatctatcttctgtgtatatttcctgcttctcccaggatagtgcctgtgattcgatagatacaatgtatgggtttttttgtttgtgttttgttttgtcttactgacaaattgagtgaatgagtgaataaataaagttttttctgaagttgttttttggtgctttttggtttttgtttgtaatagaaggaagcaacaaagacagcaactgaacaacaagaaaatgatattggaattattgaatgagcgccataagatctaacaagtaatgacaattttctttttttataccaaaataatagaagtggtaagttagtatctctgaaaatttttctatgcttaaatgctattatttagaaaacaattttatagactgaaatacaatgtctaccttaaaaaatactttttgctatctttcatcatactatcaattttctgaacctgctttgattctgaaattctatatttgctattactttttgaaatattcataaatggaaatagatttgtgtatgtttttataatttacagtaataaatgttctcatatgtgtgtctgtgaataccattctgtagataagatgcccacatcagagtcaggacaaaaagaagatacgaaatcaccttcagtttctgaggtaccgtgtattgttgttattttaaaacttaagtaatgagtaatcttaaaacataaaaagatgactttgtctcacgtctgcatgtgtccataagccataagaaattttctgacatttatcagaacatactttataatcatatgccaagtagataacagctgcatagtgcaattctgctaatttgcaggattaatttacaaagccagtgtagaatagagcaaaagaaaataaggcatagaagaaaccaggaatctgagttctgaagataagtttgtctaaaaacaaaataatttctctgcattcatttatgggcaaatacatgattctgtgtatatctagatgtatgaaagctttacttggattcagggagaaagagtttaaactgtagtcttagtgttgctcaacttggaacttgaaaagataatgcctgggacttgaaagtattagtatatttcgattatccagtatagatctgaaggaacatttcaggagttggataaacatgagaaataggacacctgtaaaactataacacaacaatttggttgagtagtattttaataagtagacattcttttcacaaatagaactctttgagtccctttgtggcagccatgtttgcaaccacataggtatcagataataatgatgtattccaaggtcacagctatggatgtggaagagataggaaaggcctcaccacttaagatagaagcagcagctgcatagtggtaacagcaatgagtggatgtcaaaaggtaagtctgtattttgattctgtcacttactagctatgggaacttggaaaaaatcatttaacctaatcaaatactagtaaccttgtatataaaaatagtgctcatatctacctcttaggtacatgagatgaaataatgttgtaacaaatgtgaaaacattctgtaaactgggaagtctgtatccaaatgtaagacaaaacgatcaaagtggcatttatgtgaaagcagaattgttagcacaagaatagggagtaagaacaggcatgtggatttctaattttgggtaagaggatggtaactttcagcaggctaccactgcagattttccatagaaatatagcagtttggaaaattagactttcctgttgagattttcaatgttttgacctggagtaatttctttctaagtaccaactgtgtgctaggcagtgagtctctgaatatccaagatgagggattatgctgcagtagtaggaagataataacaaatgaaaaacacttataaatcactgtaactttttcttaaaaacaaaacagagaatgtttggttagagaaaattgaagaactttataattagcatgggtatgggagtggcagtggaattctatggtcagagtagatctttctgcgactgccattcaatctcctgtctcaaagatgaggagtaagccatatgaaagtctaggaggaagacattctgaacagagaacagtggaccatatttgttcatcattttgttcttaacaacctagaatgactaggaagcagaaagtggggtaaccaccaacatcatcatcatcctcattattctaaggtgaagaaaaatctgcacatatgtgtctggcacatgttagatgtttcacgaatacatgtttttatttttctctttttgtgaaggcttgctctacttttctgaagttatgtcttaagaatcaattgcatactttatctaatgattgttttcatttaaaaataacaaatatatattttccttatgaatctttcattttattcaagcagttatcagcaaaaacttatcaaaattattcttaagcctttgttttcctaaatgaaacagatttagagttcttttcctactccgcatgacatactctgaaaattctcgtgccatgcatagtttttaacaaaaattctgtaattatgcatatgtcaaatgtttaatcatattgtattttgtttgcaatgccctattatttttggtgaggactacagtgtaaggcagatactttgaagttaattccttttgaaatatacacacgtgaatttttttgtgaatatgatttatttttcatgctcagtaacccagtcaatagccacatgaagataaaagataagcgtgttctacagagcatatgcaaggttttctcttgaaatgtcttggttttcaatatgtgaacagcctgaaatctaattgcctttaaagtaaggaaatgtgttttaaaaaagatttgaaataaaaaatattgatgcttgtcattatttttaaatcaaaattatttattgaggcagaatgtggtggcttatgcctgtaatcccagtattttgggagggaaaggtgggtggatcacttcaggtcaggagtttgagacccacctggccaacatggtgaaaccctgtctctattaaaaatacaaaaaaattagccaggtgtggtaggcaatcaatatatatttgttcagtgtatgaattagtgattgttaaaatatgctgtcctttatatcccaaagtactaatatattttatttctatctcctcctcaagacagattcaactagcctatcaatattcttgggtgcagttccttctcatgaaagagcaagggaacttaaaaaatatcactgtgaacaacttacagcaaaaataaaacaaatgaaaaataagttttgggtactacaaaaggaactatcagaagcaaaaataaaattgcagtaagtgaatcaaaaggttaaatgggaacaagagctctgcagtgtgaggtatgacatcctagttttaaataaatatttcaactatttatactaaaattatgtaggatactttttgtaatagctgacttaccttctgaggtttaactgcagaaaaaaacctgtcttgtagagtgtcaaattcctttaaataatacaagttcttaactttgaatacttctactgataattaaatgcatatttatttaaatcacaattttaatgactatatagaaggccattatttggaaatcccattatttacttaacaaattaatttttttgatttttaattttttgtattataagtgctgcaaggcataactgcaagtaaatatttttctacctttctaattattgatttggaataaattcttcaatataaaaatatttggttaaattataggaagttttaaaaagttctttgttcattacttccaaattgttctcaagaaaatttatattcatttacagttcaacaaagagagtgtgaaacggccattcctctccccccaagaatcaatttcctttaattgtacacttttaatcttaatgtgtatggaatataaggaaaatacttgtttatatttttaatcttttcctttcagaactgtgataactaaaagtgcttgttacaatgtctcaacttataatttataaatataattcttaaaattatatttttaaaaatagaatatctatagaatattctcaggaaaaaggaaatgaaagggctttgggaaattttatctgtctaaatataagcagcactaatattgggggaactggccagcagcccgcaatgcaacagggctccttctttgttcccaggcggattggcaggttgagaaataaaagacacacacaagatagtgaaagctgtgtccaggggggtcaccaccttctggtcctgtgatgccgccaatgcactggatataccagcatttattattaagtttagtgagggtggggataggttagtgagggatttatggtcatttgattatgaggtgagatggtcacgagggtgaagtaatttaacataacatcagtatgcagaagtacagcatacagagataagaatttacaatatagtgtgtgcatcagcaatttctaacagagccttaaaacagaaacacagtctttccataacctatgattagcaagatattaatcagcagtaacagttgcagcaaaagctggttgcaaacaatccatagaaacaggacgtgaagctagacaactggttagaccacaaattctcagaagggagtatgctttaaccctaaagaggcctagaagagccgaggcaagataagggcatttatagccccatcttatccatataaacaggcgcccctcatgcgttcgcttataggctctccacaagagtcacattccattcccagagctatgaacatctgcttttctgggataggaatcatggtgatgtgaaacctccctgactgcatatccgttcataggctctctgcagggggaagcgtatcacgcactgttggcttattctggcagtccaacctggcattgtctttacacaatcctgcatgcaattttgtatttacaataatcaggagtatttcaccttttattccaaagcaatagtttcaaggggtctccctacacactaaggcttctagtatggggtcttgtataggttagacatcagggtgtaaatcaaatttttgtatgtagtcaaagtgattaatcttttattttatgcttttgcatgtgttgtaatccagggaaagtttgtttcaattctgaagctcttaaaaattctctagtcatttcttttttactttcatgaattcattgtgttcaaataaatgtttgaactttggggaatttatgctctatagcatttgaagttttgattcaatggttcttcaactgatacctacttacagaaaccctttcagtggataaatgtaaaaattattctttaagaggaaccatgatatcccattttattgagtgctagctaaaaatttattttatttaggtttctcatgcttatgaaaatgaaaatgatctcttacatgaaaatggcatgttgaaaaaggaaattgccatgctaaaactgcaaattggacatactaaaacatcagcaccaggagaaggaaaataaatactttgaggacattaagattttaagagaaaagaatgctgaacttcaaatgaccctaaaactgaaagagaaaacattaacaaaaagggcacctcagtatagtgggcagcttaaagttctgatagctaagaacacaatgctcacttctaaattgaaggaaaaacaagacaaagaaatactggagaaagaaattgaatcataccattctagactagcttctgctatacaagaccaagataaagtgtgacatcaagaaaaaaccaagaacttgctttccacagtgctcatttgcaaggaaaaatgaatgttgatgtgaataatatataacaatgagaagcttcatcaaccactttctgaagctcaaagggaatccaaaagtctaaaaattaatttcaattatgcaggagacgctcaaagagaaaatacataggttttagaacatgcacaaagagacctaagtgaaacatagtgtcaaatgaagaaagctgaacacatgtatcaaaacaaacaagataatgtgaccaagcacactgaacagcaggagtctggagcagaaattatttcaactacaaagcaaaaacatgtggcttccacagcaattagttcaggtgcataagaaagctgataacaaaagcaagataataatattcagttttgagaggaaaacgcaacatcacctcctaaaagagaaaaatgaggagatatttaataactgtaaccatttaaaataatgtttataccaatatgaaaaacagaaagctgaaagagaagtatcaaaaaaaataaatatttttcaaccttcctgaaagaaaatttaaagtcatatttggccttagataaatgctgaatctagtttaatatagataataaatatatttaccatgtcagcttagaaacatggcttatttccaccaaatgcaagttaaagctgagagatgttttactttaagacattgtgtcacttatgaaattttaagaatttaagttaaaggtttttaatagattaacattaatgacattggcttatactgctgaaataaaggtttttttttttttttttttttttttgagacggagtctcgctctgtcgcccaggccggactgtggactgcagtggcgcaatctcggctcagtgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccggccaataaaggttttaatatctctttgtggccacattttatgaccacgatgaaacagataaatgggaatgcccatatcagcaatgagtattttgaaattgattcaacaatttactttgacagttaattctaaattttccagaggaactgaagtgtatttgaagtatattttgaagtgtacatttctgcatcttgtaatactactttttcagtaactttttgtatattttagttggtagaattttattttcatttatgtcaatttgacttaaatctgaacatatctgaatctcaaattatgtattgttatgacaacttaattttttaaagccatctgtgttttattaaataatagcttaggacaaatgtagtggattttagcaatatcaaatttgatttaatcatcccactggtatttataatttactttgaatattgttacaaataatttgctcataatttctatttcaaggctcaaagactgtcatgtggatagaactttgtcccagagaaagatcattgtagctatctgtgatttattagctttgcattggatccccatttttcaattcatggggggtggcagggttcatgtatagtacaaaaaaagtgagtagaggagagaaacttagcagctgcggtcaggagggatgtggagaccaggttacctagggcctctaaagcctttgaaacaaaaatacttttattctgagatagaaacctgttggaaaaatttcaccaggtgattgagtatgtgaggaactttgatgttgatttgtgcttcaataaaaaagaaggaaagcattccacagcatagaatttaccaccactagtcctgcccacatattttcttgagacttcagtaagttgtgaagcattacagattcattaggggacaaatgactagtgggatgaatctggtgtctagtaagagagtaccagtttggcaggaagataataccttcttgtgtccttaagtggattcagtaataagcaggaatgtgtacacataaagaaaataagctgaaccaatatatttggtgatatttttgaaagtaaatattgttaatttgataaggtgatttacaaatcaataacaaacatgtcaggtcactgtgagacaacttcaaaaaaaattggctgatctcaataaacaatgtgtgtctgaggcttcactagaagctgcatcacattaccacattaatctcaaagttgaggtacaggatttaatgaaaaaatgatttcgaattgaaagtcaagtatgtattaaaagtaacatgccaacagtgaatctatagctggtgaaattatataaattgttttatgatactaatctccatggggagacttcttttatatgttcattataattagttgtattacaattttattatcattataatgtgcttatttttaaaactgtggctataattctgcaatgtttttcttatgattaaaaattttctcataatatctgccctcaagaaggttaaaaattatacatcatttatcccacaagttgagagactattcttcggataaacagtatttttcagtgatttatgttgccatggtgaggcaagcgttatttaatcagagaagaatgtttaatggaatattccagaaaattatctgtctgagaggctgccttaaatacttcctaaaatgcttgctgaaaagtccggcaagatgaatatgacttggaggctgggtggcaggccggttttttggaggccggcctagagcctgcctgcatgggagtctggtcgaatgacaagtcttctggcagggggagaggcttgctggaacgctgatcgaaatgctggctgcatggaaggccggtcttcaggctggctggctggctaggaggctgacatagaggcttgctgggagatttgccaagaacccgggtgagaggcggccgactaggaggctggcggagagtccgtgtgagagggtacctcaaattcttgctaattttgcttgctgagggcctggtaggctgagtccggctaagagcctggttgtaccaggctcgcttgttaggaggctggctacaagatcccgtgaaagcctcacggctctactcaacaaatttctctagaaagaggccggagtgtacaagggcttcactagaccacactttttactgatgttgggccggatgtggtggcgattaagggcaagggcgagcggcgggggctggggctggggctggggctggggctggggaagggcgagtgagaggagcggcctctctcttaaaaggtggctgcagccatgcagaggctttctgccactgctgtcaagggcgtgacaagcctggagtgccagagagccttcactcagctggtctaccaccaaagactcttaagtcatccactatagggatatcagaaagatgcacagagctgcctcccggggccacgcctggaagcttgcaggggatgatgtgaagacgaggaccatcgacctgaacataaaagatgcgaagaagaggcgccgtgccctgcctgagctggggctgcaggaggaggtgacagctgtgggaggatcgccccttcagcgtggggtgtggtgggtgtccccgggacaaaggcagcaggtggaagagtgggtcggcagcggggcagaaatcttgggccccggtatctgggccttcttcctgggcaggcccccagtcctgggatgggggcgccctgcagggcacagggacaaggcctgcagggcagagggacaaggccaccttaaaatcaacctcaaactttggctgccttctccttcactcccactgaggctgttggaaacgctggctgcaagggaggctggttttgaggctggctagtcaggaggccgcctaagaggctctctaagaggcgtactgggaggctggccacgccattggtggcatgggaggctgattctgaagctggttggctaagcggctggctaacagacttacctagaggctggctggaaggctggccaaggcgcgggctgcatgggaggctggtgtactgaaggactctcttgaaaagtagcatagaggcttgctgagaggctggctcactgggaggctggcctagagcctgtgggagaggctttctgtctgagaggctgccataaacgcttgctaaaaggcctgctgagatcctggcaggctgaatctggctaagagtcggaatgcaagtctggcttgttaggaggctggcctagaagctggctgcatgggaggctaaccaagaggctggcgaggaaactggcagagtggcagattgtctggctgtgcaagaggcttgctggatggctgttaaaaacgctggctgcatgggaggttggtctggaagctgattgtctgggagattcgcttagagactttctgaaaggctggatcggaggctggctgtctaggaggctggccaagagcctgcgggagaggctgtgtgagaggctgccttaaatgcttcctaaaacgcttgctgaagagtccggcaagatgaatgtgacttggaggcctggtggcaggccggttttttggaggctggcctagagcctggctgcatgggaggctaatcaaatcacgagtcttctggcaggggaagagggttgctggaatgctgttcggaatgctggctgcatgggaggccagtcttcaggctggctggctaggaggctgacacagaggcttgctaggaggcttgccaagaattagttcaaccatcgaggaaggaagtgtgttgactcctcaaagatctagaagcagaaagaccattgacccagcaatcccattgctaggtatatatccaaaataatataaatcattatattataaagagacatgcacatgtatgttcactgcagcactattcacaacagcaaagacatgaaatctaccaaaatgcccatcaatgttagactggataaagaaaatttggtacatgtgcacgatggactatcatgcaggcctaaaaagaaacaagatcatgtcctctgcaaagacatggatggagctggaagccatgatcctcagaaaactaatgcaggaacagaaaatcaaacaacacgtattctcacttataagtgggagctgaatgatgagaacacacagatccatgaggggtaacaacacacaatgggacctgttgtgggggcaggaggagggagagcatcaggaagaatagctaatcaatactgggcgtaatatctgagtgatgggttgatctgtgcagcaaaccactatgacacacgtttacctatgtaatgaacctgcacatcctgtacatggaccccagaacttaaaagctgaagaaaaaaaaaataaagaaactttagtgctgtccagggatgcacactgaacagaaaaaatggccttgtgatttgctttataatattcctgtaaagatagatgaacagatagatgaacaaaatgtaggacaatcttgatcacagaaattgaataatgggtattttagtgttacttttactattttctctacttttgaataggtatacaaattgtaattaaaagataaaaataaatatattaatccctgctttgaaaccacatacaaacagtactctgaaaagattcaagcaatttacatggtactatatggatctccctcgcacctctgtatgtaacatttaaatattttgcaactggccaggcacgatggcccatgcctgtaatcccagcactctgggaggcgaaggcaggtggaccacctgaggtcaggagttcaagaccagcctggtcaacatggtgaaaccctgcaggagaattacttgagcccgggaggcggagtctgcagtgagccaagatggcgccactgctccagcctgggtgacaagagcaagactccatctcaaaaaatataaatataaataaaataaaagatcttctttcttaaattcttacttcatgttattagcaccaaatctgaagggctccattacagaaactctttgaaataagaaacaaatgtatttttgagaaaccacacaagatgtagtaattatcatagctgttaaaagaaatgtgctcataaacaaataacagtaaaggattagaggctttcggtcacaccaggaagtgatattaattataattcttctgttaattctgaaagaaaatatataaacctacttctaacaaacttcccataaaacaaaacaacaacaaaactcttggagttgagaatgaacagcagaagttctagaaaagcagaagttctagaagttctagatagcaagcaactgtggaacacagcgcactgccttctgcactgcccagtttctggcacctgactcacaggtgccaaatggctgcaggattacgacgttggaagtagtgaatatttcctcaatacttgcagtggttcatagcaatgaaaaatctaagatttcctctctgcctttcaggagctttaagggaagcagcaaatactactagcttctcacaagtggttacgttccaagatccacctaaagccatgagcagtacaaagagagccaagcttttattgtttacaagtaaatgattaataaactgttattaataaaatattgttttagctataatagccaaaatattttccaatggccatattatgtgagcaaaataactcgacagtctcctccttctatgagaaagatgtaagcttgcttggtggcaagggtcaatgattctattaggtttagctgattctttatctttttttgttaggggcagggtcttactcagttgcccaggctggagtgcagtagcctcaaactcctgggctcaggcaatcctcccatctcagccttccgagcagctgggaccacaagcacatgccaccacacttggctaattgttaatgcttttgcagagatggggcctcactctgttgcctaggctggtctcaaactcctggcctaaagccatcctcctgcctcggcctctcaaagtgctgggattccaggtttgagtcactgtgtccagccaggtttagcaggttctttttaccatgctcaatttccaaaaaaacacaggagggcagaggtgaggcctcttatgcagatccttcttctcaggtgtcatctcctcacgaatcctagtgacatcacagtggtatctctaatgataaacaatgttcaccacctgacctattttattgcatgacttaaaaatataatgatttgaaaagtgggagagactctttattgatcactggctgatttataatcaagtattaggggagatcaaatatcacaaaaagtaatgaggagtagaaacttaaaattttcaattttttcaatatatgaatttttagagacttaaagtagtataaatagttaaaaactaagtacatgaatcctgcaagtaacatacaaacagtgacctaagtttgtagttgccaaatgagttgcacctaaaacctggtctttgaagactcagtgagtgccacgcaccccacttcaaatccatagggatataaaacgtctgacacatgctgaatatggtaacgacatgacataataagtaattagaagctcccaaaggggttctagcacagaatgagcgctaaataaataaataataaaaacaagaaaaatgcttagtaccttaataaagtagtaaataataaaaaatgacaatgataataacaaggaagatgcttagtaccttaaagatacctgacagttatttgttaagtggacaagtggataaataaataaaaaacattttttaggaaattctgttggaaaaaatgcagaaattcaatagggacagctctactgtattatgagcaccttaaagacccagactatgtgtattccatctttgtctcctgcaacttgcaaaacctaacttatcgtttgataatttatcctttgataaatatataataaagatgtgctcatacagttcatattgtaccatgcattgtgtcacatttagatatcacagtagcatttttgttattgtgaaaaatgtttgtaattttattataatttgttgagcctagagttaagctatttgaatacttataatgataatattttggctattagaaacagagtatcttgttgtaacaaaattactattaacacgctaattatccagcagatagaacaacatatcttgttctaatgaagtaaatatatcttatttggtttcagcttggaatgaagttgataatagtgagaccttgttggtacaagactatgtaacacaacctgcacttctcaacaaaaaattgcttttctgacttctgcactcagtaggtatctttggaaaataatctcctattggtactgaggcaccctggctaagttttgtaattcttgttgacatttgttcgtggtgccagaaaagtattattaagtattattaactattctaaagatagttacttttctttaagacagagtctcgctctgtcacccaggctggagtgcagtggcataatctcggctcactgcaagctccacctcccgggttcatgccattctcctgtctcagcctcccgagtagctggaactacaggtacccaccaccaagcccagctaatttttttgtatttttagtagagacagggtttcaccatgttagccaggatggtctcaatctcctaaccttgtgatccacccacctcggccttccaaagtcctgggattacaggcgtgagccactgcgcctggccaagatagttactttcttagtgacacaagtcactatgtcacaaagttgatccttgaataagggttttcactgtaggagcccactaacagacagatttttcttttcctttggcactgcaagatagcaagacaaatctctcctctgcctcctcatcagactactcaatgtgaaggcaataagaatgaaaacctttatgtataataattcacttccacttaataaatagtgaatatat

SEQ ID NO: 2129 - DNA, 76 bp, Homo sapiens
tgcagaagaaagatctggaagtgggagacacttttactatatatagtggctcccacttccagatctttctctctgt

SEQ ID NO: 2130 - DNA, 12956 bp, Homo sapiens
tgtaatagcatggagcacaagcacaagacctgtctttattagacacagaggattcgttcacccagttttatctgaaacaatggaaggatagcaatgccttactacaatgccgtttaacttattagagctgactcatggcagctgtcctcgctccaggccaattaggtaggtcagatactcagaatctgaagtgttagtaagaagaaaagacaaaagcagaaacaacagtttgcattaaaatcaaactatttttgaagtccaagtggctccagaggaaacagttgaggtaagataatgggggtagaaggtttcctagaggccagtggtcaccttaaaacaaagcttcagtctgacaacccttcaggggctgtggggtccacaattctgcctaactttttagacccacacagctgaattctaggtgtgattttagaatttacaccctgagtgttgtacatacaaaaggaaaatgtttgatgtggctatgagttgaaaacacaaggaacacttttctcctcctaggccctgtgtttctctgccaactcagcactgacaccaccttggagtcagaccaagagatctggtgtctcagaggctggtgggtcacacctaccgcaatccccccatcaccaagtctcagggaaccagcactcccagctcatccatgcacaggttctgctgggttagaaaaaacaagtctatttacctcccagtccagaaacttgctcatcagactccactaaaactgcagtctccaaggacaaaaacttcagaagacacaagttaatttctgaagaaagggaaaagcttcctgagggctgctttgacctccttgtttctcaaagtatagatgagggggttgagggtaggactcagcacagtgtacagcaggccagccaacttgctcttccctgcgctgtagccagagaccgggcttatgtaggcgtagaagacagcggtgtaatacatgcacaccacggtgaggtgggaagagcaggtggagaaggctttctgcctcccccaggcagtcttcaccttcaggatgctggagacgatgaagccataggacgcgatggtcatcaggaagttcactatgccgtagaaagcatccgccaggacaatcatgacaccgttgacgtaggtggagctgcaggagagaagcagcaggggagggacctcgcagaagaaatggataatgacattggggccacagaaatccaagcgcagcatcagccccgtgtggatggccgtgttgacggcgcagagcagccacacggctgtggccagcccgctgcagaacaccttgctcatcatgctgctgtaatgcagcgggtggcagatggctgcgtaccggtcataggccatgaccgtgaggagcagcagctctgaggatgcagcccacgtgaggaaatagagctgggccatgcagcccccgtaggagatggagctctcttccgacaccagactggccagcgccttgggcatgatggaagaggtgcagataatgtccatagtagccaagttgagtaagaaaaagtacataggagcgtggagcccagggttgaacgtgatggccaaggtgatgaggacattacctgtgagggccccagagtagaggaagaggaaacagctgaataagaacacccggtattctgggtgctccgaaaagccctgcaggatgaactcggttaccaacgtctggttactcatcatccttgggctgggacgggtttctgggactatcaggtgactctccatccacagcttcatgtgatttcagagctagagagataaacaagaggtgtcctgaggaaggctgctcccgtgtttcttccacacctcacatcactgcatgaaagatagagatgcattagggcatattgattaagataaacaccccaatattacagtagaaaaaaggcgtgaacactcagtttataaaaaataaatacagttggccagttaaactcatgaagcatcattcaacctcaaacaaatgcaaattaaatccatgatctagtcttcatcatccatgatctggcaaagttagaaaagcatgatattaactagcattagaatggctgcaaagatgcaggccttttaaaatatgtattccatttgagccggaacttcctcttccagaaatgtatcctaaggaataataaaaagcatcctgaaggtgtcagagcagcactatttataatagtggaaatttaaaacaatctatacccttaaacgtgagtatattatggtaaattgatataaatgctgtctaattatcaaagtaatgctttggaagtgttttactgatgcttttaaaaggagaatgacactttgggaggccgaggcaggcagatcacttgaagccaggaattcaagaccagcctgtccaaaatggtgaaaccccattctctactaaaaatacaaaaattaacctgacacggtggtggtggatgtctgtaatcccagctacttggaaggctgaggcaggagaatcgcttgaacctgggaggcaaggtttcggtgagctgagaccacgatgctgcactctagcctgggcgacagagtgagactgtctcaaaaaaaattgttttaattttaaaaaaaggaaagaatgaaaaaaaatttaaaataatgtgtacaataggatctcatttttaaaaaaaaaattaaaaaagcagatttgtttccactgatattgaggatagtgaaaaatttaaaataaaaataaaatgtaaaagcatgtttgtatatgcacctgtaggaaaaacactggtgagtgctagaccagagcttgaacagtgattgttttcactttttaaatttttgctggtctgtattttctactttttctataaaatgacctctctaaaaggcagatgtatcacacagaatcctccttacaacagttcttccatggcttcccattgccaaaagaataaatgctcccagcaacttttcctggatccacctcctctccagcctttcttcccactcatcttaaagccagaactccagccatgccctgcactcacagactggctgatgcaccaagccattccaggatttcttggttttgttcttcccactccctgagccaggaatgccctttttctcatgaaccagggacataatcagccccctctttctgagcatcccttccctggggagaaagtaccactctttcctttgtgtttcctctgatactgacttctatcctagtacacaatacacgtcactccttgatcaggttactggactgtgccctaaaagattaacacatatgcccgtttatctctggacatcccttcttggcacccagccccctgcctagcaggcagtgtgtagacactcaaatatgtgtgtttaaataatgctaaagaataggctagtatgaataacagcagaatgacttatattcttaagttactgcacattctgtacagctcaagataaaatcagcatagtgcacatttggtttttccctttcaactctttattcattaaaagttaaggaagaggctgggcgtggtgactcacgcctgtaatcccagcactttgggaggccgtggagggtggatcagaaggtcaggagatcgagaccttcctggctaacacggtgaaaccccgtctctactaaaaatacaaaaattagccgggcgtggtggcgggcgcctgtagtcctagctactctggaggctgaggcaggagaatggcgtgaacccgggaggcggagcttgcagtgagccgagatcgcgccactgcactccagcctgggtgacagagcgagactccgtctcaaaaaaaaaaaaaaaagttaacgaagatattcattttaaaaatgaacatttggaagatgtttgttttaaaaatgaacatttggaagatgtccattttaaatatgttcattttaattatgtttttgtcaagattcaagaaatgtatttaccactaaaatattaaaaggtttacacaaaatgaccaaacatcatctccagctcaggtcatatcaccttttaataaggtaaaaactgttttttgaataggcaagcataaaatccctatgactcagagcaataaggctatattagcgtggggtatgatcagaatcaatggaaatgatggtgttccatctgtgtatcttcccagcaacaaggtgtcagaacagctcaataacttgagtggaagtaataaatacaatatgctttagctgatttcattattgtttgggacaaaaagagtgaataattactttcgctgagtttgagttgtggatctgaagaaataactgtaactttatttgctcttatgatggcccagtgagtgactcctctttaactccagggacagaattggattttctccatcaatgtcccagtgtgaggtttctgcacttccgactcatgtcctcctccctagaattctagccaccagatttctccagccatcatgaaatcatggtgcactccacagtgcatattacaaacgcaccagagtcagcacagctgcagctgtacctgggagatggaaaacgcatccatcactgaacacctaccaagcagcagtgtgcagagtctgtcacgcatccttcctggagcaagaaaacctattacgaaggaaaccttaaacacaatctctctcttagctccacaatgagattagaaaaacaatagctctgcaatacaaatggatgttttgaacaggtgctgagcacaaggaaatttccacaaatgtattcacattcaaggagcaaattagccctcaggtaattacccacttattgtgattgggtggggacaggaggacagtcttctcaatcaactggtcaataatgagatcaaagaatcggggctccaatcctctttccatgagaatgaccacaagatttctttacagcctcagccagtcatttcttctgaaaaataacaaagaccttgctcccttgagtttcatagggcatttgcttcaattctcagccagcattacaagagtattactaagggtatgaggcaaaataacacaatttcaggtaataaatggcaagtttaaacacatactgcattcagacaacacgatgacatctcaccagcaggccaacaggatattcgaacagcggttattttccacatttatcaaacccttgggcactcaagcttctgaagggggaaaaaaggcatcttggattacatttatcactttaaagaaataacaataatagtcctcaaaatctctgaaattaaaaaggtaatttcattgagtattttctaaagacaaattatattttacataaaatacaatttacttgtagtgagattatatctttgttccaatttattgttcatagtttcataaacagaaaatttaaaagatttaattaataatggagaacttgactcatttcattatttttatctctaaagctgttcaatgattttcacagacaccatattaatctaatgtccttttattgtatatgaaggtaggcatttctattgtagacatgcttcaagaacagaaaactaaaaatcagaacatgccagaatcgcatatgttcagggtcaaatctgaaagacattttgaagataactttgtccaacctattgatttggaaagtcataaatgtatctaaataacttaccctggtcacacagagtattagtgacacagctagtatctaggctcaaggctgtgggactacagtccagaattcattgctgtgtaatttgttggttgcctccataaatccagccccatcaaatgtcaaagaaaagccatgaaaaagaaaaatcaaccaataatttatacaaacgtatttaaggctggggtgtggaatgtaaaccctaaactctcagccacatttggcatcccacttaccctgttgttttgttactgatcaaatggtaataacacatattcaaatgttactgactctggatcaactcaacaaaaaccattaagtcttttatataagcaaattaagcagacagagttatgagtagaacttttcccattttttaaatgtcactcaatcaccatcctcagaacaatcataattaccttaaaaaaaatgatttcacctttgtagagtgaacagactttatgtatagctgtcctctctctgccaagcacaactgagggtagaaacatggtgacattgaggcagtgtgcaacctgtgataagatcagtctgaacaggactgttcaggactgaacaaggtttccttcccatatttaagatggccttgccaagaatttgtgacttatctttagcaacatttgtcactgcctgtgggagacactagggagagctgttcacaactattactctaagtggaccctgaaggagcaattaaattaagtgcttctttactggggacttgcctgtcattggggttcacagaaaggccaattcagatttctaatccaaatgtgtagaaaagggtgtgggcccaagtgggggaggagggacagcaggacacattctctgtcccagctcacagaatctgggtcagggcagacccaggctcaggtgctcagaacgtgtccacacctggggactggagaaagactgtcaggcaggcaagtagcatttctggactgctatccatggaaggcgaggcatggagcaaatgtttccatgcttctctgtataaaccactctttctaacagagctggcctctccctgtccctcataaacagcttggatcttatttatccctgcttgatctcatttcatccaaatcccacccagatctaactctatctcccctaccaaaccttccctgactccctggaaggaaaggaccactctgtctgctgagtctctgtcccattcaggggttctccaccaggctctggaggcaataacatgggcttcagagtctttccagacctggggtaaaatctctgaaagttactggtcatgtgactttgggtgactgcgcttaacctctccaggactcatttataataatgaaaagccttatcgccttatcacagtacctaatacaggaaaggggattggcaatattttatttcccttctcccaattcaggatgtacgtagatgtatgttttttcttccatattagttagcaagcagagagctgactaaatatcgatgggtttactattaaaacgcacttcaaacagttctaattttactaagcagcactaaactaaacagttcattaatggctttgagactttactctgtttcttaaatagctgcagaaacttgtataagtccgtagtctctctgaatcccaatttttcaatatatagaatgggaataattatacctaccttcagaatttttgcggggactaaataagatgacgtacatgaatccattttagaaaccatgttagttgtcattatgaatgggtcatctatagaaataattattccaaaaaattctgccttggcagtattaagcccaagcagattacctttatttcaacaaaataaaagatccatgaacaaggaattcccttcctgtgatgttaataatatgctaccattcaggaataaatgtgtgttaggttaaaagctaaactgttaacatgaagagacctaaatatatagtggcttcattttttctcttttgctcaacaatctgaagatatacataagttgtggggtagcttccagactgatggggcagtcttgctccactaagtcattaaaggatttaggttcctctcaaatcaatgattcttgatctcctacgtgatgattctctttaccataaaagttgccataacctctacattttagttgtaaaaagggacaatatagaaagctcaaataatacaatttattttaagcaagtgaggcagatattgtgcacataacttctgctcatattttacaggcaaaagtttagttacattgcttcacctagctgccagggaagctgggaaatgtggtcaagctggaaagatacatgtacaggaaaaagggagaatggatttttggaaaaaaactaataattgccacaaatatgcaagagaactagagataaggaacttaggaataaaagactggaagtaagaatgaattgtatatgttactcccgagaactgagattcgaggaagaaaaaaaggatgattatatacttacacaagaaagagggcggaagtgaaaagaagagggtgaaagaggtaaacaggcaatgaacagtattaaaagttaaaagagaaaatcaaggacatgaattaaagagttataatatccttacaaggtatccagaaagagtcaaaagtggtggaaccctgaaaaattatgcagaaccccaaaagttcccatttgatggagaaaaatgctttgtagagttgtggaatgactgactgaaagagagtaggatctgtgctgcgagatgacttgctggccaaggaaatgcttggaaacttggaaaaacttagggatctggagaatgtcatgaggagtcctgcctgggcaataccactgctcaatttttccaggcctatcccctaacctcagcaaggaccagctataaaacaatccttttaaaactttttagttatttctatcacccagccatagccttgggtgcatttcatatttctcaagacattcgccttcaactttcccaacatattatcttgggcttgcatcttacatgattaaaaagagaaataccattgtatcagagctcctcaacttaattacttcccatctcaatctttctacatctttaacttcagtcttggttgagctccaccctctgtgcttgttcttgagaaacaagcaaaagagctaagaaaggcttagagcaaactggtaaacattgttattttcttttaggtatccatattgcgacagggtcttgatataatatccatactaggtataatttgcataccagatattcaaagaagtaggagaatatggccatagtgagaaaaataaaatcaactcagaaatgacaaaaataagagaactagtagagacattaaaatagtagtgatacaaagagaggaacaataaacactggggcctacttgaagttggagggtaggagaagggagaggaacagaaaaacaactattgggtactaggcttagtacctgagtgatgaaataataaacaaactcctgtgacacgagtttacctacataacaaacctgcacatgtacctctgaacctaaggtaaaagttgtaataaaataaaatagttgtcataactatatttcatatgctcaagaagctagagaaaagacttagcatatcaaatagagacaaagaagatataaaaagatgaacaatttctagagatgaaaactacaatgtctgaaattaataatacattggatgagattaacagtggattagacattgcaaaaaaattagcaaattagggaaaagtataataaacctgcccaaatgaaatagaagtggaaaaataaacataagaactgtaagtgagctgtaagacaacctcaaatagcctaatatacatataattagaccccataagggcatgagaaatgggagaagaacagaaaaaaatttgaatgaataatggctacaatttttctaaatgtaatgaaaaatataaacctacagacttaataagctcaatgaaccccaagcacaataaatatgaagaaactcacaccaagccacatgatcaaaatcaataataaaaataaaatcttaaaaacaggcagagtaaaaaggcacattaagtacaaagacacaaagataagaattacagcagagtttctatacaatcagtacaagcaagaagacagtagagaaacactaaacagtactgaaagaaaaaaactgtcaatgtagaattttacactcactaaaaataccttctgaaaatgaagaaaaaacatttcacaaatataaaagttaaaggaattcatcatcagaagatatgaacaaaaaaaaaatgttaaagaaaacccagagactcacagtgagacacactataatcaaactctcaaaagtcaaagacaaagagacaatcttgaaagcagcaaaagaaagtaacttgtcatgtaaaaggaagcctttataaaattatcagtggatttatcaacagaaaccttgcaggccagaaggcagggggataatatattcaaagagctgaaagaaaagaaaatttcaaccaaaaatattatatccagcaaaaccatccttcaaacataaaggaaaaatcagcctttccaggatgaacaaaaactggggagttcattaccactggacctgctgtagtatcttgcaagttgaaacaaaaggatgctaaatagtaacatgaagtcttatgaaaatataaagctctccagtaaagataaatatatggacatatatagagactgtactatgcagttttggtacataaatgcacttttaattcttgtatagaatttacaagacaaaagcttaaaaataactataaaactgtgttaatgaatacattacatatgaagatgtaacttgtgacataagtaacctaaggtgagggtaggagctttgaagaaatagtttttgtacacagtcgaagttattctcttaacagtttaaaatagcttgttaacactttaagatgttttttataattcttatggtaaccataaaaaaatctatagaatacacacaaaaggaaacaggaagggaatcaaaatgtcaccacaaaaaaaaatcgacaaaacccaaaagaggtcagtaagagaaggaataaaaaacaaaatttacaaaacatacaggaaacaacaaaatggcaagtgtaggtccttccctatcagtaattactttaaatgtaaatggattaaactcctgaatcaaaagatatagactggaaaatggatttgtaaaaaggatccaactttatcctgtcatttaggtctaagaaacaaatatgcttaaaatgaaaaaaaggaaaagtaaatgccatgcaaatggtaaataaaagcaagcagaagtgactatactactatccaacaaaatagacttaaagtcaaaaatagtcacaagacaaaaaaatggatattatataacaaaaagtcaattcagcagaaagatataacaattacaaatatatatacctctaataccagagctcctaaatatctgaagcaaacattgacagatcagagaggaaacataaacagcataataatggtaggcgacttcaattcctcacttacaataatggctagaacaacaagacagaaaatcgataaggaaatacagtacttgaacaacactataaatagtgctaacaaacatgtgcagaacattccacccaataaaatcagaatagtatttttctcaagtttacatggaatattcccaaagataaatcacatgttataccacaaaaaaacttgtaacaaattttaaaagattgaaattatacaaaatatctattttgatgaaaatgacataaaactagacatcagtagcagaaggaaaacaaaaaattcacaaatatgtgaaaattaaacaacacagttttcaacaagcaatgggtcaaaaaagaaatcacaagggaagttagaaaatatcttgagataaaggaaaataaaaatacaatgtaccaaaatgtgtaagatgcagcagaagcagtgctaacagagaattttatagctataaatatgtgcattataaaaggaagaaagtggctaggcatggtgggtcatgcctgcaatcccagcactttgacaggctgagggaggagaacttctggaggccaggaatttgagaccagcctgggcaacaaagcaagaccccatctccacaacttaagaaaaaaaaaaaaagaagtagaagaaagtttgcaaatcaacaacctaactttatacctcaggaaactaggagagaaaaaaaactacacccaaagctagcagaaggaggaaaatcctaaagattagattaaatcagagataaatgaaatatagaatataaaaacaatagaaaaaaatcaacaaaactaagaggtggtttttgaaaacaccaacaaaattaacaaatgcttagctagattaactaaggaaaaaagattcaactaataaatcagaaataaaaaagagaacattagaacccatgccatagaaatcaaaaggattataagaaaataccatcaacagttaattatatgtcaacaaattggataatttagaagtgcataaatttctagaaatatacaacctaataagagtgaatcatgaagaagtagaaaaaacgaacagacttataactacgaaggagattaaactggttcaaaaacctccaaacaaacaacagcccagaaccggatgactaccaaacatttaaggaagaattagaaccaatgtttctcaaagtcatttacaaaaatgaatataaaaaacacttcaaagctcattatatgaggccagtattaccctgatttcaaagtcaaacaaagacattacatgaaaagaaaactacagaccaatatttgtgatgatcaggttggctttattcctggaatgcaagaatgatagaacatgtggcagggtgtgctggctcatgcctgtaatcccagcactttgggaggctgagacaggagaatcccttgaacccaggaggcaaatgttgcagtgagctgaggtcatgccactgcactccagccagaatgacagaatgagatttcatctcaaaaaaaaagaataatacaacatgcaaaaatcaatgtaatacactatagtaatagaataaaggacaaaacagcatgatcatttatattgatgtagaaaaaatgtttaacaaaatttaacaccttttatcacgaaaacactcagcaaactaggaatagaaggaaaataacataataaaggccatatatgaaaaatccacaggtaaacttacactcaatggtaaaagattcaaacttttcttctggattaggaacaagacaagtatactctgtctcttcgcttctattcaatatagt

SEQ ID NO: 2131 - DNA, 78004 bp, Homo sapiens
agcataggaatcatgctttaattgccatttagcatccactaattcccatgagatctgtgattaaaaaaaaagcctctggcctgcttgtcctgtcttaaaagtcatgagtctgttttatgaacagaaagaatgccacgcttcttagcatatgtaaggcaaaatggatttttgatctctcatgatgtaaaggagatacaaaggtaaggaagggaagatttctaagtgagactttttttgagtgtcaatcccgctggacacacatattacaaaataaagattttcttctgtaaagtgctgtttgctcagtgaatcatgcgccaccacagagcaccatggctccacctgctcaagagcatggaggaggcagcatcggcagagggcaggcaggagtctgtgtttgggggtctgtttcaataccatctcctggggttcgccgtgatgcagagggaatcttctcgtcatggctagacactccccaatgctctgctccaggctggggaccactgcaagctggaggcggctgggtatcagggcctgggcacccctgctcctcctcttcccttgggattggcattttattctctcattcagctcaagaccatgggcaggaactctgctggctccccatgatgtcatcatggggtcttccactttcccacagagctgccaggcagaggcaggacccaggcatgcctggcccacaggaaggttttctaggagactaaggagggtttagaaaaagagaagccactataaatagtcacctgtccagtctatgctattaaaggacataagaaaggtatacaattggcagtaaacaatttccttcagctcttcatggatgtccaggaaaatgacaacccgcacacaatcagacgtgaatgatttctgctccagtgtcttcaggctctgtgcaacaagaagagtttgtgtcggaatgacagattccatatccatgtttattttcaaagttgggctctgttagtggagatttttcaaaaatattctttttgcttgtttctggacagttttgaacatagatcactctattataggccttgagtctcttccacaattgcacatacactttacactgaacatacataaaaagaagtcctccggtgaagccgatggccacaaccaccaatttagtccaaaagggccattctaggattcctggaagggaaaaactcagcctattagattttatttaagatatgaagtaaagaaaaacacaacttctgaacttcccataatcaactgattctttgttgttgttgttgttttttaagagatggagtcttgctatgttgcccaggctggagtgcagtggctattcacaggtgtgatcatggcacactacagccttgaactcctgagcctcagcaatcctccatccctcagcctcaagtatctggggaccacaagcctgcaccactgaccaatggattcacaactcatccaatgttgctcagtcaaagaagagtggaagacagtgtccagctacttcctgcttttataggatgtagtttgcggagattctcatgctccagaatatgaactctcctgactgggtttcaaaaactaccaccacagcaaaagaaatgccaaaaaggaggctagtgcctcctaactgatgtccctcctccggaaacccagacgtttttggctaactggaaaatcctctgaccccaggactcctgtgagctatcccggcccccatgctgagcttgctccagcctgagaactcacctgttgcctgcccctgcttgatctcctcagcagtacggtcaatgagcacatacaaggaccagaccacacatgtgatggcaatgacgtggaatgtcactgagcacatgatcttcctgcgctcgctggacgtcatctgcaacttctcccactagaaagacaacacagagtgtgaggctcaggcttctggggaagggctccggtggggtgagagcattgtaggtaggtaagattggctttccaccccacttctcccttcccaaactagatgcattcccccaagtattgttctcctaaaaccacttggcttcaaccaggtaccaggtgcagccaactttctatgcaatgaaaagaagccaggatcaagatgaatgcagaactaccatcaaaaatccccttgtctgcttattcttgcaagcagacataagatggcctgataaagaattctatgatttcagtcctaatgaaaacagtatgttggcccaggacccaggtactacgttttaagtctccctgatgtgctgactggcatggacgagcggaagaagagggttgatgatgccacaacacactagcagatgggtcacactacattgtgaaggtgaatggcagaagacgctcactctttggtccttgctactttggcagcaacagctcgaaatcgacgctaagagttcctggtacaagcagactctgctagtcccatctcctctaggagctcattaatttactccaaatagccagactttctttttcatttactggtttccgaatcaggagaaaacacataaaggtagagagaaagaacaatgtgtaaacactctgcacatatcctttgccaaccctagtcacagcctctttccagatgagtctatgcagggtagttgaaaatagagcctcaaggacttcccatgttgagagattagcatagagtaggcacccaataaattacaaggtttctactgggcaaaacatttttttaagcagtttgcacaagccttctctaaatctggttgttttctgctgggattttatacactagcaagttccctggtcttcctacctataatacagagtcagtgcctcagtgccccatgctccctgctacttcctacaacgcacgtagcttgacaccctgtcaatgttcaccttcacctttctagggtatgctttactccacagacagcctgacctctctaaactccttgcactctgcctccaaatcctagtgatccttcaagaactgctctaaaacccaaacaccctatgaggctaccatcgctccacttccccagcactctagctcataatgagcatttccttttctgaatgactgttatgctctaccagcacaccatttagcatttaattggctagtatttgattatgtgacttatcttgcaatttatatattaatgttctgagataggaacagttttttattcttccagacaaaaccttttgtgctgggcatctagagagatatatgaaacagtcaaaatttaaacaggaagccagtgtggcggacaaagctcctctcagagggagcagtgacatgggcctccagacagctgcgtgtcatgcaatgcctgtgggtcctttctgaagacagttgcacatcacgcaacgtttgtgcttcctttcttttccctatccacctactcacactcccatccagcaaatagttatcatgggtgtatacaaataaatttactgtatgctacactgtgctgggtgctggggagatactaatctccaacagacagtcctaatcagagaagcaggacgtcaacagttaatatgtataaaattaggtgctaagatatgtcacaaacagtctgtagtcaaaggccagaggactgacaccgacaagcaagcagtcttactttgaagggaaaagaaggattatgaatggtcagaaagagcttcttcctgagaagagggacttgaaaatcagcaccagaaacaacaatctctacaatgcaaatgtaagcaccagccccagctttttaaggaaatgaacgcaggcaagccatgacctcatgatctgagacaccagctttctgggggtcactggtttcaggaagggtgaagcatcccttcctcccacgtacttttctcagtggcttcagcttggtctccatgatgaactcatacttgcagagctcgcagcagcgcgtgtcggagctcttgatccactgctgcaggcaggcctggtgcacgaagtggaggcttcctgtgcagtggcagggggtgatcagggggctctcatcatctccttcacagtggcagatcctatggtggaaggaaaacctgtcattccaaggacagtcccatgacagggaagctgacacttcagtggcaggttaatccccccaaaggaaactcagaaacgaacattacagaagtgactatgggcacaaaaacatacaaacacaaacgaaaacaatcactacaaactaaaaatgtctagcttaccgcaccaacatggaaagtctggagggcatttggcaacagaaaggaaaaaacgatgtaagaaatgacaaagctgtcattttttggtaagaaataagaacttcactgaaagatgaatttaaagcaacatggaatcattttccagaacataagatggtaaaataattagagggaaaatttctatgtaaaacaaaacctgcattccaacatccaaaaataccagtgaccttaaatgacgtttgctttttagctataatcactgactttaccttcataccccacaactacacatttctgtcgtctctcagcaagtaaacaaagatgacagtacctctctcctagacctaaaaaactcaccattacaagatgctgcaatttcatctctttttcttgggaccactaatagcaataagtgagaaattaatttgaaagcactctctatttccaaggaagtatgcaacaaggtgtagctactagcctgaaggaacttaacaggcttttaagaaacagaggggtcttttccagcagctagagaacaggttggggcactcgtcctggaaggagccaggctctcaggctgttttagtgaggggatctctgatccaaatgttagaaatgatgacagctggcactaaggagcggagactggagaaaggtcagaatgaggagggcacaagagtcatgacaaaaagtgaattatggaggccagacaaggatgctgcacaagggaagataaaggggggaaacagagttaggatgggacataggtggctacacctcagttaaaaagaaggaaggaaggagctactggagaacagccagtccccacacaccttttgggggtaggtagggagcaagggttaaaaaagaggctgggagatgcaacaatgcttaaaatctggaccatcaggctggaaaactgaagatactagtttctttcttccagtttctttatgcaaagtctacttatttttagtttagaagagtcagcttggcctttaatatgtgtagcttcttcctctttttttttttgttttgttttgtttttttttagacagagtttcactcttgttgcccaggctggagtgcaatggcgcaatcttggctcactgcaacctccgcctcccgggttcaagcaattctcctgcctcagcctcctgagtagctgggattacaggcgcccgccaccacgcccggctaatttttgtatttttagtagagacggggtttcgccacgttggccaagctggtctcaaactcctgacctcaggtgatccacccgcctcagcctcccaaagtgctgggattacaggcgtgagccactgcgcccagccagcttcttcctcttttatcatttgtaaaactatcttgggactcacatcataaaaattaagtttttcaaacgatattgatactccattcttctggagaaaaccatcaacccacaactggttacaacttcctattacttcattttcctgaaacttcacatactaaagcaagaggaggttcctgatgcgagcagagatggctagaatggcacttcctggcaaaccaacctgcagacatcccctgacgtggacacgggagatatggggggtaatttttcagagaagggagaaggacaatccaggtcgctgtccttttccgtggagcagaggggcgcccgcagaaccctactcttcagttttgcagatgtgctgtcctcaaagacatcgtcgtctcccatctcgtcagagcagaagcccatactccctgccagcccgctggaggacttggcagtgtgcaggcgagcagcgcagctctccagctcatggaacctgtgcaggctgctggcgctcaagccgtgcgagagtgagaacaggtactggagcagttgccggcttcgggacgtggcctcaccatccgccttctcttccagcagcaggccgggcctgccccccttgccagcttccacctctgaggcagttgagcgaccggcagaaaggcatgaaacacaagaatgtttggaattgccaagaggtttgtggttcagggttcttttttctttatgatgaaacctgttagttctgagacacgtatcttgagggagtattaatttcccttcagaacaagttctttccacataggcaaaactttctgaagtatcctgcgccttctcacccacatcattgagggaccttgagaactttagtgttcttctggctttggtattcttagcaggcttcaaggcctgggcccattctgaaccaaaggaatttctctttgacgcctgtaatgtgtccttacagataactgtcacagtgagcccttgtgtcagagaactctggcagtgaggagctttcgagacaacagcagactgcacggaactgtggtgacaacactcagaaaacactgcactggaactgcatgcagaacagtgggataaaagcacagaaagtaaaaacaattttaaaagagaatagacatcatagtgaagaaatgagactagcatgggtaacttggtgagcaaaccacacataaaactcgccaactgtttagaccaaaggcagattgattaagcaaatggaaattcaagaacctacagacactaatgcttatttctggctgcacactgatcatggcagcatctgaagcagagtgttacctgcagatgtcctggctggatggcgtgatagaagtgcgagagaaggaggacaccggagccggagctgatgctgacggaggactcccagcctgcaatgacagacctgtggtcagtgttcaggtaagagccaaggggattgtgtgcactgtctcctgaatggtgacagggagaaaccctagaaatgtctgctgcttcccgctgctcaacgagtaacacatattagatccttctaagccttggcaaaacaaatcaaatatcactatttttttcttatctgtggataaaagtgtaagaaatgtctaaggctatggaacaccactactaatctcttgcaggtccagtggccgtttattttctaagcatctaaattgagttagttcatatataagtcaaaaaacgaagtactagaaggtatcatacaaatgccaaagaaatatgaggctccaggcctgctggcactggcttccctagcactctctcctagttcccaagatcaacaaggctggtagatttaagagctctctcccacctcacaacctcatacatagtgccagatgctccctgagttccacaaaacctcactgccctgccacagctcttcacacaaaagggagtccagaccacgtcaccatgggggacaccaatccatagctcaaccaggggctgaggtagagcacagaatgctcccaacagatctaatcttgaaactgtaaattaagaaaaataatcaagaaaatttagatttgaaagaaagtacagcaagaggtcatgggatagaacagagtctctggggtggtgaatagtcaaacttagagaaaaaaatctaggaaggagaggaagcactgcagtgaggagagaaatggacagagagaaatagggacagtgagtggcactgagctgaggatgcaccaccaccgctagagggccccagactcccacgccagcctcggattccccaggctccacagccccacagacctatgcgtattcataaaaaagcattcttccctccttaagacagtaagcctgagtaagaatctgctccatgcaaccccaacagccccaggaaaacagtgccacgagtctgttatcaccagaaaggccatatcaccacccaccttctgcaggcccacctgcatggcccttggccctaactccttgatacaaaggagctccaccctggcccaccattccctggctgaggcctagtccccactctttctaagtaccatccccaagggtgcactctcatcctggaactccacctttgggacccccgacccttggtcaaccaccagaacagataaggccattgcctggaaactcctcctccccctacccctcacagcaaatgaagcagcctggagagagccaggatggcactcggattaaggcacccatcgcatggctgctcccactcccagtgcagagattcaacagcactttaatgcaagtccacctgaagaaacaagatccaagaagctctcatcagcatgcttcatgtgtacactgagatcacgctgtgccactccatgagcacatcttcgaattcaccaaagaatctacatttattttctaactgaatgtgcatatgggcatgaggtacacggtctttaaaagcattagaggtcaaagttcttaggaatcttaagtttacttggacacatgaaaatagcatccttgaaataaccctcccatcactacctttgtcaatattcttcctgaaacaaaatgaaagacatctagggatgcctgtggacactatgctgtgacatcccttgcatcttctaggcctgactgcataagccattgtcctttttctccaactgccttagacactgtcccctctccagcatcctcctctcggggcacccatcactggctccacctgccccagagacaagcactcaaggccttttagtacaatgggctttactgtttataccacaggggagcagattgagagggtatccatgctaaggtccccaaactcctacagtccccctgttctctgacatttagtcctaacactattctgggactgaaagccttcctgtacttattgctctcttcttttatttctgaggatgaccagctctgttcaacacacataggcaaggctaaaatgtgtcatgaagaccaaagcctgatcacggtgtattgcagagaagtaagcgtcttcatcacctgtccccaggtagactttgaggaagaaatacccagcaatatccacatgcttgcccctcattgctatgaggtcacttcttcctctgtgttgctgggtcaagcatactccctggaactgatgaggcattgaaggaagcccccttccttcaagggatggcagcagaggaaagtacctagtcaccctcctcccttttatcttagtaagagcatggtcctcttggaaccacgtgtactttcctgtattctgaagggaaggcaaaccctgttgggaggaggtaaggtcttatctggaaaatcgtgcccaatcaaggtcagtgtcctgggtccgggaggcaggtttctgatgggaaattaaagttctgaactccagtactaaactacaagtaatccaagtcaaaaagtgtactctggggtaacgattccatccttgcatgcccatgatgaggagcaaggcctgaaggtaggagggcagagcctcgtaacaaaacaaagcctggatcaaggaagcagccacaccaggcacacacacacgtcaggacatgtgttcacttccctgtgtggttccccatgtgtgtgcacttgtagcagatgtcaaggccagcatgacagtgacagcggacccaaggaggaagggagttctggcagggctggggagattctgccctgctcagttttacttaggaaataggaaacagcgttggcatcctctgcctacatttctgctctcatttcaccatttccaatcttatgaaaacattacaggatactctcagcaggtatgtccgatcctcatcaagcctcccaatgacagagaaagagtctctcttcttattagatcacagaatttaaagaaaaattttaaaatctacttattgttattttacataaatataaacttcaacaaatgctaactcttccaataaaagcaagaaaaccagtgagatctgtggggtcttcacagctcccagaagaggctccttctgtcacgatctaaaggacagcaaacatttcaaaggtcagaaccaatccataggcagaatggtcaagaaaataattttaaagagctttatttgttgctgctatagacctgagagaaatctatcaaccaacaaagacctaaaagactggcctgatcaacaacaaaatgaagctgacagcttcaaataatggttccatggtcagattctggaagccagtgtaatcaaaggccagcaatcccctcttaggagctctgcaggacagaaccttactagatgggacaggacctcactagatgggacaggaccagccgtcctgctctttctgaaagcagcaggcagtgtggcacgtgtgagccgggggcagtactagctccagagaacacctacactctcctctccataggatcagaccacacacgactcgacaattactaataaaagtgcaaatgttcatcatgcaaaaatccaaatgtgtcaagaaaacttaggccctctgttcctgaagttctttgcgggttgccaaatgacagactctccagtcatgaaaaggaatataaagcaatctcactacaaaaaaaaaaattcttgtaaaaatcctcccttcttcagatgttgtaattaattatgccaaaacaaacctctggatttctatccaagcctaaatcccagtttattttatttcttagaaatgataaatactttttgacaatttgttttgctacatccaagtcttttagtggctggctttgttatcaaattcaccattttaaatgattttaacaaggttgccaaagaacatacggggaaaaaaaacttttccatatatccttggcagaaactggcattccccttttctcagttcccttctgagagtgcctgctgtcgctggagcagctatagcagtgtgtttacccagttgatagtgcacacatccttctcactgcaggacaccagcgcaccttccttggcctctggcgccttctgccaggttactgcccagcctcctctattacccacgcccctcattttctgtgcaacccccaactgggcctccttttcactcatcagctaagctacttttaaacatttgggtctcaggcccctaacaaaagcaaatttgcccatctgatttatttcaaaagggagagggccacaggaatgatctgtttgagtgagcttgtttttaggcaaggaggaacgtgaagacaggctggataaggatggttaagaggccagaagagctcatgtttacaactcatcacaaattacagtactgcaaatcaatgacttaacagaaacaatgggaaaagatgcacagatggctctcaaaacatgaaaagatgcttcatttctctcacaatgagaaatacaaattaaaactacaatgagataccattatcagccaagaaaattaatcaaataatatgtgttggcggaagtgttgggaagcaggtatgcttatacattgctggtgggagagcaaatggtaaacctccacaggatgacaactgccctcaggatgacaaaggcacatatactttgtctcagcaattcttttaggaattcatcctcacacacctgcgggaagaggtttgtacactgcactagtttgtgacagcaaacggctggaatcaccctaaatgcccatcaccttggagctgaggcaacactgttccatctacagaaagaaatatcagcaatcattaaaaaaatgggaaaagttctcattatgtccagtaatgaacacacaaagtgaaacaagcagagagaggcaccactgccatctgtgctggtgctgcacagactactcaggagggagaccagggaacctggatggagggacatggacttgtcacagagacccacaaaaccataatgccactttacactgagcaacatttcccaaacagaaattcattcttaaaataacaggtgattgatgattttaaaaagtaaaacaaaactgcagaagcacaaccaactgcaacaactttccgactttgggatgacaggtaaagaaatcaatgtagtgggtgatgacctatgtttttaaaagtacaataaaatagaatatgtcagaatgtatctgacataaaaaggataaagtcttttgaggtaattttgtctctcagatgtgtatgcaaaagtgaactgggtttcaatataaaagctacttctggccaggcgcggtggctcacgcctgtaatcccagcactttggggggccgaggcgggcggatcacgaggtcaggagatcgagaccatcctggctaacacggtgaaaccccgtctctactaaaaatacaaaaaattagccaggcgtggtggcgggcgcctgtagtcccagctactcgggaggctgaggcaggtgaatggcgtgaacccgggaggcggagcttgcagtgagccgagatcgcgccactgcactccagcctgggcgacagagtgagactccgtctcaaaaaaaaaaaaaaaaaaaaaaaaaaaaagctacttcttactttggatcatggtcaaagtcacttgaaagtcactgcctgactgtatttctacaaagaaaataaaaattatcaaaaaaaaataaaagaagaagatggctaaatcaagagttcatgttggctgttggcccagaggctctagaagcaaatggctcttacagatctctagaaagaaggttttcctctacatggaaagcatttgccacccatataagaggtgtgttgctatgtaaacaaaacttagtggcttaaaactacacaaatgtatcacttcacagttcccacagactaggagtctacatgcgcatgctgagactctctgctctggtcagtctccctccttcctggaggcctggggaggactgcgtttacacattctctcaggttgttggcagaacacagctccctaaagcttgaggactgagggcccgtctgctggctgactccacctggggcaggccacatgcatctgcagtcacatgaccccttcccatcttcaaagcccacttgcggtatcaatctctctgacttccctttctgccaccagtcagagaacgttctctgctttttaagcacttgtgggattccattgggcctgtatttataaccccaaataatctcccttattttaaggtcaactgtgccacacaacacaacatgatcataggagtaataatagcaatgcattcccaggttccaggcaattgtggggacatttttgggggccgttttagaaatcttgctcaccagatcacttttttatttgtgcttcctgctcatgagattgctagcggttactgccctcccacttccaaactaagagatagggatctgctcctaacggtcaactcggcaggcctgacttcataccacagagccagataaactcacttggtgtttacatattgcaatgtgcagactgagattacatcttgacaaactttctgcttagcacagaagttactctgtcaaaccaatgcttcattatgagtaactctgctttcgataaatacccagttgtattcaacttcaaaaatgagccacaattaaaagaaaagaggccattctgtggcttttctgtggcttgctctgataaatacatgttgactcttatgaagggctgtgccaagaacaagctttcacaaaggcaattaattaaaactgaccattaaaaaagtaagtatatacaatatacttacagagaagcatgtacaattaaaaactactgaatgctaaaatgatatccattataaatgactctcattagcattgcttacgccaagtagcactaacatggaattcttttctacagtggccttttaaagggagtcggaattacttgagtagcaataaatccccagaacaatgaggggaatatattacagcactggtggaggggacagaaggccacagctgaagggactttttcaggactgtcttcctccatgctgcagctgaggatcttgcaaatataatttgttttcaataaattacattgaagacaatgatttctgagcaaaggtggcttcacagtcccagaaactaaagatgtaaccatataaaaatccaaaatcaccagaaataacacggtgaaaggggctgtgtttgtgagttacttatcactcacaaggaccctttaatactgttgatttcctttaaatattgaacttttcaaatatagtcgaaatacattttcattgccaagaggcaataaaatatttcctctgagagaattctggggcagtggccaaagcactggcttttgaccccaaagtcttccctctgtgttctggggccagtccactgagcacactaccgagcaggagtttaatcatttaaaaaatgaggtcaacaatctacagggctgctactaggatcaaataaagtcaagggagatgcagaaatgcagcacacaccactccaggcacacctccagtgtggaacaagacttccgtgtgactaccactcttgattcttgatgacctagagagtaaacctgcaggtctcatatctgctacaaaatgcctcattccaaccaaggtaaccaccgtccacccacctgggaagaaaacagcttctgctcaggctactcatctggccagccctggcccaagatgcacagaactctaagagcgaaccctgagccgcggagtatactactgacagaaacatggcaggcaggaaaaatgaccctcacttcctctaggcctaggccctcctttcccggcaactggtggcctttcccacccctcctcctcctcccaggaacactcccacattccaacccagcatgatggcccctcctcctttctgaggagaaagggcttttcatccctgttatcatatccttgtaccctattcatttctttcactgcacctatcaaggtttataagaagatgttactgggatatgttaacttagaagctgttgctgattggtctggtacacactaggtgtttagggaacatttgctcaatgaactaaacagctaccctctggggagactgtgcctctacaacagagattctcaaacttgttggccacaggacctccttaaactcttaaaaattactgaggccctcacaaaaagcttttgtttacacgggttccatctctccatctttgctatattagaacatcttaaaacacaggaacatattccaccagctaaggaagatgctatcctgcatgttgcttagcttctggaactccgctgtatacttgtggaagaatgagagtgaaaaatggaaataatcttggtattattgggaaattgttttaaacctgccccccttccaccttcaggagactgaaccaaacttcagccaaaaactaaactgtaacagtcagatgaaaaaatactgcaaagacagtcggttaaactttgcaaaaggggagctgaacggaaacactgcctcagtgctgtcaggattcgagtgaggctcagtggtgctgaggccacctgatgccatgaaactcctccaattcatcctttgtttttgtcacttaggaataaatatcctgttttgggacagctgttttcttcagaataaattaagaaagcacattttgccttatttgtaacccataagttttgagtaacctgagcgtgtcactggtcaactctgcattcagaaacagaaagaagcaaaccctggtcttgacaatcacatccaggtctgccctcgcgtaataaaagtgggtcagcaagaattccttgtaaggaatgtccctctgatacgtgacattctgctgtatctcatccctgtctaatggcaacaataaccggaaaatattcaggaggcctaggagggttagtgctcaaattcattgagatgtgcttgccaagcaatagagcaatcattgtaattgctcattaaacatgtccagtctgattctacccaggaatatttgattaacaagaggtacatatcacagtctgcaaggccccagccttgggcaactgccagagcctacagagccaggctggctagggggctggcagagagatactcgtgctacgggcttccactgccttctccctggggtaagtgctgccaatcatgaacttgctcaagaaattgtgtcacctggaccaagtttgattcccagggttgaatgagaaggcttccctggggataaaataacattgtgtctatgtactgccctttttgcaccacaatcttcctctgagaggcatcaagagaggctccaaaaagtccagcccctatgattagcctagcctaggccaattcctggtattaaagaaattccagctgaatagagtgggtttaagcctcctctgcgaatttcaatcagcctctataggattttaggccaaagtactcacatgaacagccacagtcaacacaatcttgtggttacagccacctgcaatagggtgccatgagagccatcacccccagccactgaagatgcctttcattgtccatctaaagtactggactttccaagcaggtgacaaatgatctttctactacagtttaacctcatcctggttggctcctttccacctctcacatctgctttacatgtctctcctgagccacatcttctctgagcagtccttcaacttgggttccctgtaattctctacctaagctccttactgttccctttgtaggaattctctccatccgtggtatcgtatagaggtctgcgtacttccctctgctgtttggttcagcattcaaagcacaatttctggcacacagttaggtgctggacaaaatctcaatgtgtgcaatcctcgtaaactctgcatggcctccttgtctccatgttagagatgagacatattgtcaaatggtaagacagcctgcaggtgggggcagtggtggcacaggacacaacgtcctgaacaggcagtcacctcacgtcacctgagtccaccctgaggccatgcccagtacactgtgcatcgcccctgccagccatactctatggcttcctggtaccccgagacaatggccccttgacaggcagaggctcacagcagagatggaaagttggcttgccccatccccacccctcccttctctctaccacacagcctcctgaatacccatctgtcagagctctatctcacaaagggccatcacaatgagtttaggtgatataatgaagaacatgctttttaatagttatattttcacattaaaaagttaaccaatcaaaatctagaggaggggcttcaagatggctgactagaggcatctggtacttacctcctctacaaagaagaaccaaaatagcgaggaagaatcagactttgaatagatcatctaacagagaacacgaattcaacagagaagtgacagaaaacacctagagcaggcaaggagagggcagtcaggcaaggcagccaagaggttccccagtgtggggaaaggggaagcgagcgatccccagcggtccacattcctaccatgcacttctgcaattccagccatgacagagccctagaccctcacaggccttgaggctaacagagggagctgcctggagatggcgagaaggcattgctccagggagggagctcgtgatgggtcccacacacccctggagtccaaggcagctacaagaagacaccatactgagagcccagtcctcaggagactgcatcctgctgggggcccaacagtccctgcttcttcacatccctggaaccccactgatattcctcaccacagccattgcagcagctagctgctgctgccagggatgaagtgcaaaccatttggcaaagaccctgctgcttccagcagtgaagccactgcacgttttcacaagcgccaaggacaaagtgagcaaagtgtgcactccctagccgctggcatacctattgccactgaaagcaaccccactctccccagtagtagggctgcagtatagccactgctgcctccaccagagcattctgccagggccttggaatcacccagcccctacctaagactgttagagcctgaatgcatccccggggggggctgaagtatgtcctacccagttcctgagtaaaccatcctgaggcctggggactgcgcagcccattccaccactattggaacctgagcatactgcctgggcatctgaggtcaggcccacccaacctgccattaccgccacatctagcactcaattgcgtacacatttgggcctgaagactggttcaaccagcccatcacagccgcaaactgcttgggagccagagggttgtcctgccactgctgctgccatcacccatatcatgcctgctgcccaggagcccaagaattcacccacccacccagttcgccactgccactaccagcgtttgagcaagctacaaggaggtcccccaaaaataacccacctgacctgctaacactggtgccagcatatactgcactgaggcccaagggcaggcatactcaccccactactgccaccactgggaccaaggacaggccaacctggtatccctgtccccagcaaaacctcactacagcctccaccataccctaagatactgaggaaatcacagacaccacaaacatgacttatagccaaagaaatcatacagagactatactactgcacacaatgagaatcaaagctaaagtgccctgcacaaccaacaccatagacacaccctcaggaaaaactcctctcctacaacagcaaattaagaaaactagaagagactgttacaccagacgtgcagagattaacataaggacacaagaaatgaaaaatcaaggaaatatgacacccacaaaggaacccaataattctccagcaataaattccaatcaaaaagaaatttatgaaatcccaaaaaaagaattcaaaataatgatattaaaactcagtgaacactgggcatggtgactctcacctgtaatcccagtactttgggagccccaggcatgaggattgcttgaggctaggagttcgagaccagtctgagcaacatagtgagacctcgtctctataaaaaatacaaataaaaattagctgggcatggtgatgtgtgcctgtaggcccagctactcaggaggctgaggtgggagaattgcttgagcacaggagttggaagctgcagttagctatgatcgcaccactgtactcctgcctgggcaacagaccaagatccggaagctcagtgagatacacaggaatacagacaaacaatacaaagaaatgagaaatgcaattcaggatatgaatgaaacattttccaaaaatacattataaaaaaaaaaacaaacagaaattctggaactgaaaaattcattacatgaaatacaaaatacacttgaaatattcaacaaatagatcaagtagaagaaataatttcagaacttgaagacaggtcttttgaaataatccagtaagacaaaaaaatttaaaaaaggaatagaaaagaaagaacaaagcatacatgacatatgggacaccatgaaatgaccaaatattcaaattttcagtgtctcagaagacaaacagaaaacaaaaaagatggaatatctaacaaaataatagctgcaaacttcccaagtcttgcaaaagatttagacatctagatataagaagctcagagatatccaaatataattcaaggtctcctccacagcacattatatagtcaaacagtcaaaagttgaagcctaaaaatagcaagaaaaaagcatctagtcatttataagtggacccccatcgaaccaacagcagacttgtcagcagaagccttatagaccaggagagaatgggatgatatattcaaagtgctaaaagaaaaaaaaaaggccagccaaagatactatatccatccaagttatcactcataaatgagaagaaataaagtccttcccagacaagcaaaagctgagggaattcaccaccagattggtcctataagaaatgcttaagggaatcctacacatggaagcacaaggacagtatttgccatcatgaaaacataccaaagtataaaacctactggtagagcaagcacacaaataagcaaaaaaaaggactcaaacgttaccactacagaaacccaccaaaccacaattataaacaataagaaagaaggaaacaaaggatatacaaaaccagaaattatttaataaagtgacaggaataagccctcacatatcaatagcaaccctgaatgtaaatgaattaaactttccactggaaagacagagactggctgaatggatttaaaaaaacattactcaactatatgctgtgtacaagaagctcatcgcacctgtacagacacatatagacttaaagtacagggatgaaaaaagatattccatgcaaataaaaaccaaaagcaagcaggactagctatacctatatcagataaaacagactttaagtcaaaaacagtaaaagacaaagagagtcattatataataacaaagggattaattcatcaagaggctataacacttctacatacatctgcaccctacaccagagcactcagatgtataaagcaaatattattaaatctaaagggagagacagacttcagtataataatagctgaggacttcaacaccccactcccatcgttagacagatcatctaggcagaaaatgaacaaacattacatttaaactgcacgttaggacaatggactaaacagacagttacagaacgtttcatccaacaactacagaatacacatttctcagcacacagaccattcttcaggataggccacaggttaggacacaaaacaagtctcaacaaagtttttaaaaattgaaatcatgtcaagtatctttctcagaccacaatgtttaaaactagaaatcaactagaaactgtacaattacatggaaattaaacaacatgctcctcaatgaccactgggtgaaggaagaaattaaggagaaaacataaaaatgccttaaataaaaatcgaaatacaacataccaaaacctgtgggatagagcaaaagtagtgctaacagggaagtccagagcaataaacacctacatcaaaagagtagaaagatttcaaacaaacaatcgaaggatgcacctcaaggatctagaaatccaagtaaaaaccaaatccaaaattagtaaaagaaaagaaataataaacattagaggagaactaaactaaataggagctaaaaaaaaaaaagatcaatgaaacaaaaaattaattttttgaaaaactaaaattgatagactagctagactaaccaagaaaaaaagatagaagacctaaataaaatctgaaatgaaaaaggagacattacaaataacacagaaatacaaaagatcatcagagactattacgaactacatgctatcaaactggaaaacctagaggaaatggatagacacataacctaccatgattgatcagaaagagacagaaaacttggacagatcaataagaagtaatgagatttaaagagtaataaaaagtctcctaacaacgaaaggtccaggattggatgacttcactgccaaattctaccaaactttcaaagaagaacaattcttctctattccaaaaaactgaagaagagagaattctccttaactcattctactagaccagcattatgctgacaccaaaaccagacaaggacacaacaaaaaataaaactacaggccaatatccctgataggcatagatgcaaaaaatccttaacaaaatacgaataaagcaaatccaattgcacatcaaaaagacagtacacgattaagggaatttatccctaggatgcaagggtctttcatcacatgcaaatcaataaatgtgacacatcatgtaaacagaatgaaggataaaaccatatgatcatctcaatagaagcagaaaaggcatttggtaaaattcaacattccttcatgataaaaattctcaacaaactaggcaaagaaagaaatactgcaatattaataaaggctatatatgacaaacccacagctaacataaatctgaatgggggaaaagtgaaagaaagccttccctctaagaactggaacaagataagaatgcccgctgatatgatttggctgtgtccccacccaaatctcatcttcaattgtggctcccataattcccacaggttgtgggagggactcagtgggagataactgaatcataggtgcagtttcccccatactgttcttgtggtagtgaataagtctcatgaaatctcattttgtaagggaagcccctttcacttggttctcatttctcccttgtctgccgccatgtaagtaagatatgcctttcatcttcccccatgattgtgaggcctccccagccatgtggaactgtgagtccattaaacctcttttactttaaaaattatccagtcttgggtatgtctttatcagcagtgtgaaaacagaccaatacagtaaattggtaccagtaagtggggtgctgctataaagatacctgaaaatgtggaagtgactttggatctgggtaacaggcagaggctggaatggtctggagggctcagaagaagacaggaaaatgtgggcaagtttggaacttcctagacatttgttgaatggctttgaccaaaatactgatcatgatatggacaatgaaatccaggctgaggtggtctcagatggagatgagaaacttgttgcaaactggagtaaaggtgactcttgctatgttttagcaaagagactggcagcattttgcccctgatgtgtggaactttgaacttgagggagatgatttatggtatctggaggaaaaaatttctaagcaccaaagcattcaggaagtgacttggatgctgttaaaaacattcagttttaaaaagttttaaaagcattctcagagaaacagaaaataaaagcagaaaatttgtggcctcctgatgccattgaaaagaaaaacccattttctgaggagaaattcaagctgggtgtggaaatttgcctaagtaacgaagagccaaatgttaatcaccaactcaatgggggaaaatgtctcaagggcatgtcagagatctttgctggcagcccctcccatcacaggcccagaggactaggaggaaaaaaaaatggtttcaagggctggtgcccagggcccccttgctgtgtgcagcctagagactccatgccctgcatcccagccactctaaccaaaggatacaagcagccagggtatagttcaggtcatggcttcagagggtgcaagccccaagccttggcagcttccatgtggtgttgagcctgcgggtacacaaatgtcaagaattgagatttgggaacctctgcctagatttcagagaatgtatagaaatgcctggatgttcaggcactggtatgctgcaaggatggagccctcatggagaacctctgctagggcagtgtgaaagggaaatgtgggttgcaagcccccacacagagtccccactggggcactgcctagtggagctgtgagaagagggccaccatcctcccaactccagaatggtgtatctactaacagcttgcaccatgcacctggaaaagctacagacactcaatgacagctcgtgaaagcagccaggaggtgggctataccctgcaaagctacaggggcagagctgccaaaggccgtgggagcccacctcttgcattagcatgacctggatgtgagacatggagtcaaaggagatcactttggagctttaagaatggactgacccattggattgtggacttacatggggcctttagccccttcattttggccagtttctcccatttggaatgagtgtatttatccagtgcctgtgcccccattgtatctagaaactaactaacttgattttgattttacaggctcacaggtggaagggagttgccttgtctgagatgagactttggactgtggacttttgagttaatgctgaaatgcgttaagactttgggggactgttgggaaggcatgggtggttttgaaatgtgaggacatgagatttgggaggggccgagggcggaatgatatggtttggctgtgtccccaccaaatctcattttgaattgtagctcccataattcccatgtgtcgtgggagggacccagtgggggataactgaatcataggggtggtttcccccatactgttcttgtggtagtgaataagtctcatgagatctgatggttttataaggggaaacctctttcgcttggttctcatttctcccttgtctgctgccatgtaagacatgcctttcgccttctgccatcattgtgaggcctccccagccacatggaactgtgagttcattaaacctctttttctttaaaaattacccagtctcaggtatgtgtttatcagcagcatgaaaacagactaatacacccactttcaccactcctgttcaacacagtactggaagtcctagttagagcaatcaggcaagagaaagaaataaaaggcattcaaattggaaaaagtaagttaatttgtccctttttgcagatgatatgattttatacctagaaaaacctaaaggctccattagaaaacttagatctgataaatttggaaaagttataggatacaaaaataaacatacaaaagttgatagtgtttctatacaccaataatgaactagcggagaaagaaatcaaaaaggcaatcccatttacaatagctatacaaaataaaatacctagaaataaatttaatcaaagaggtgaaaggcgttgcaaggaaaactacaaaacactgataaaagaagctgaagaggacacgaacaaattgaaagatatcccacgtccacggatcaaaagaattagtgtcattaaaatgaccatactacccaaagcaatctacagattcaatgcaattgctatcaaaatgtcaatgtcattttacacagaaacagaaaaaacaatcctaaaaccatatggaaccaaaaaagagcacaaatagccaaaacaatcctaagaaaaacaaacaaagctgcagggatcacactgcctgacttcaaaggatattacacaaggctacagaaaccaaaataagcatggtgttgttataaaaacagatacaggccaggagtggtggctcacacctgtaatcccagcactttgggaggccaaggcaggtggatcatctgacatcaggagttcaagaccagcctggccaacttggtgaaaccccatcactactaaaaatacaaaaattagccaggtttggtggtatgcacctgtaatctcagctaatcagggggctgaggcagggagaattgcttgaacccaggaggcagaggttgcagtgagcctagatagtgccactgcactccagcctgggcgacagagcaagactctatctcaaaaaacaaacaaacaacaacaacaaaacaaacccagatacacagaacaatagaacaaaatcaacaacacagaaataaatccacgtacttactgcgaactgattttcaacaaaggtaccaaaaacatgcgttagggaaaggataccctctcaataaatggtgctgggaaaatgagagatccatacgcagatgaatgaaactgaagccctctctctcatcgcatacaaaaatcaactcaagatggactaaacactcaaacataagacctgaaactatataactattagaagaaaacacagggattacacttcaagacattgatctaggcaatgattttatggctaagaccccaaagcataggcaacaaaaccaaaaaccgacaaaagggactatattaaactgaaaagcttctgcacagcataggaaacaatcaacagagtgaagacacaacctgttgaatgacagaaaacatgtgaaaactacccatcgaacaaggaactaacatacagaatatgtaagaaactcaaacaacattaaaaacacaaacaatcccattaaaaagtgggcaaaggacatgactagacatttctcaaaaaaagacatgtaaatgaccgacagctgcatgaaaaactgctcagcatccctaatcatcagggaataacagatgttggtgaggatgcagagaaaagggaactcttatgtattgttggtgggaatgcaaattagtacaaccagtatgaaaaatagtatgggaattcctcaaaaaactaaaaatagaactactatataatccagcaatctcactacagagtatttccccagaggaaaacaaattagtattatcaaagagatatctgtactcccatgtttattgtagcactgttcgcaaaagatatggaatcagcctaagtgtccacatcaatggacaaacaggtaaagaattcgtgacacatatacacaatgaaatactattcagccatacaaaaagaatgaaatcatgtcatctgcagcaacatggatggaggtcattagccagacacagaaagacaaatattacatgttctcactcacatgtgggagctataaaaatttgatctcatggaggtagaaagtagaattataggtactagaggctgggaagggtgtgcatggaggcaggagtgggggataaagagagattggttaatgggtacaaaaatacagttagatagtcacaataagttctaatgttcaataacaacagagtagggtgactacagttaacaatatattatatacttcaaaataactagaagagaggtttaaattgtttctgacacatagacatgataaatattcacagtgagggacaccccaaataccctgacttgatcattacatagtctatgcatgtaacaaaatatcagaggtaccccataaatatgtacaaataaactaaaaaaagaaaaccaatcaaatgtgatttcagatactacacaatgatataaaactttgagtttgttctttagaaaatgattaagcaaacagcagcaagggaagtacatagggtgaggactgagtgtggatggggcatctggggaacatcctccaggatggctcgtgggcccacatggtcaaggaccctgcggtgaggtgaaggtctgggcaagatgcatggcgatttcatgggggctgcattccagtgcccgtctttgtataaagcatgtcacctgtgggactcaaactgcctcaaacttctccaagcacccagtcaattaaacagatttttttccaaggggggacattctgctgcttctaaaaatataagattttctacacactgctatcattacaaactgtgataggtgctatgaagaaagagtaacaaaacccaaatgggtgataaaatttagactaaggggagggtgtcaagggtaagtgcctctaaagaagctaagaactgaaagagaaatgagttaggaattttagccattcatgcaaaaaaggggtaagattgggagaggcctctcggacagaacaaaaggtgcgcaaataggaatttggcttgtttgaaaatcatcaaggtagacaccatacctagatcatcatgaccaaggggatattgcacaggatcaggttccaagtggccaggcccaggtcaccttagatgtgacagctcaaggtagtgtaatcagaaacactgaagaattgaaaagagaagcattaggaattctacttactggctactgggtgctagatggtttgggatagattcttgagaagctactgcaggagtttaggaggcctgggcctgggaagtggctgggatgatgaagagggatgaaccaatgggctgggtatcaagtgtctagcagaacagcatgcaaacattgactcagcatgtactgacaacctccagggctccatcccatcactggttctgcagatttaggggtaaacaaagcatggctctacactcatgaaggttacatgtggggtgaaggtgcaatggaaaaaaattcatgaaaacccaggcagtgataagtgcgatcctgaaaaataaaaggaaaaggtgactttggaccccttaggatgttaattggaggtgacaaatttcatgaaatcccttggtaacagaggctcaacaaatgatatccattaacattgtactatcaatacaaaataagtattgggtgaagactttgccattgtaattgcttaaatatcccaatatgcttcttctattaactccttaaggggatcaaatccagctgcccactttgaagagaggcaagccaccacagacctagcagcctcataaacatctcatccaacctacctgcttccttctttgaaaatggagcctggtttttaaagtcaatatgcttccaatacacactgagacactttgtaataaaatctagatggaatactaggaggcatgattaaaggtttattttttacctcttttcaacctctaaatttacgccagcaagaggtgaactgcagaagcataaagcagactgcagtgactggctcatgtgctgaccccagctggggtctaaaagtcagcagaaagtctcctgacagagacaacggggatttcaggtagcatacagtatgtccacattgtggcctcctttaatctcaagagtatgtctgctatactgaagatacgattttacatgtcacggcctaaaactggcttcaaacagcaggttcatttaataaatactccaataaaaaaactgtcttctcaaaaacagttatcttccacagggggcctgccctcccttccttggtcccactgaactggttcatgtctaaccaccttatacagcatgctaactatcttcgttacaaaagggtacactttgcaacagaatttcacgttgacaggttaaccaggaagttctgtgagtaatcaaatgttctaaaggctcactccactcagatactctccaatgaccatagtaagcatcccggaactcactggacacactaagtgtccagtcgcaaacagcacacagtaaaaatgtattcaagaaggggccgggcacggtggctcacgcctgtaatcctagcactttgggaggccaaggcgggtggatcaggaggtcaggagtttgaggccagcctgatcaacatagtgaaaccctgtctctactaaaaatacaaaaattagctgggcgtggtggcacgcacctgtaatcccagctactcaggaggctgaggcaggagaattgcttaaatccaggaggcggaggttgcagtgagccaagattgcaccacggcactccagcctgggctacggagcgagactctgtctaaaaaaaaatgtatgcaagaaggaaaaaataatgtatggttctccattgttcagcaataaataataaagctaccattaaatgaactgtcctggcccaatcaacctaaggtcaccaggattcaacgaactttgacaagagtcaggtttgttggctcagtgtaatgggtgagctgccccatggttccatgcaaatgttaatcccaagactcggaacaaccctgaaggttgtattattaccctacttttttttttttttttttttttgagacggagttttgctcttgttgcctaagctggagtgcaatggtgtgatcttagctcactgcaacctccgcctcccaggttcaagcgattctcctgcctcagcctcccaagcagctgggactgcaggtgtgcaccaccacgcctggctatttttttggaattttagtaaagatggggtttcatcatgttggccaggctggtctcaaactcctgacctcaggtgatccgcccgcttcagcctcccaaattgctgcgattacaggtgtgagccaccacgcctggcttaccctacttttactgataactaaattaaagctcagagagatgtcctttttcaaaatcacatggctagtaaaccatcatccatgttaattccaaaacccttacaaagctcaaaatacccacaacccaagccaggacaatagcctttcctctagactttttaagatggtggtttgcaaacagttttttttaactataggaagaagtttcctttaaataaaatgtgactgaaatccatgaatgaacaggtacatatttaaagcataggatgtcctccttcagaactgcccttggctactagggcaaggcgacatacatgtgttactgagcgttttttaacacatttaattcaacttaagcaaacaggccatctgcagctgcaccttctcacttttctccgtgcttagacactgattagctcctttaaaaggtgcaaaaatgggcagcaatggtttaccactgcatagttctagcactgcagcattcctggccaaagggacagcaaaagaaaagaaatggaggttggatgggaaaaaatattttgtgaaaggcattcctatttttaacgcaaaattaagcggaagaataatataattagattacaaatatgcctaagaacagacaaatgtcttaagaaggtttgccagagtttacttttagtcttaaaaaaataaggtgacctgaatgaaaacatatatgtagtcagcacattaaaatggcatataatgtaactgttcatttcagagtatctaggaggcctgagacagcagatagactttgtcacttgttcaaatcctcccagctgaatctgtggtgtgtttggccatatgccaaaaacatggggaaaaggtccacccttacaaagaactttcatggccttaactgtatggcgaaggggttggccagagtcaatgtgtgggctgagagaggagcactgcctggaagcaagctcactgcatcagatacactctgctggttcccaggccataccctagcagccagtgtgctcctggtgcgctaaaaagaccacaccacaggtgaggagatgctgttggatggctgattcacttcccaagccctcctttccctagctgccttccagctagaggtggcctgtgatccagttctggccagggagatgtaagcagatttcaggcggccaggtgggacttgtgggacaacttttgccttcctgctgaaaatggtgactctcagctaacagacctgttaatccttgatcagtcctctaattcctgccaaggccacaaccgcaatgcctgaaggtccagctctcatcgtgagaccatgtgtcaagtaggagatagcacagagaggaaagagcctgggtccctggcaacatctgttacagggagccgaagacccatgggacgtgaccaactcagcattcccctggagactatatgatcaaacagcaaaccgttcatcatgaatgcaggatatgagcaaactcacgactgctccggccgactgctcctgccaacagaaggtttgctggaggcaatcactccctggcgccaaggttctctactgcaacatctagaaccttttgttcaaggaatgcagtcttgcaagcctactctagactgagcagctgaccccttcttccacccgccttctcactatctcttttgcctaataaatatggagggctgtgtaaagctcagggcccttgtccactagagccaagatgcctccttcttccaaatatactcttttgtctcttgtcttttattcccgccttcaccccttgttcagttcccctaggtccatgcgggttacacagtggcaccccgaacagccacagaatcgggtgcactacaatctgtgatcaactctgccctggatcacctgcttccagacaccttgtcaaatgaaccatataaatccataattatgtaagtcatcatagttagctttctgttactttcagtcaaatatattcctaattgtggcaacagactctcctgtgcctgagatttcttctgccttaaagtatatggttttctggaaaaaatggaattttctcccagaagtcacttcccccaacacacactcaaaattgccttaccagaaaaatgtaactgccacatacctcttatggtcccagaacagattacagaaatgtatcaagaactctaacgtcttttcaaaaaaaaaaaaaagagtataaacacatgtaaggcataagaacagaaaagactcaaggtaataaataacatttttcagtggcactctaccttagaaatgttgcttgaatgactcatgaaatgtcccaaagtcttctcattctgcaagaaaatcaaacaggttttaattatcaatctttgattaaaatatgcaaagaacaagtaattgatcacaacaaccctactgacaaatcattccctgaactagaatttgcaaagcacaacctactatatactagatgtatgtagccaggcagtaaatattgcacatttgggcaaaatgaatacacaatagtccctgtcctaaaggatttaacattttatttaagagatttaattttttattatcaggaaaaaataagagtttagaattcactgtcaaaataagatggtaataagtgtcttaagtcacatttcacgtgaaagttcagatggtgataagtgtcttaagacacatttcaagtggagaggctgcatgctcagttgtatgtgacacagtccacattatgaggagtcacggcgaaagagtgaagaaagtaggacagctgaccagtcctggggtgtctggctaacaaagtgctgaatactcaatcgggatatcacacagctcacatctccttcaactcagtttctcctcctggagcagggaaatctgggagccatgccagcctccttcctctcatgcccctccacattcagtcacatagtcttgtatcaaattcttcctcctctcaatcacaactcattttcatttttattgacaatgctttagtttagattctcttcatttctcagctagaattcttgaagaataacatcccacctggcctttttgcctttaggttgacctccctgatacacaactatcatgggctaaactgtgtattcccctcccttctgtgaaaatttagatgttgatgtcctaaactccttcttcctcagaatataactatttggaatagggactttaaagatgtaattaagtttacatgaggtcaatagtagtcccggctactcaggaggtgactctaatcctagtggactctaatccaataggattggtgtccttgtaataagaggagtttgtgacacagacacacacagataaaagacaatgtgaacacagagggagaagatggccatctacaagccaaggagaaaccagccctgctgccaccttcatcttggacttccagcctccagactatgagaaaataaatttctgttgtttaagccaccttccgtatggcaatttgttatggcaaccctcaaacaactacgatcatcttccatcctatgactttctttaaaaaaaaaaagtgaacactctaaacataaatctgatttttaaaaataaagtcattttcctgaatctactcattcttgctctaaacccaaatgagtaacaaaaactattgcctaaggaagagaagatcttagttgtatttccttgctctgtcacctaggctgggagtgcagtggcatgatcatggttcatggcagccttgacctcttgggctcaagtgatcctcctgcctcagccttctgaggaattgggactacagggatgtgccaacatgtctgactaaatactttttgtggagacagggatcactctgtcacccaggctagagtgcagtggcacaatcacaatcatgcttcactgaagcctcaacctcctgggttcaagtgatcctcccgcctcagcctcccgagcagctaggactacagacatgtgccaccatgtctgactaagtattttttatagagacagggtcttgctatgctgcccaggctcaactcctggcctcaagtaattctcccatctgagcttctcaaaggactggaattacaggcatgagtcaccatacctgacctgtttcttcatcttaaggcagtcaattagtaaattataaagtatgctcaaagtgttgggagaatgttaccaaagaatgtttctaaaagatcaagtttcactttgggaggctgaggcgggcagattgcctgaggtcagtagtttgagacccgcctgaccaacatggtgaaacaccgtctctactaaaaatacaaaaattagccgggcatggtggcacgtgcctataatcccaactactccggaggctgagggaaggagaatcgcttgaaactgggaggcagaggttgcagtgagctgagatcacaccactgcactgcattccagcctgggcaacagagcaagactccgtatcaacaacaacaaaaaaagaccaagtttaactagcaatttaattcaatcatattattcacacattcattcactgggaatgaaagccctctgtccagagaacaagtaatctgagtttcattcattagtcaagaatgtacttataggtaaacacagggcactgctgtgagtcccaattttaaggccaagctactggtgacttactattaaattttagtgtagtctactaagttcaaacaaagacaccataggccttggattatctgtacagaaagccaattataaccactgctacattacttactacctcacaaggaatggctggtttgacaccatctggaaatctacagagaagttcacaagtactaagagaagccaataaatcatatcctcagacctttttgacattaattattcaacagagaatggatattggggtgagggagaactacctgctaacttaacattataaacccagattgagagctaaagctgttccttaccctttaagaaataaatttgataatgcaagcttttattttgttttcttgttagaacaattcatattttacattggtaaaaccaaacaaataacaagccctagaaaacacaggggttttaaagcctgaaacctgtcaatatttagggttgcttctccactacttggtaggatcttaacagttcagttccagcagaccagatcatcttttattttcccccaataaacactgctctttttcttcttcttcttcttcttctttttttttttcttttttgatacgtagtctcgctctgtcgcccaggctggagtgcactggtgcaatctcggctcactgcacgctccgcctcccaggttcatgccactctcctgcctcagcctcccaagtagctgggactacaggcgcccaccaccatgtccggctcagtttttgtatttttagtagagacggggtttcactgtgttagccaggatggtctcgatctcctgacctcgtgatctgcccgcctcggcctcccaaagtgctgggattacaggcgtgagccactgcgcccagcctaaacactgctctttagatgtccatttatttggacttaaaatatatagtgcaggacaacatcagagatattttccagaaagcaagtcccaaaactcattcaaatcagtcattctttccacacttatttactatgcaactactatgtgtgaacaactgtgtcaggcatagaatatggaccaaaatctcactcctaaccatatgccaatgataatattgagaatcccttatttgaaatgcttgggaccagaactgtttcatatttctgagttttttggactttggaatatttgcattatacttacaggtggagcatcccaaatctgagaattcaaaatctgaaaggtgacaatgagcacttactttgagtgtcatgctgacattccaaagtttcagattttgaagcatgctggatttcgagtttgtggattagggacgctcaacgtgtattaccactgaactcctctgaaaaagtgttttggtgagaaatgtccaaactagggaagagcttaagaatgacataaaagaagcacatacataaagtatatcaaggtggaagtgtgacaccactctgccctgtagtcagaatggcatcttggttctgaatgagaagtaaagtttgccaagcatcaatgtaaagaagtggaattagacataccaaggagaaaaaagttccagttcaagcccaaactaagcttcaatgcccaagtaataaaaaccctggcaaattatttacagctctttaacacattcagtcactgcttactggataccaccaccttgtgaccccaggagagatggaagcctcgctgcatcttccttccttcctcagagaaggtactaagagatgccacacactaccctggctttcatctccacatctctctggtgggctcttttcatctacattcaacatgagagctcctcagaacacagcctcatgccctctagatttcatttgttttctcctttagccagtgcttttccaactctggacacctaatcatttagggatcttgctaaaatgtagattgtggtttgttaggtctaggggggactcagatttctgcatttccaaaaagctcccaggtgactcccatgctgctgtccccagaccacagtttgaggtgcaagttttcattccaaatcttgaaccagaaaaatcaataaagtctatgagttttgtttgtttgtttttaagacagggttttgccatgttgtccaggctggaggacagtagctattcacgagtaccatcatgtcatactacagtctctaattcctgggctcaagtgatcctcccacctcaacctcccaagtagctgagattacaggcatactactgcacccaatttatgactcatgttttaaaaagcaaatcatgaccattttaaaagtaaattcctatgtaaaagatggctgtgagcccacaattgagttaatacaaatcaatcaatcaggaaacacaatggtacagattgggaaagactgagtctgagggtgtgagaaaacaaagttttcttaatgtgagaagctaccagatcacaaagataaagagaagctctgctgaagaataaggcacattttacaatttaatcagtgctgtcaatgatgtttttcacaagtccacatgtggctcccaacagaatgtacttgtgggtagagccaaggcataaaactcacatagaccaaatacaccctggaaagtagaaaccaataattatcaagaagacaacgaggtgagatgcctaagcgagtttttgggattctgtatgaaagagtcaaacaataggacttcatcatgtggggttttcctgaaactctgaccaggactggtccttaaaaaaaaagacaaaatatgtgggcaatgaacaccgctaactacatactcaatacctatctccctttgtccccaccaaaagaaccctgactttgtcctgagcagcaacaaacccagctaaaagttctcacttttccacactactttgcagttaaggaaaactattaaatatataaaaagttcttttgaaagaaattaactaaagatttcctgggaaaacattttgctttcctgatattgccattgcccatttctctggaattcctcctccctcatccagcctggaatatagacgtaataccacgaagtaaagcagttcactttgggactatgaagaagatagttactagaagtctgaaactttttggtctcaggacccctttatcctgtaaaaaatgattaagggccaagcgtggtgactcacacctgtaatcccagcacttgggaggccgaggtgggaggatcacctgaggtcaggagttcgagaccagcctggccaacatggtgaaaccccatctctactagaaatacaaaaattagctgggcgtggtggcacatgcctgtaatgccagctacttgggaggctgaggcaggagaactgcttgaacctgaaaggcagaggttgcagtgagccgagatcgcgcgactgaactccagcctgggcaacaaaagcaaaactccatctcaaaaaaaaaaaaagaaaagaaaaagattaaggactcccaaaacctttggattatgtagggttttatctatgggtatttgcaatattagacattaaaactgacagcgtaaaaactatatctcttaattcatttagcattagtaataaacccagttaacataaataacatttcaatgaagtttaactattttctcaaaaaaaaaaaaattagtgagcagagtggcactcctgtacatttttataaatctcattgtttaatagaagacagctagattcctgcatctgtttatgtattaaatctcttctgatctgatgcttttgtgaggacccattcaaaactcagagttgacataatcatgattttaagctgaagacatctgatattcaatgaatgcaggaagaagccctctccatacttcccttatatgattaaaagcagaaactgtgacaaatgaggctgccataaattccctcttcaacggtttactcccaggaaggagatcaagagtaaacgtaccataattcccctgtctaggaggagttttatggccatgaagaagaggaaaagacactcccatctacacaaacattatcacaagctttcttatctcttaatttgttaggaggggaggggaggggaggggaggggatgctaggggaggggagggagacaggcaggaaggtggggaggggagaaaggaaaggaagaaaagagaaaagagaaaaaagaaaagagaagaagagaagagagaaaagaaaagaaaagaaaggagaaaggaaaagaaaaactaaaagcagcaggaaataaatgactcatcatattctccatggtacatgggaaccacaaaaagattaacagctgacttatcctcagaaaccagggaggccagagacagtggaaggacataaagaactcaaagaaaaaaaatgtgaaccaagataattatattcagcaaaactatcttcaaaaatgaagatgaaaaatacattcatagataaacagaaactcagagaattcattgcaagtggatgcacctgaaaagaaatactaaaggaagttctttgagttgaaagcatgtactgccaaacagtagtcaaaagtaactgtgtaactataagacaatataaatgcatatatattttgcatatatattttcctttcttaaataatttaaaaaggaattatataaaaactatgtttataattgtattgttaaacctataacataaagaaatgtaatgtatttaatagtaatacaagataagtgggtacaaagttgtcatcattatactaatatcagacgaaacagaattcagaaaattttaccagagataaagagggacttctactatgaaaggttggcataaggaaatgatatcacatggaaactctacactgaaacaaatgaagataataaggagtgctaactttaaaataacaaactgtataaacatataatgctctcctttcctttatgtctttaaaagacagttaaataaactaataactgctacaatgtattgttgggtttgtaacataaatagatatgtataaacaataattagtaaagaaatagaggtacataggaggaatcattctatgtcttacaggaattaaatcaatatgaatctgaagaagattctgttagaaaaatatatatatatatagtaaaccctcaaccattaagaaaataattttttaaatagcattagaaatcttttttaaaaatcatttaaggaattaaaatattacaatacaaaataatgcaaaagaaagcaataaaggaagaacacaggaacaaaaatggcaagacacatagaaaacaaaaagtaaaatggcaaacaagcaaaccatatcattaatagcatgaactgcaaatggattaacaaatcaacaggaagggttgtcaggatgtacaataacacaaaatccagttgtattctaagttcaggagatacaattagactcaaaattataaacaggattacagtaaaagaagcaaaaagatacatagcacaaaaacaaccaccataaaaaggggtagtcattatattaatatcagataaaaaagacttaggaaaattttactagagctaaagagggacttttactatgataaggtcaaccatcatgaaggtataataattataaatatataagcacctaatatgaaaaccacaaaatacataaagcaagaactgacagagctgactgaaaaacagataatacttgcagacttcaaaatcctgctttcaacaatgaacagccgagctatgtaaaagacttgaacagcactaaaccaacttgacctaacagacatccacagaatacaaaacccaacaacaacaacagaatatacattcttctcaagtgcacaacaacagactatagagtagtccacaaaacaaacatcagtaaatgtaaaaggactcaaatcatatacagtatgattctggctacaacagagttaaactttagagttaaatgttattgtttatcaacagcagagagaaactaccaaattcacaaatgcggaaattaaacaacaaaatctgaaataaccagtaaatcaaaaaagaactcaccaaaaaaaaactagaaaatttatttgagattcataaaaatgaagtcacaaaataccacacttacacaatgcaactaaaatagtgcttagggggatatttatagctgtaaatgacaagattaaagaaaggtacagagaaaacgcagtcatatgtaagtcagaaagaaaggcctaccagaaaccaaattttctggcaacgtgattttggacttcttgtctccaaaaatgtgagaaattaaatttctgttacttaagccacccagtctgtggtattttgttatggcagcctgaacagactaatacaaacatctactaaaaaactacaggtaacattatacttaatggtgaaagattgaatgcttactccctaaattttaacagcaattctatctgctttcaccatttctttttaacattttaattgtggcaaaatacacacaatgtaaacacaccatcatataaagtatgcataatataaaattcaccatcttaaccattttaagtgtacagttcagtattaagtatattcacattgttgcacaatctacagaactttttcatcttgcaaaaactgaaactctatactcattaaacaattccctatatcttcctacccccgaaatatttttaaaaatttttactttctgtttctatgattctgactactctagatactttatacaagtggaatcataacagtatttttctttttgcgattagctcacttcacttggcataatgtcctcaagattcctccgtgttgtagcatgtgtcagaagcctttttttttttgagaagtctcgctctgtcacccaggctggagtgcagtggcatgatctcggctcactgcaacctctacctcctgggttcaagcaattctcctgactcagcctcccaagtagctgggattacaggtatacaccactacatccagctaatttttgtatttttagtagagatggcatttcaccatgttggccaggctggtctcaaactcctgacctcaggtgatcctccctcctcggcctcccaaagtgctagaataacaggcgtgagccgctgtgcccagccagaatccttttctttttaaaacaaatgtgaaactatatgcaataaatgtaccatattttatttattcattcaccctttgatggacacttgtattgcttccaccctttggcactgtaaataatgttgctatgaacacaggtatacaaatatctctttgagacctggcttttaattctttggggtatatacccagaagtggatttcctgggtcatacagtaataattatcttttactttttaaggaactcctatactgttttccattgtggttgcactattttacattcctattagcagtgcacaatcagcgttccactttgttcggatcctcatcaacacatttttaaaatatatataacagccatccttgatggttgtaaagtggtatctcactgtggttttgatttgcgtttccctaattatcaatgatgttgaccatcttttcatatgcctactagccatttgtatatcctctttggaaaagtgtctattcaagcattttagaatcagattatttgttgctgttgagatgtaggagttctttatatattctagatattatccctttatcagatatatgatttgtaaatatctcccattccctaagtggcctttccaccctgtccactgtttcctttgatgcccagaagttttaaattttgatgtaatctaatttctgtatttttacttctgttgcctttgcttttggtgtcatatccaaaaaatttttgccaaatccaaagtcaagaagcttctttccctaggttttcttttaagaattttatagttttaagtcttagatccattttgagctaatctttctacatggtgtaaagtaagggtccaattgtattcttttgcctcttaatatccagacccctgccacccccaccaatatcatttgttgaaaagactgtcctttcctcactgactagtctcggcgccattgtgggaaatcatttggccaaatatgtgaggctttatttctgggactctctattctattccattggtttctatgtctatcttatgccagtaccacactaacttgtttactgtagctttgtaataagttttgaagtcagggagcatcacaccatcactttgttctttttgttcaaattgttctggctattcaggatcccttgtgattccatataaattacaggacagatttatctatttctgtaaaacaaaagtcactgagattttgagaaggattataccgaatatacagattgatttgggcagtactgtcatcttaacaatattaagttttccaataaacacaggatgtcttcccatttattttatgtcttctttaatttctttcatcaatatatagtagttttctgtgtataagtctttaccactttggttaagtttattcctattttatgcatttttgatgccattgtaaataggactgttttctcaatatcctttttagattgttcattattagtatatagaaacacagctgatttgtgtgtgtgtgttgattttataacttgaaactttgctgaattcatttagtctgattttttgtttgttttgcatggaaactttagggttttctatataaaaaattttgtcatatgtaaagagataattttactcctttccaattttgatgctttttacctctttttcttgcctaattgctcagctaggatttccagtaatgtgttgtacagcagtggcaaaaccaggcaaccttatcttgctcctgatcttagaggaaaaattttcagactttcgccaatgactataatgtcagctgcagacttttcatatatggcctttattatgttgaggtagtttccctctattcccagtttcttgaatgttttctactattctgatgcatcatagtgccaaaagttctagccaccacaattaggaaaataaacaaaataaaaggcatatatatcagaatgaaagacataaaaatctctatctgcacatgacatgaatgcttatgtagaaaatcctaaggtattaacaatagcaacaacaaagtcctcgaaggagtccagcaaagtcagaggatacaaaatagacatacaaaaattaactgcattgctatatatatatatacatatatataacacacatatagcaatgaacaaaagaactcacaattactattatagagccactctaaaaaaactgaagtatttaggtgcacatcaagtaaaacatgaatctgattgctgatgctgcaaaaaaaattgatcaaaaatgatctcaacatataaaaatacatactgttcctggaatgaaaaattcaatataatgtaagctgacaactcttccccaaattgataaacagcttaaacataattcctatcaaaattctagcaagttttttttttagatatagacaggttattctaagatttatatggataggcaaaggaactagaatacttaaaacaatcctaaagaatcctaaaagaataaaaaaactgggagaaatccatccatccaatttcaagaactaatatacagccagagtaatcactactgtgtggtactagtgaagaaccagacataaccatcaatggaacaagacagagaatccagaaatcaacccatacaatatgcccaactgatttttaagaaagcaattcaatagaggaaagagaattttcaacaaatgatgctggaacaaagcaatgaactttgacttgagtctcaaacttatacaaaaattaactcaaaatagttcatggacttcatgtataatctaaaaccataaaacattttaaaaaataggagaaaatcttcaggatttaaggttgggcaaagagttcctatactacacacccaaagcaggatccatttaagaaactgatcaattaaacttcatcaaaatcagaaacgtttgctccatgaaagaccccgctaaaaggctgaagataaaagctatagcctgggggaaaatatttgcaaatgaatatccaattaaggactagtatttagaatacagaaagaattcttagacctgaacatttttaaaaatccaattagaaaataggcaaaacatgtgaagggacatcttaatgaataggatactcagatggcaaataagcacatgagaagatgttcaacatcactggccattagataaatgaaagtaaaatcacaatgagatattactacacacctatcagaatggctaaaaatttttttttaaataatgacatcaccaaatgttgaggatataaagaaactagatcacttatatattgcttgcaggaaaataaaatgacagttatcctggaaaaaactttggaagtttctttaaaaattaaacatgaaatagctattgctctcctgaagatttaccttggagaaatgaaaacacatgttcacataaaaacctataggtgtctatagcagctttgttcaaacaaatgtccttcaacaggtaaacggttagaaaactgtggtccgtgcataacatggaaaactactccactagtaaaaaggaacaaactattgataaacacaaacctggaagaaatctccagagaattacacttaatttaaaaagccaatcccaaatggctacaaattattccaaacagtaaacgagaaagtacggtgctggcaaatatttgaagaaatttgttaaaattttcccaagtttggagaaggacataaacctatgcattcaaaaaactgaatgaactacaagaaacctatgcccaggcataccatagtcaaattaatgaagacaagaagaaatctggaaagcagagagaaaaaaaggatgcattacttatagaggaacaatgattcaaatgactgtgtcttgctcatcaggaaaccctcaaggccagtagtcagaagtaacatcatttttcaaatattgacaaaagagacctgtttacctaaaactaagtatgtggtgaaaatatatttcaggaatgaagggaaataaaaacagtcacagacaaagagtaacaacaagattagcaaccaacagaactgcttaaaagaaattcatcacatggaaggaaaatgataccagaaaacaatgtgtatatcagcaataaagaaagagcaacagaaaggctaagcattcagacaaaaacaattgactattctttttctcttgattctttacatttgacggctgaaagcaaataataataataataatacattctatgaggggctctgaaggtatgcaatgtagaatgtaagataactgtaacagaaagggggaaagtgaaagttgtgatatattttctatattttagcgaagtttctacactacaattgaagtagcaaaatactgattctaaatagactctgagaagtatgtattttgtaactcattttttaaaaagcaaagagatagtcaaactccaaatagataaatatagcaacaattaagtgtacataaacactgcaattacaggacacaaatgtggagaactgactttttaaaaaaacaaccaattatggccgggcacggtggctcacacctgtaatcccagcacttcaggaggctgaggcgggcagatcacgaggtcaagggatcaagaccatcctggccaacacggtaaaaccccgtctctactaaaaatacaaaaattagctaggcatggtgacgtatgcctgtaatcccagctactcaggatgctgaggcaggagaattgcttgagcccgggaggcagaggttgcagtgagccgagatatcgtgccactgcattccagcctggcgacagaacgagactccgtctcaaataaataaataaataaataaataaataaataaaataaaaactaaaaataaataaaaaacaaccaattatatgctatctataggaaactcgtttcattgatacaggtagtgtaaaataaaggaatgggaaaatatataccaagcaaacacaaataaaaatttccaaaaggtagaaacaactcaaatgtccatcaacacataaatggagagacaaaatgtggtattatccatacaatggaatattattcagtcattaaaaggatataaatactgacacatactacaatatgaaccctgaaaacattatgctatgtatgtaaaagaagccagtagcaaaagatcatatattatatgattccatctatataaaatgtcaaaaataggcaaatccacaaagacaaaaagtaaattcgcagttaccaaggattgtggggatgggagaatggggagtgactgctaatgggtagagggtttcattttcgggtgatgaaaatgttctggactggcacagtggtggcagctgtacaaccttatgaatacactaaaaatctactaattgggcactttaaaagggtgatttaatggtatgaaagctgtatctcaacttttaaaatatactaaggtctggcctggcacagtggctcacgcctataatgccagcactttgggaggccgagacgggcagatcacctgaggctgggagttcaagaccagcctgaccaacatgtagaaaccccgtctctactaaaaatacaaaattagtgggcaaggtggcacatgcctgtaatccaagctacttgggaggctgagacaggagaatcgcttgaacctgggaggcggaggttgcggtgagccgagatcgcgccattgcactccagcgtgggaaacaagagcgaaactccgtctcgaaaaaaactaagatccaaaaaataacctatgatgtataaaacactgtgctatacaccttgttttttctccagtgttttttctgtataagctaatcaatacaggacaccagctatctaattacaagccattagcacaaagctagcactggatattggaaatttaagtgaatggacactcactcagaatctaacaacaaaacaccatacagtatgaatttcattcttatactgtaaacatggtgaataaatatagccaattttctttctagatggtgtttcctaaatttaaagaggatactaatgactataatcagagctaaggatgtcaagattcatgttcgcgtatctggcatgtttaaaagaaaaatatgccaatttgctgaaaatactgtcacttttagcactagtatttcccttactgcgtccctcttcctcctgagtaggggcttatactgagtggccagagatcattaacaattccgacattctacaaaggtggccctacattctgcatttctacttttataagagacataaatttcattttattgctcatttcgagctgttaattatatatacaattaagcacttatgccttcttgcctttaatcaagatctcactgttcaaaaaacaagacatattattaatccagctactcctgaataagaaagaaggattgcctacttcacagcacaggatcaagacccgccttgatggctccctccatggctcagtttgtccctatcacaaatcagagtttccaacactattctctcctttaccttcccctgaagagccctaaacttctcagcattgactttcagtaggattgggtccccactcccagtcctaggggtagacactatcctaaaacaatccctgtggcaagagactgcctgacttcacttgtatctattaagccaatttcacatattagggtctgttacttgcaactacccagttgctatcgccaaattctgttacagttaagttgctatccatttatttgtttttaatcaataccacaggcttgtaattaatgccagatgtgatctagttactgtttaagccagaaaacttctgtttcccagcaacattctacccctactttttcccacagtgactggttgaagaacaagataacattaattgctttaggccaattagagccatctggagctacaggtgattctatcctattcaaaccacatggctgtgaaatttgggacctccaacaaattatttcccaatggggattcggttttatggtctggccattttataaaaatctctaatctttgtgaatggtttaatgggtgagcaactataaatagtctggtttgttagtttttttctgtttgtctatttgtctgttctcaccacgaatcaattaagaattcatgctcactgggaagagagcaactctttgacacggactgatgagttttataattctgtatttgccatggccccatagttgaaatttcagaattgaagtcataaactctttccgcatctgcgtgtctatgtgtaattcagaaaggctgttgtctttcaatgtgtgaaggtgcaataattttctacctcagaatgggattaacaaattagattataaaatctactacattatgaaatctcttaaagtaatatattctgatttactcatagaggtaaataagtacatatataaacagaatattcctaaatttcccagaaaataaggaggttgaagatctaacactttcaagaaaccaattattgagctgtattaagaaatcaagttcacataaaaaaagcaaatctttggaaatgggaccagtttaatatttatggtttaaaagaaacagttgtatctttactgatttatcaatattaagtataagcatagacttttattctatttgggtacgtcattcataaacctatacaggtttactgattgaataaactagcgttacttctacttaatgtctaagattatggaaaaggtaaatttgtgttcaaccaaacaaaatcattattctgatgaccttgtatttcaacagtaattatgtcttgcaatatatcagcttgaagacaaatttccaagatctttaggaaacttaaaaactcgaactggtatcaatttgaattaactaatgaatatgcactcaatactgatctcatttctaagtaagactgaatattgagacatttataactaagcataaatttaatattgtcacgcacgtccatgtgaagagaccaccaaacaggctttgtgtgagcaagaaagctttttaatcacctgggtgcagatgggctgagtctgaaaatagagtcagcaaggggagttggggtggggcagttttataggatttgggtaggtagtggaaaattttcacttcttttgtgattcttcagttgcttcaggcgatctggatgtatacatgcaggcttgggctcagaggcctgacaaatatacttgtttcttatttttatatgctacaaagaggctatgtctttggctcttttaatcagttaaatgtgttcatttttgccactcttgagacttgtacacaatgaaagtgtacacacagttaaagttgtgttagctctggatgttagctctgctagtttgctaaaacagtggcatgcaacagctcacaattatccactccctagttttctctgtgtaataaaagttactttggctaaaagttatcaataacatgtgaatgagactactagaacaatggtggcaggcaggtacaacactacgtgtgaggtagtaggatgggttttgtttattaaggaaaaaaaaatagttttgtcctaaaataaaagggctggttgttccagaacgagaaagagggttgtctcagtctgttcgcattactataaaggaatacctgaggctgggtaatttataaagaaaagaggattatttggctcatggttctgcagactatacaagaagcatggtgccaggatctgcttccagagagacactcaagaagcttcccattcatgatacagggagaaggagaacagagattacaaggtgagaggaaggacgacaggtcaagagagcaaggagggaggtgtcaggctcttcttaatatgatctcagaggaactaagtgagaatttatgcattacccagaggagggcattaagccattcatgagggatccgcctctatgacccaaacccctctcagaagaccctacatccaacattggggataacatttcaatatgaaatttggaggggacaaatatccaaactacatcagctgtaaaggacaaaaattgatatagaaagttgtagaagatttgagaaaagataattttacttgccttggccaaagttagctcagttttgaaaaaaaaaaaaaaagattttataaaagtgcttgtagttcctgtagtatcaaatattacactgatacaatactggagtttggttttctctgttgaaattagaaaattttcttggattattgatctgcccttagtaagagattgtaagatatctgctgtataaataacaaagattctgttttaccaaaatagttttctgtgcttttcatgttgattgtacaatgtccttgattaaatatttctcacttatgaaagagccaaatgctttacaatcatgtaaccttcactttattttcaaatgtttggatgtcactttgaaatgagtaggaaagtatttctcaggcacctatgatctgattcctaagtgttgaaatctcctggtaacttttcatttatgtctttacaaattcaaatcctaaatgtaaaataaaataaaaaatttgagatacttttgggactaaaactgtctctgagatttataagagggcccatgaaagaggacaaaaatttattctttcacagtaaaaaaaaaaaaaaaaaaaagtactggaaacaattgtgtttgttactattgatgaaactgcatgggaggaattagcaaatcagaagagatttgtcaatgctctcactgtcatgattagtttctatttatcaaagtcctgatactctgcactgtatagctgttatcactcttatgttttaaaatgttaacttggttacaacttcacttttcaaatgtgaatgcagcatcttctgggccagtggttttcaattaaggattcacataatttactatggagatggagtttcattaatatacagaagcttaggacccactccagacttactagatcttttcacttgatattctggatacattattggtacataatatctaggattattgctatatttcaagattcatttctctgtaaagtttatgctcatctgcttttataaatcagatataatattacatcctttaactatagagttcattattacattttaaattgtttaaaatttttttattgactttattatcttgttttgcatgtcacagaaaccagatttccttgtcagttatatttttctcaaactctcatcagatccttcattttttgaaaatgatcagtaaaaaattaactgcagccattttaaatgtttttatctgcagacatctatttgttgctgttttattctgatgtttccctcagagccttttcaatcagctacaggccagaaggaatcagaaccccatggaaaagggctatgccaggtactttggggcacaggcttctaaatgacattgcttaaacaactttcagaccataccagtggcctaagtcagaatttccaggactcttatgaggaagccgatgggttgataatactactaaccccacatccagtggaacaaaaattaactagatatggctgaatgagctaatgagggatgactgtagtttttgtctggaatattgttgatgctgtttgaatgtattttccagacatataaggaagccttttctctttcttcttaaagctatctataactcataacttagtagactctgcttttgtatactgaaatgaaacacttgtaaacatcttattctccctgcttgagccctccaaagttcagaaacgtaataaatattctattttcagggcaataaagttatttgcatagattaaataagaatctgtcctcttttttactaggacataagtggaaatattggttttgcaactaaactcacatttgaaaatgatgctcattcaatcaaatatgactaaacacttttaagtgttctggaactaaggaactaagactgcctttacagagtcatccttacaaagccttctttggaaaaactggcttacagagttcccagccttgcaggtgagtaagaaaagccacttcctgggaggcccatgagtcttaggatattttagggacctcaagaaatgaggaattcttataaataaaacaggtgaaatctgatatagagttattggcatagcttcctagccttaagatcactagtaacaagaggctttaaaaaatccaatctgagattcctaaagaaaacgtgcagcagagcaaacttaagaactttaaggaacttttaacactcttgctgtgcccagctgaacaacgcctgtaatctggggaaagaagactaaacatctcatacgtgcctgacttgaagagtagcgtagggagaagacagaatgggatagagtagtacagtctctcaaatttttaaacaaattctaacatcgggaggttggaaactagaattattcagcttacagatgctttcagcttgtgcacagagagaaggccatgtcaagacatggagagaaggccagcaagagaggccacaccagaaactgcacactgcgagaccctgatcttaagactttcctacctccagaactttgagaaaatgaattctattatttaagccatgcagtctatggtattttcttatggcagcccaagcagactaatacagttagtaaaatagatttgggaaaattatgacataatctacatctatctcaaacataaaaggaaaagccaagtcgtcttaaggaataacaaaaatggcataaagtaccattttacaagaagttcaattttgaaataaaatttagtacatattttagtcactaaaattttaactcaggaaaaaaacaattacatcacagaagtcaagacaggaaaatttatttcttataaaactatatttcaacaaactaaggtaatttatttaaagtaacgtcaaaatgcatcaatatttgtcttcagtataataatatagtccaaatttctagtaatgtgattatctgtttccaccactgctttcttttttaaacctcattgtggcaataatgaagttaacaagcaactagaaaatatgaaacaaccaagcacaagaccataacagccacacatttgttctaagccattcatctagggtctctggatttcagctttctcctctataaagtggactatgtggaagtggaaggaggaggagagtagagttaatgaagatgacccctttggttcctctgagagtcaaatatctatggggaatatgttgccctgcttagcgctgctcagcaccacacactgcagctgaaaattcacccttaaagttatgaaaaaatggatttatagttccccaagcctttctaatatagactgataaattaaatgctttttaaaagttacatataacatatgattagaatcataatattttagtaatgtactgaagaatacaatcttttccaaatgctttctccattaagtatttttcattttcattttctgaatatgaagtaagggtttgctaaaaacaaaggtctttgtattcattgctgactttttaaaaatcttaattatacattagtaaaatgaacagataaatttctgccattttaaaataatgtatccaataaatacacgaaaaccttgaaataatctatgtcaatataagtcagaattcatttgctgtaaaggttgttatagaaattataacactgtgccctctccctctccctctccctctccccacggcccacggtctccctctccctctctttccacggtctccctctgatgccgagccgaagctggactgtactgctgccatctcggctcactgcaacctccctgcctgattctcctgcctcagcctgccgagtgcctgcgattacaggcgcgcgccgccacacctgactggttttcttacttttttggtggagacggggtttcgctgtgttggccgggctggtctccagctcctaaccgcgagtgatccgccagcctcggcctcccgaggtgctgggattgcagacggagtctggttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgcctcttcctggccgccatcccgtctaggaagtgaggagcgtctctgcccggccgccatcccatctaggaagtgaggagcgcctcttcccggccgtcatcccatctaggaagtaaggagcgtctctgcccggccgcccatcgcctgagatgtggggagcgcctctgccccgccgccccgtctgggatgtgagagcgcccagccgcgaccccgtctgggaggtgaggagcgtctctgcctggccgccccatctgagaagtgaggagaccctccgcctggcaaccgccccgtctgagaagtgacgagcccctccgcccggcagccgccccgtctgagaagtgaggagcccctacgcccggcagccaccccgtctgggaagtgaggagcgtctccgcccggcagccaccccgtccgggagggaggtgggggtcagcccccgccaggccagccgccccgtccaggagggaggtcggggggtcagccccccgcccggccagccaccccgtccgggaggtgaggggcacctctgcccggccgcccctactgggaagtgaggagcccctctgcccggccagccgcccagtccgggaggtgaggggcgcctctgcccggccgctcctactgggaagtgaggagcccctctgcccggccagccgcccagtccgggagggaggtgggggggtcagccccccgcccggccagccgccccgtccgggaggtgaggggcgcctctgcccggccgtccctactgggatgtgaggagcccctctgcccggccaccaccccgtctgggaggtgtacccaacagctcattgagaacgggccgggacgacaatggcggttttgtggaatagaaaggggggaaaggtggggaaaagattgggaaatcggatggttgccgtgtctgtgtagaaagaagtagacatgggagacttttcattttgttctgtaccaagaaaaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggctgcagggtcctctgcctaggaaaaccagagacctttgttcacttgtttatctgctgaccttccctccactattgtcctatgaccctgccaactccccctctgcgagaaacacccaagaatgatcaattaaaaaaaaataaataaaataaaataaaaaagaaattataacactgtaactgcttcctacagtgctatatgagcaagtaacctttctagaaagacagttaatggtctttagtgcagaatgtactcattcagaaacacgtttattaaccacctactatgagccaggtacaggtccagcccctgcgaatgatgagtgaacaaaacaaagatccctgctgttgtagagcttatgaaaacagtgtagaaagagattgtccattttctctggttgtctcagagctcagggcttgtgttcaggggatgtttgttagagttttaaaactataaatgatatatttactgatgaaatagtgtattcaatttggcctggattccttaatactctggctcttttcatctttgctatttgcatgtccccacagctcaagaacatctcatagcctcagcaaagttaacagagacggcatccacaaaaaatcagacagagggagcaaatggcaacactggaacagccctgccaaatgaaattacatgtctggcttacacacacacgtgggaaataataccacaaaacagaacaaagaccctttgttctgtcttctatgcatttttccaccctatgagaagctaaaagatcttcccagaatgaatgctccagcagaaagaattggagtggcttctgaaaacaacacttcctctagaaaatagcaatagagcctgaaggtgcgttcattaaaattatgaactcagttgtctttctcagggtttttcaaagccataactccataatttaagtgggcaatattatatcaataaaaaagatttttttacatcaagaataagacgatacatttaaaaatgctataatctatatgtttaaatgcttactggcttaagaatacttttcgcaatttcaagaaacagttttgttagaaacaaagtacatcattgaaaatgaaattaaaattaaactgctaagtttttctggctgggaacctcaagagtgaggcatccttgagcaactctgggttctacacgtctgttccataaagcctaatggcatccctgaatcagtgagaaaccaggcacagctgacagggcacgtctcctacctgaagcttcattttccaacaagaatgcattggtgtgcgctcagtgcagcgcttccccgcaacatggtccctgtgcttgatgccggggaacaggcgctgcctgcacagcagctgccaccctacagctgccagcagcagcacatggctggctgtcgcagctggacttgtgagggcttgctgaagccctcagcataccactcctgccatcaaactggactacttcctccagctgattttcaaggaacgaggcagtgaatgaataattcatgacaagtccattctagcaaccaatttcacctctgcctatagtctccccatagcaatctgcaatgtaacgattctaagacttacttggtgccatacaaggaatgaaagctcagtttcccgtcaatgacagtaaatgttacaggatctgtttgctcttcctgtgtgccaacctgtcacccagacttacttgaaatattttttttaatgtagaaaagctaaatgattaaccacagatgtctgacagaacaaaacaaaatttttttccccacaaaacccaccctacataatgagttctggatgcagaaaaagcagcaaaatgcttgccctgtgatcagcaggtcagtatttacatttagtaaaagatcagttcctgcagaccatcatcacagggtgggggaggggagctctgcgtatcaatgccaggaaacaaactgcttcaaggaggaattttcctggtttcaggctataaataaatcgtccatctcattggtattcttctaggaagtacatgaatattcattttcaccaatttgtccatgcttacatatttccaaatgagtcatatctaaagaagtcaattttctgcaacttaaaatcatcattccaagacaaacttgaaccagagaagggaaggccaataatggtatcatctcaactgcacctgtaggcagtccaatcacctgtaatgttctccacctgtttcccatagccgtccttttttctcactgctgcaatgttttctcttctgaactcactgtaaacatctcaagcttttgctgtcactaaggtaatttttcagccatgagtattctgttcctcgctgcttctaatttatttgttgttctgcaacaaacaagttccccaagtgtttcttgcccttgtattttcccttttcaccttcttcttttcacctattttatcacttctgaacttatgttttataaacttctagttcctattatactattccacagtagataggaattctcttccttttttgcagggaaataatgatttcttccagtacagactctgcatcattccacaagcactgagcctttcactgtccggacatgtgtacagaggcctcaccaagtcccctcattgccttccacttcacaaggacattcgatctggcttgtgtgtgtgtgatgccgtgttgtctaggggaacccttcctcttccagctattgggagctgatgccgcattcaagcagctttctgcaggcatgctgcggagagggcagttcatggtgtgtggtaaagagacaaaggaaccagtctctattgaaagccctaactctgttctcttctcccagggatatccttttcctcaacattctgtaatcccctcaatgtcttacgagatttcatgtccaccagaaagtgtctagcccaagttgttctcttccccttttgaagtgacattcctttttctccaaatcctgaccacccactcccctaccccatcccatgaatgagaggataagagggcctatcacctgaggctcacaatgtgtcccttcttccacttcctgttctctacagagacttatttccttgatgttctcttttgccctgcgttctgctaactcccagtttcctgatgaagataatcagttctaaggttgatcactatgcttcttgtcttctctacttcattcccagcctagacacaagagatcactaaaacagtgatctccagtatgtttcattttgctaattattttttgtagagacagggtcttactatattgcccaggctggtctcaaactcctggcctcaagagatcttcctgcctcggctcccaaaatggtaggattataggtgtgagccactgtgcctggctcaaactgattgattattaagaatcaagtgtgggccaggcacggtggctcacgcctgttaatcccggcactttgggaggccaaggtgggtggatcacctgaggtcaggagttcgagaccagcctggacaatacagcgaaaccctatttctactaaaaatacaaaaataagctgggcgtggtggcacgtgcctgtaatcccagctacttaggaagttgatgcaggagaatcgcttgaacctgggaggcggaggttgcagtgagctgagactgcgccactgtgctccagcctgggtaacagaacaagactttgtctcaaaaaaaaaagaatcaagtgtggctaagagtgctcaaaaaaatcctcagaattaacagcgacataaagatcatttagtccaacccaatccagagcctcaatcctataaaatggcaaccccagctgtttctctcaacactcccagacagctctccagtcacctgccaaggcagctaaatctattcactctgctaaaatatatgtatgtacctccttattaacagccaggctcaccctttggcctgcagtatgtatgggaacactggattgtaaaagcaaattaaaaggacagacagtttggcacaatggtggcaacagtggtgagtagcacaacaagaagtcaaaacatggacaccaaatttccctggagtatcagctagttgacagtagagttgtgaatccactagcacttaaccaagttattaaaaacttttcttatggactatacacgtgaacaattctaccgatgttttagggcctccttccattccccatcccaagaatagtaatatgaatataatgtaaaaagagaacctcttaagaagggctcaaaatagtttggatatttgtctccaccaaatctcatgttgaaatttaattgccaatgttggaggtgtgacctggtgggaggtcgactggatcatgggggctgatccctcaggaatggtttttaccaccatccccttggtgctgtcctcatgatagagtgatttctcagaagatctggtcatttaagaatgtgtggcacctccccagacctcttgctcctgctctcgccatatgagacaacactctccctctgccttctgtaagcagcccaaggcctcaccagaagctgaacagatgccggtgtcaggcttcctgtacagcctacagaaccacgaggcaattaaacctctttatgaattactcagtctcaggtatttctttacagcaacaagacagcctaacataagggcttagaactgctataactaaaacttcacacaaaaagactctggaatacagtgcccttcacattttcttgtataccttcatgaaagtctatattctccatgtcctccttagcagactgatgtctgggtgaacaaatatataacacaggcaaggatttgcaatgttttttcatgacaaatgtcaaacaagcataagagactgctaggcactattaattgtaagtgataaactaaccctccaattttaagatgatcgtgatcttagcaatctatgtttcttgaatattttaagttaaaacttaatttttttgcattatcaggtacttctctcagagactaggcttcctggcagctaatacaagaggtgatgagtgcacatcgtatctcaggtgtctcataaagaattctggttgctcttggttgtctgagataaaaggcctgatgactatggaggggcaggctttcataagaattatcaatgaaggcaaggtgatggttatcaggcaagtccttccaaccttcagaagaactctgaattaaagttggactgacccctgagtatctgtgattctaccatcacagtgccacatcagtacagaaaagagagctccgatgacacagaacgcagtttgcagcttgatgacatgtgtattctcgcactgctgacattacaaccaagacctcagaactcttaagacaacagcaatggtatgtccttgaggcagcaggaaagtatcaacaacctacctgcctgcagttcacccattcatggattttccctgcctagactactgctctaaagactctgatctgaagaacttttgctttccatgatcttcaaaacctgcctcctcaaacactgcccaatactctagacgagatatccagtttgctctgacctttactgtacatgtttggtccttccagaatattaggagcttcctcaactcctaacagattgcccaagggagcatcctgtggaatggaaatccgtttccacattatctctgtaatgccaatcctgctgatctcagttcagcagcaaactgtaacccctggacactggtatggttctagagccctcttgtaactttcaagagcattcccaaagctaccagcatcctatcattgctcttggccagaatggctctaataaagcatgtatcatacactaatcaaaatggcttagcttttaaaccactgtacttgtgagaggacctagtaacaccttcgtaacacttcctttgtcagtgttacaaaagaagtaacaaggatcccaccaccttgtaaaagctctaaaagatatgctggaagggagtctacacacacaaaaaaacttctgacagatttcaccaactgctgtctttttcaatttgatcttaaaatgaaaatataaaatatgtgagtaaaaatttaaagtgccattcgtaaaggattgaatatatcttcattcaagcatgggtatcatgtggataccatccctttgttcatgagtaaggtatcatctgtacaataaggagttcctactctattacatgagataaacaggtaaacaactaacagatatgactatgtggcaaaactaaataaacgccatatcagagatacagatgctagtttcttgtatcctcccactaccacccatccatccacaatgagaacagaaaggaaggagacataagggaaggtttgggaagtcagtaagtagactactgcaataatctagatcaagggtcagcaaactttttctgtaaagagccagagaggaaatattttatgctttgcaagtcatattctctattacacctactcaattctgccattgtcagacaaaagtagtcacaaggaaatgagcatggctctactccaataaaactatatttatgaaaactgaaattttgatttcatatcattttcatgcatcgtaaaatattaatctcttgacttttctccaaccatttaaaaatgtaaaaaccgtttttagctggcaagtcataaaaaacagcagtggctggatttggaccatgggctatgatttgccagcccctgacctacacggctgcctgaaatacagcagtagcaccagggcagagaggaaggacaaagaaaacatttcagaggtggaatcagtaaaacttattgatgagtggcgcattaagagcaaagtcggcaaaaggagctccctagtttctagcccaggtgactcagagggaatgtcatgaacaaataagagcagcagctctccttcacctgaggaggacaacagcacctggagtgcaccactcactgcccaggtgatgagaactacgcactcagcagcagtgacccaagactcaaatcccacctccatcagttatcacatacccaacctttttgattctcagcttccaaatcaatccataaagtgatcatgaccacaacagtaatgcctacttcaaagggttgctgtaaggattcaatttagtgagttaacatatggaaagtccttgggacagtgcctggctcacagtaaatgatatgtaagtgttagccattattcgaaatataaaaattttaatccataaatgttatagaggcaatttataaataccatatgttggcctacttaaatacagtaaaaaacagtattcacagtaataaacattcttaagcatttaaaccatctgtgaatacttgacatagtatacagcattatttaagctaaataatatcaaattaagttcctttcatactggggaaaaaaatcaatgctgaagtagtgctggccaggataaactgtacaaaggtatgtgtggttcagggtaaagcaaagtcagtcttgagagttagaatgggacgagggtctaaaacaggtgacaagtacaactgtggcctgggctagtcaccagatttctgggggactccatcaggcgcttttcttatgttctaagaatttacctagtctacaagttccattctaccacacgagggggcgtgaagcaaataccaatgtgagattaaaacctgctgcaattactgtacttctaaaaacaaatcagtctgacagcaagaatgtaattacattttttattaggagatagaaaatacaaaatattttatgaggattaaatataattggaatattttctatgatttgataaaaagaagcattaactactttgttgaatgatacacatttcaactgaaagaaatcacaaaatacttttaactttgttctttatctgtaatatcttgaaaagttgctgttcaaaggtatattgctttctagttaattacccatcgtagcaactaaacctgtgaacagctaaaaaaaataatcaacttatctttaattacgttacattttttagaaaactattttcatcacttgaaactcactctgctttgcttttaagggtcttttccccaaaagttcttcattgaagaacaattgatggggaatgaagtcacttttataaatctacctatgatatatctgaatccagaatgtgcccaaataccttcattttgaagcctcttgaataagacaggaaaagataaactgcctaggcaggtataccatgatttgattaagcagtaaaaaagattacccaaaaccagtaattccaagtattcctttgtttgatgacctgatttttattccctagaacaatgcagcatagcaaaattaagagacatagtaaaatgtaggggcctttccttcttcagagtcgaaaactagctgctcagaaatgtgggtgcatgaacagttttaggctcaagtgtatgtggaaggtaaagatctgaaaatggagtcgttaaaactgcccatgcttctgctccttttggaaagtctgcctgtgcctcccagacatggtgcaaaccaatgtttacataagataacaaaaaatttggaattagatttaaaattatatgaatacctaggaagtgtgagataacttgcccattggcctttaaattatttcgtataatttactatttattattgtctactgcgacgctttcttcagctcactttcggcaagcataatcttttatttcccaaaacttttgatttgaaaaactttaaatctacagaaaagctaaaagaatagtacaatgaatacctgtctgtccttcacctagatgcatcaactgttataaaatctgcccatttactttttctttctctgatatacatattctgatgcataaaattaactgtaattctatcattattatctaatatatagaaaatattcagctttcccagttgtccaaaaaacacaccttacaggtatttatgtttttaacatgttccaccaaggtacacatattacactggttgtctttttagttttttataatctaagacagtcctcccacatttttctgtttttaatgataaacaactttttaaagtcaggggttcaaggttcaaatttcccccaaaaaactctgcatattaatttaataaaataattttttcagttattatcaaagttttgttggtaaaagatgctagccttgtgactgttagatttggggtgacaactctcagtggattggtatgggagggccactgaggcctgaaggacactatctgggagtggacacactgtgggagtgactatctcccacaaagtaaccatttcatctccaccactttccagaaaataagcagtctcctccaagttcagtaagaacccaaggtcacactgctaattagatgaaaagacctttgctctcagggaacagacatctacacaccttgggtaacaatcctggggtgtaatacaaatcagttgagcacatctttcccaatttgggtgtatgactgcttagaagtgctaattacgtacacagctagtaatacataaacactaccttaatcatcctaagcctaactcaaaaccaaagccctgaggcaaaagatgctattaagatgtccttgtaattctaccactgttcatgtattacctgaacagtgtgaatccaacagcagtgccctgctctgctttttaaaaaacaggcttctgaaatgtggtaaattgagttcttcagaaacaaacatgaaaaacacacaaattcggcattaggatgactggatgaaagggatgacagttcattccctatgcaaaagtggtatggaagatataaaacattccaagccaggtgtgatggctcgtgtctataataccaacacgtggccccccaagtgagctataattgcacccctgcacctcaacgtgggcaacagaatgagacccctgtctcttaaaaacacaaaactatttgatgcacaaatgaatgaaaaaatatgtgtgtgcagtctatattcatgtgcaagcatttttttagaggaaacaaaacaatatggaaaaaaatatacagtcaggcatttatctttggtgctgttttattcatgtgtaaaataaggaagtcatctcaataacatcacatatcaaaagccattaacaacgattacaggacactaggactgtagtattatttactgcaatctctgcattaaaaaataaattaggggcccaatagggtggctcacacctataatcccaacactttggaaagccaaggtgggaggatggcttgaggccaggagtttgaggccagccttggcaacatagcaagatctcatctcttcaaaataaaaaatttagccacatgtgatggtgtatgcctatagtcccagctattcaggaggctgggatgggaggatcacttgagcccagcagttcaaggctgcagtgagctatgatcatgccactgcactccagcctgtgagagtgagacccaatctctaaactaaataaataaaaacaaagagtgaaaaataaataaatatatttgagtggttttcttattttcaagttactgacagaaaatctgaaaaattatctgccacctagttgtccaattcacacaggacagctataagagagtagtgacaaccaagaaatcataatcatcaagtcctacagtgatacctagacaaacgtattcatacaccaccttgactcaacttatatgcaacacactgaaaccaactgcaaatgcttcacttaccgcacaaccagacaagactcttggttttacctagattatgtacactcttaactagcaaactctcactagaccaacatccacagaggtcagctacagttattctgtgcattccttccatctctaaactctaaataaataaacagcaaaccattaccagttctcaagttttacgtgagaattggctgatataggtaagctgctaatatataaaatagctggaatcgatattgttggctttttactaagaatatttaaaattgcaggacctcaaagttgcacataattttatctgcatttaagcttcaaaaatctatatatgcaaaagaaaatgtagatgtagccgttcaaatgggtcaacctgaatttaatgttttataacagcatactcttttttaatctctagaaaaacatcaaaacttctctttattctcaaagaaaacaagcctacaaagcagaaaatgaccatttagtaaagaagtcatctttggttcttaaatgttaagcatgctacaactttctatacatgtttgagccaactaggagatacttccaaggggtttcagagatcgctgtgattaccaaataggaaaaacacgcttggaagcagaagtgaaagactccagggagcaagaacaggtaaacaggtgacaaagaaattctggtttccaggtatgagaaaattaatctcttgtggcccttgcaggtaaggtagatggatgattcaagaagccacgcaaatgatctcacagatggtgatgcctaaccagacagtaatctgcaacaggtttattttaaagatgcatattcatctcttcatgaaaacatacttctataaaaaagctagaaatggtctaaaagacagtaactagaatgctgagagacccaactaataatacgtgattataagggatttttatcctgcagaataagactggcagttcctggaagcaaaaagtaaaagtgtcagtaagagaaagctacagacagtttggtcttatactgtatctcaaatctctggtagcccaaaaaaaaaagcacaaaacaaccgcctttcgaagtagtgggttagcatcagggctgatgccctaatggtgccctaaaaacaaactggccatgataatacagagtaggttcaagcattaaactgggagtttgcccacatggctctggagatactgcaatgttaaaattcaagaggttttctccaagttccttatattaggtttttattatttaaaagggaagaatttatctaatagagaaaagagaataatttttaagtagtaaaagtgtggtgattctgtctaaagatattgttatcacttgaacattgtgaggtcattttttcaaaagatgttaggtacaaatgaatacagtatgatctatcaatactcatgtgtttttagagcaaatacgaaattgtgtttactgaccatcatcctgatgctgcatggtaaaatcctccttttgacctcagtagcaggacaacagggccaaaactaggactgtttataaatatataaaataccacttttattttctgtgtagcttactttaaatataagttgatcattgaattaccttcttacttatcacctttcaggaatcctgggatacagatcatttctttcaggatccctttatcaaggaggacagggcagaaaattgaaaaatgtattttttggacaatcttgcaatttgggttccagacatgtagaagaattccagataattcatgtaaagactccaccttcaaggagggggagcacaactccccattctttaaagtgggctatgcctagtgacttccttccaaagaatgaagtacaaaaggggagaaaaagagtaactttatagtggagagacctgatagtcactatatcagccaggtggtcaagaaaatcagtcataaatcatgttgatagtatactcgatctgttgtgatgaactggtacattgtatctgtggacttccatcccaaaacctataaccctagtctagtcatgagaaaaatatcagacaattcccatagaaggacattccacaaaatacctgatcagtattcttcaaaactgtcaaggtaatctaaaacaagggaagtctgagaaactgtcatagccaagaggagcctaaggagatacaacaacaaaatgtaatatgctacatcctagagatgagatcctggaacacaaaaaggacattagttaaaaagtagggaaatctgaataaagcatggactttaaaactataatgtattcatattagttcactaactatgatgaatgcagcacactattttaagatgttaataatatgagaaactggaagcttggttcaagatggctaactagatgcagctagtacatgcctcttccatggaaagctccaaaacggcgagtagatattcacccttcaaataggtcatctaaaacagaacactggaattcaactgaaaagcaacaggaatcactgatcacaaaggagaaggaagcaaggcacgtgctcagccaggattgctgagagatgaaagaagcttctagatgctgggaaagggtagatgagagactcccagggctccacattcccaccatggacttttgcaacgctagctgtgggagacccccttgaccctcgcaggtctccagcctaatagagtgagttgcctggagattgacagaggcattgctcaaactcacatgggagtacacaggcttccgagccctgagcagctgctgctaccagccaacaagccaggctgaagagaggaggccaggcacttttacacaaccactgtgcttcttgtacagtctgcagaatagtgagccaaataaaatctcttatttataaattacccagccttgggcattcctttatagcacaagaggggacttcaacaccccactgacagcactagacagaccactgagacagaaaaaaaaagaaaaaaaaaaccccactggatttaaattggactgtagaacaaatagacctaacagatgtttatataacaagctacccaacaatcacagaatatacattcttcttattagcatgtggaacattttccaagacagaccttatcttaaggaatgaagcaagtctcaataaatttttaaaaaactgaaatcatttcaagttgtcttctcagactacagtggaaaaaacctaaagtcaattccaagaaggactctcaaatctatacaaatacatggaaattaacctgctcttgaatgatttttgggtcagtgatgaaattaagatggaagtttaaaaattttttaaacaaaagtagagacacaacataccaaaacctctggaatacagcaaaagcttatagtgttgactgtaaatggattcaagaaagaaaagtttatagcgttaaatgcctaaatcgaaaaaaatagaaagaccacaagttaacctgacatagtacctcaaggaactagaaaaacaagaacaaaccaaacccagaagaaaagaaatgatgaagagcagaactaaatgaaatccagatcataaaaacccaaaagataaagaaacaaaaagttgcttcactgaaaagataaacaaaattgacagcctactagctacattaaccaagaagaaagaaaattcaaataagcacaatcagaaatgaaaaagacactacaaatgataccacagaaatacaaaagatcatcagagtctaccatgaacatctctacactaacgaactagaaaacctagatgaaacaggtaaattcctaaagacacacaacctctcaagaatgaactaagaaagagaaagcctgaagagaccaataaccagtaagacttaaccagtaataaaaataaaaaaaaatctcccaacaacaaaaaaccccagaagcagatgaattcacagccaaattctaccagacatagaagaataggtaccaatcctattgacaacactgttcccccaaattgaagaaaatcctctctaactgaagccagtatcaccctaacaccaaatccaagcaaggacacacaaaaacagaaacagaatcaatcagtacccctaatgaacacagatgcaaaaacgctcaagaaaatactagcaaaccaaatccaacagcacatcaaaaaacatggtacaccacaatcaagtgggttatattccagggatacaagtagggtttaacatacaaaaatcaataaatgtgatctgccacataaacaggattaaaaacaaaaaccatattatctcgatagatacagaaaaagcatttgataaaattcagcattctttcatgataaaaaccactcaacaacttggtgtagtaggaacatacctcaaaataataaaacccatatacaagaatcccacagccaacatcatactgaatggggaaaggttgaaagcattccccttaagaaatggaagaagacaaggatccccactcttaccactcctactcaacacagtactaaaagtcctatcgggccagagcagtaatgcaatagaaagaaagaaaagacatctaaattgtaaaagaggaagttaaactatctctgtttgctgatataattttatacctggaaaaccctaagactcctccaaaacactcgtaaatttgataaattaattcagtagagtttcaggatacaaaatcgacctacaaaatcagtagtatttcttttgtttagttggggtttgtttctttgtttgtttttgaaacggtctcactctgttacccaggctggagcacagtggcgcagtcatagcttagcgcagcctcgacctcctgggctcaagtgatcctcccacctcagcatcccaagtcgctgggacttacaggcacgtgccaccacacccagctaatttttgtattttttgttgtgaggaggaatcagtagcatttctatacaacaatgatataatcaagctgagaaccaaatcaagaaccaaaccaagaagtcaatcccatttacaatagctacaaaaaaataataaaatactcagaaatacactcaaccaaggatgtgaaagatctctacaagaaaaactacaaaacgctgacgaaagaaatcacatatgacacaaacatgatcatgggttagaagaatcagtatcattaaaatgaccatactactcaaagaaatctgcagatgcaattcctataaaaatactaacattgtttttcacaatattagaaaaaacaatcctaaaatacccaaggaaccagaaaagagcctgaatggccaaagcaatggtaagcaaaaagaacaatacttgaggcatcaaattacttgacttcaaattgtactataaggctataacaaccaaaactattataaaaagagacacacaggtcaatgaaacagcttacagaacccaaattaaagacacatgcctacaggcaaatgatcttcttcaaagtcaacaaaaacatacactagtggaagaacaccctattctatacatgatacttgggagaattgggtaaccatatacagtagaatgacactggacccatatctctcaccatatacaaaaatcaacttaagatggattaaagacctgaaagtataaagacctgaaagatctgaaactataaagattctagaagaaaacctaggaaaaactcttctggacattggcctaaggcaaagaattcatgcctaggacctcaaaaggaaagctacaaaaatgaaaatagacaaatgggacttaattaaaataaaaagcttctacacagcaaataaataatcaacagagaaaacagacaatctacagaacaggagaaaatatctgcagactatgcatcttacaaaaagctaatttgtagactctacaaagaactcaacaagaaaaaaataacctttttaaaaaatgggcaaagggcatgaacacatattttgcaaaagatgacatacaaatggccaagaaacatttaaaaagttagaaatgcaaataaaagcgatgaaataccatttcacaccagtcagaatggctattactcaggtgtcaaaaaaatcaataacagatgttggcaaggatgcagataaaagggaatgctcacagactgttgttgggagtgtaaactagtacagctgctatggaaaacaatatggagacttctcaaagaactaatagaaataccatttgatccagtgatcccactactggggatctacgcaaagggaaagaaatcattatatcaaaaagatacctgtactcaaatatttattgcaggactactcacaatagcaaagacataaaatcaatctaagtgcccatcaacggatgattggataaagtaatccacatcatggaatactactcagctataaaaaaagaatgaattcatgtttttttgtagcaacatggatagaactggaggtaactatcttaagtgaaataactcagaaagagcaagtcaaatatcacatattctcacttacaggtgggagctgaaaaatatgtacacaggggcatagagagtggaataataacattggagactcagaaaggtgggaggatgggagtgggtgagggatgagaaattacctcatgggtgcttatgtgcactattcaggtggtgtaacaacactgcacttgtactaaatctataaataataacaatatgagaaactgggtgtcaggtatatgaaaatactccatcctagcttaacaatttttctgtaaatctaaaactagtctgaaataaacttttacttaaaaatgaaactgggccaggtgcagtggctcacacttgcagtcccagcaatttgggaggccaagatgggaggattgcttaagcccaggagtttgagaccagcctgggcaatagcaagaccccgactctacaaaatgaaagaaaaacttatccaggcatggtctatagtgccagctacttgggaggttgaggcaggaggatcatttgagcccaggagttcgtggctgcggtatgctgtgatcacgccactgtatgctagcctgggcaacagagcaagatctgtactcaaaaataagtaaaaaataataacaaaaatgaaaataaaactgaccgaagtgagggagaaaagcaaactcagaatagtcacacatgccaacaatgacagaaaagaggactaaaactgtcattatagctgttatttcatatactaaaaaagttgcatagagacatggaagatataaaaaagatccaaaacaaatgtctagtgataaaacatgtctgagatgaaaaacacactagacggaattactggcagattagatattgaaaaagaaaatattaatgaaattataaacaaagtaattggaatatccaaaataaaatgcagaaagaaaaaataaccttaaaaaattaaaagtgcagcagtggacaactttaagccagtcaatgtgtatactggagtccccaaagaaagaatggggggacagaaaaagtatctgaagaatagccaaaaagctccaaattctatgaaaattgtaaacccactgatccacaagcacaacttcagaatacaagaaacaaataaaaaatattttttaaataaagctgaaagaagtcattgtcagccaactcacattataagaaatgctaaagtcctttagacaaaagaaaaatgatagatggaaatacaccagaaatggtaattatctgagtaaacagatctttattattatttaaaagaaaagtatttaaagagaaagtatttttttaaatatattctagggtttaaaatttattaaaagacaataatgaaaaggccagaaggaaagaaatgaaagtatactattgtaaggttctcatactgtatttgaaataaaagatcatctccacagtgacatgacccatatcactgaaactgaattcatattcactcattcattcattcatcaactgtattgagtactgtataaaagtcattaaccctctgtagaagttatgggcttcagcgagggtgtgttaacagattagactaagcaaacaggtggattatttgagtctaggtaaaatgcaagggttcactcttcttatgggactcagtaggaataatatctcccaagcacaggaggatcagaaatcatagcaaaagattttgggttgaacctgtgccaggaaaaactgcataaataaaaatgggctccactggacaaaaatttacctttcaaatcaaacctgataccacaattgagaccctagaaacacaaccactattttcatcctgtgccattgctgctgaagctctcacggggccctgcaagttcctggttcaactgctcttccactactgccacctcatctgggctccacgacaccctgaactgtcaggctgccactgggtgttcaaaccatccccacactaaggtaagacagaatggtttctctttcttcccaataccaataaaaatccccattctacaaataattgattaatgctatttatttagaccttaaaaatcccatcaaatagataaattcaataaggctttattaaataaccacctacagtaaacctgcagtgagggtgtatatcaaaaagaatctcccttcctggcctaactgttggacattttcctttttctattccaaacaagtttgtatagcttccccatgtacacactattatggactaaatgtttatgtttcccacaaaacttttatgccagaactctaatccataatgtaatggtatttggaggtggggccttggggagacaattaggtcctaggggtggaaccctctccatgggatcagtccttctatatgaacagccacatgacagcttgcttccttcctccctctatgccatgtgaggacacagcaagaaggcagctgtttataagtcaggaagtaagacctcaccagaatccaaccatgctggcaccctgatctcagatttccagcctccagaactgtgagaaataaatgcttgttatttaaaccacccaggctatggcattttgttacagcagctagggcagactaagacacatattaagaaattccagccatctggtgtccaaatttcacactacgatgaataggaaactagcagcatcatgttctgagaatccaaagaacttagtcacagtgattaaccaaaaataatcaggtagatttaaccaatgaagataagtcatttataaccatttataaacagtagtttacaccaaaatctgaaaacctagaaatctacaaaaagacaattccttctgagtacaactatttgtgtgcttgtcagtatattatcagagaaaacctgacctttagagtttaagcactgttctaggtcatctttaataaaaatttaataaaaataatgaaactaaaaaagatactctcccagtacctgttcttccctctccttttctttggtcttacttctgtagactctagcagagatggcatcctgggatggaatggcagagatctgatgcagtggcatgctcatcccaacctcttatctggtcgtcttcttcacagaagagagtctccactggtagagtcattttgggccatggatttcaagctgagagaaaatgaagagagaataaacataactcagctaaaacactttaaatttccaagagtgagcttaacattttatacttatattcatatgtatatttaaataagttacggcaacataaatgtttggtcttcaaaaacaatagaagatgaatgtctaaggggaaaattctaacatttctcataataagatgggagcacctgaaagaggcaggtggatcacgtacatgtataatcagagatataatcttccattggctacttaggattaaaacaaagcagtgccaccatttattttaagaatatttttgaagttaaacttttttttttatcatgaccaagcatttgtcctgaaataagcagtgatctttccttaaaaccactgtctgtgagtccacataatggtgagatcagaggttaggaagtccaaattaaactcaaggtatctatgatccatacttaaccttccaaaagtagagactctacacgagctgttggcaaactattcctataaagggcaagatacatattttaggcactgtggtccaagtgtgttccagctaattaactctgccactgtagcatgaaagcacccatagagagcatgtaaatgggccgggtgcggtggctcatgcctgtaatcccagcactttgggaggccaaggcgggcaaatcacgaggtcaggagatcgagaccaccctggctaacacggtgaaaccctgtctctactaaaaatacaaaaaattagccaggcatggtggcgggcgcctgtagtcgcagctactcaggaggctgaggcaggagaatggcacaaacccaggaggcggagctcgcagtgagccaagatcgcaccactgcactccagcctgggtaacacagcgagactccaaccccccaacctcccccccaccaaaaaaaaaagagtatgtacatgaatgagcatagttatgttccaataaaactttatttacaaaaataggcagcaggctagatttggcccaccagactatagtttgccaaacactgccgtaaagggtttcctagggaatatgaagggtcaccatgacatgcctaagaaccatgagaaaggctgcctttaggtaaaataacagtgtatgcataaactgtcttcagtgattccaggtactcctgccctgtttctggttttctcttacgcatcccccaaaatgtctaataattgaattgtgtgttgttctttctccccacttacccactgagatctatcccactctgtatacaaaaccaattaaacgtaaattatccagaaggtttaatgtagtaaaatgtttcatgttgttcaaattttaacagaaaatggaagccttcaaccaaaagaatgaatctcgaatttggagattttcatttattaaccatgtgctggggtagggggtggggacaggtgaggcagtaggaaaaggtagggtaaacaacagggcctgacaaccccaaggtcacatttgataagcagtcacttactctacctctccccaaactctactctggatcaaaggcaggtgtttgtaaggctggtgccaattcttagtagtgtcactaagcaagcagaggagcaccaggaatcacgaaatggcttccttcacacaactctagaatcaatgaacaacaaaaaggaacaaaaactgggagggatcaacacatagaagaaaattagctaaaataataatctgtttataaagtctagttttacagtaagtgagtgaccattgataataacaacaaaaaaaggaaaatagaataggggatgttagtgtctaggtatcacacaccacctactctatttcaagcctttgatgaggctggcataagatggagcactactgtgcccaagaaacagtctgaatgtttgtattcaagcacgtcacacaaaacaagaggcacttactgcggagctgccttatactccctgggagatcacaatagtcagtggtaagcagttttttcatcactaatgcactaacgtcctctattacagatgacaaactccatggggcctcttggaatacttggtcaaactgacgatatccacagccctatacctaccat

SEQ ID NO: 2132 - DNA, 20207 bp, Homo sapiens
aggcgccggcggttggcactgacaggggcggtgagcgagccgctccggtctccgggcgaggcttggccttccgagcagagacggcgggaagcggcggcggcagcggcggccctagggccggctggtgaggcgatggcggcgccggccccgggggctggggcagcctcgggcggcgctggctgtagcggcggcggcgcgggcgcgggcgcgggctcgggctctggggccgcgggggccgggggccggctgcccagccgggtgctggagttggtgttctcttacctggagctgtccgagctgcggagctgcgccctggtgtgcaagcactggtaccgctgcctgcacggcgatgagaacagcgaggtgtggcggagcctgtgcgcccgcagcctggcagaagaggctctgcgcacggacatcctgtgcaacctgcccagctacaaggccaaggtgagagagccccgggccacaccgctgcccccagtcccgctccccggcgtcgttcgcggtgtttctcatccgagcttctgagtcagaagcttcgcctcaccagcccgcctttccacggctccagtcagtatcttcctcacctccccccaagataaagattctcttttctttggatcgaagttctgctccttaacccatcccacttccgtgatccacttttcaaacaactaggtagtttgcctcactcattcaacttttgacagttttccccgttaaagacagaccaccactcttgtaccttttaatgccctcatcctacttttctccccggcctccagatagacttcattatattaaataatcccggccaccttaacatgggcttagtttctaagtttctaagtttctagtttgctttcactccacgtttatctcatcttttccaagctctgatttttaaccatttgttttcattattttcccccaagttctctttagttccctccactatattggaggcttacaagtgagtgtagttctagtcatcctgctcacttacaagatacaggcttttatagaacgtccacgggcaccacctaacatactgctttgtcctgctgttattggctgtttccttgctaactttttaatagttccacattgatggtgtctctctttttctatttgtcatctaacgtgctgattacagtttcgctgcatccttcctgcatattccgcccgccttcatatacaaaataaaaatgtcaaggaacaagttgtggtacggctgaaaggactctcaggccgaataaacaaagggtcttggtcttgagttgagttgaatggttaacagctattcagtatagcagtcaatcaagatcatatataagagaagataaagtctgattgcaatgtgttaaacataatgaatgcattagtaactaaaacgataacatccccccctttttttttttttttgagacggagtgcaatggcgtgatctcggctcaccgcaacctccgccttccaggttcaagcaattgtcttgcctcagcctcccgagtagctgggattacaggcatgcgccaccatgcccggctaattttgtatttttagtagagttgtggtttcttcttgttggttaggctggcctcgaactcccgacctcaggtgatccgccctcctcggcctcccagagtgctgggattagaggcgtgagccaccgcgcgataacaccccctttttaatgctagcttgccaacaggggtcggagtaagaagtaaaaatttttttttcatgtgaagcatgtaaaatttatacttatgtagtaaaaccggttttagttatagaagatagggaacattgccattaaatatgtaaactatcaagttgtttctcttttcttttttctttttttttttttttttgagacggagtctcgctctgtcacccaggctggagtgcagtggcgggatctcagctcactgcaacctccgcctcccgggttcacgccattctcctgcctcagcctcctgagtagctgggattacaggcgcccgccaccacgcccggctaattttttgtactttcagtagagacagggtttcaccgtgttaaccagcatggtctcaatctcctgacctcgtgatccgtcgccttggcctcccaaagtgctgggattacaggcgtgagctcatgcgcccggcctcaagttgtttttctattaagcgaaataacaataatttactaggactgtttgtgcgtggtggctattcagtggatactggttgtaatttatataggtgagtacagacgattggaattttgtcctactttgataaatgtgtcggtttcataaattttatttagtttttatttttctgtaaagtttattgtttttacttattttaaactaggagtttttgttgttgtttttgagacaacaaaacaacaaaactctgtcgcccaggctgcagtgcagtggcacaatcatagctcactgcatcctcgacctcctgagctcaagggatcctccttagcttagcctcccgagtagctggcacttcagtcatgtgccaccacactggctaattttttattttttagagacacggggtctcaccttgttgcctaagctggtctcaaactcctggactcaagcgatcttcttgcctcagcctcccaaagtgctggggttacaggcattagccactgcacccagcctaaattaggagttgttgttttgataattgacttgtaatagaaatgttcacatgattcaagattcatattataatatgtaatagataatgtgttcgtgtgagtcaagcttcaatagaagcaaaatgatatcaagcaaaatgttttcctttcatccttgtcgctcagctacccggttcctctccatgtatgcaacctgtcttactttttcttttgtatccttccagagatattttaggtttctgaggtttttaatactttgcttttctgctatgtgcattatagatgttgtagacttgtaccaatcactgttcattcacacattgtaggacttcccttgaatattttgaggataaaagattaattcaaaaggagtcaaatagtctagtaggaaatctttcagtctagtagaggagagaaaaatgtatagaaagaactgctaatgtgtggtagaaattgctccttactgttacagacataaaaaagtatactagaagttcagtgaaaggaggaatttacaaactgagtggaggattggaggagatttgaggttgagcttatatttgagctgaattttaaagatgaggaggagtttagtattttaggaagaggaagtactctgagcagaagcaggacaagaggaaagtaaagggtttgtacaacatatatttttatttaaaaaaatgagtgccaggcactatgctcatttgcagatgcaatggcaaataaaacaaacacagtctcttaatggatgtcttgccttatggagcttacagtctagtaggggaaatggatattaatcaaataatcacacagatgtaaaaccgcatctggtaagtagtatgaaggaaaaatacctagtgctctgattgtcagtagtggaggatttaacctggtggagaggtgagggaaggctttctcagatccatgtactgagacctgaaggatgataagtaggcaaaggggagagagaacagccttccaggagggaaccttatgagtgtgagggatggaaaatatgtcaatgtggctggagcacagagagcaaaggtgatgctggtttgagataagatggaagaagtggactgggaccaaagcgtagggaagccattttgagttgtaagcaagaaggatttgaggtgtggggattggtgatatgattattttgcattttaagagattatttctgactttagtatggagaactaaattgttggttggaagaggaccttagaaatatggtagatcaattaggaaataggtagtggaggagatagaaatgggcagatttagtaagtaaaatctatagaattggcaatagatttgaaatagggatgaggaagagggaagtggtaaggatgactcctagtatttggctcacataatgtagagatcagttgatctagattttttttttgagatgaggtcttgctctgttgccctggctggagtgcagtggaatgatcatagctcactgcagccttgaactcctgggctcaagcgatcctcccacttcagccttctgtgtggctgggactacaggcatgtgccaccatgcccagctaatttttattattatttttttttgtagagatgtctcattatgttgcccaggctggtgggctaggtttcgaagaaatggcagtgagttcagttttgggagagcagcatttacagtatttttgagacagagatttccaataggcagctgttggaggttggagcttagaggagagatctgcgctaaagatataaaataatatagttagattgaatgaaaggaagtagtgggaaatattataaagctatattatgggactagatatatcatggagggctttgaaatatagccttcagtctatagtttgggttttgtactacagttgtaaaccatagaagtttgaacagcagagtgacaaaggctctacttcaaaaagactaggccatagatgagttggagagggcagcggttagtgcctataccagagatacttaagactggaacaggtacatcgaggagagaaggggatggctggagagctgtcgtagaaaacaatatacataggtagacagctgactgggtgaatgggatgaggaagatggatgtgtcaaatggattttcccaggagcctggataacagagaatgataggaaaaggtttagggatagcatagaacaggaaagtggagtttattaatctgttcagttgttttttttttaagttcatattttacatatcaccccgtagcattaattatttaagtcatacttggcatctgatgagaattctctaaagttcagacttagattttaagctaggtcttcatgctgcttttgccataacaaaattcaggttgtgcatgggaatgtgaggctatgggttgtttttaatttattaatttggtctttattttcctttttttttttttttttgagacagagtcttgctctgttgcccaggctggagcgcagtggcacaatttcagctcactgcaacctctgcttcctgggttcaagtgattctgcctcagcctcccaagtagcttggattacaggagcctgccactacgtccagctaatttttgtatttttagtagagacaggctttcaccatgttggccaggacggtctcgatttcttgacctcgtgatccgcctgcctcggcctcctgaagtgctgggattataggtgtgagccaccatgcccggcctattttcccatttcatatgaagtttccagtatctgtttctaaaaagtaaagacacttaatgtaatcacaatatggttatcacatctaaatataaatgtacattaattccttaatatcaaaaatgcagtgttcaaattgccagttgtctcataaatgttaaatgttgcattttaaagttatattttatataatcaagatctatataagggtcccatggcaaaggttgatatgtctcttaaggctattttagtctacatattcactcaccatctccccaacctcccaccttatttgttgaggaaacaaggtggtttactctcagctcgattttgcggatttcattatcatcgtgttgcttgacatgttcttctgtcctctatttcctactgaggtgtgatcaatttagattagattagattttttttgcaagttattttgtactagactcagtggttaaaagtgtgttagaaaataagagctgctaaattgttacgtggcacagaaagtggtgggcaagcacccggcagagagagacatcaagggaattgggtggccctggttaagaatagcttaatagaggtgatcttagagaatgtgtgggagaagaaagcacatataatactttcagcaagaagaacatcatcaaggtagaaagggaaataggaagaatcagatttggagggctgtgaaagccaggcagaagaatttgcagttggtgatgctactaagtatggaactaccagaggttatagaactgggatgagatatgtagtaaaggtgctgttttagaaagacaggtttggaaataattcagatagagagttgaggactgagtttggagaatttggttggggcagaggaagggtggtcaccaaaaaaggaaatgatacaggatcagttcagggaaataggaagatgtcatagaagtttgaggaagagagggccgggcgtggtggctcacgcctgtaatcccagcacttgcggaggccaaggcaggcggatcacctgaggtcaggagtttgagaccagcctggccaacatggtgaaaccctgtctctattcaaaattcaaaaattagccgggtgtggtggtgcacgtctgtaatcccagctactcgggggaggctgagacaggagaatcgcttgaacccaggaggcagaggttgcagtgagctgagattgagccactgcactccagcttgggtgacagagtgagactctgtctcaaaaaaaaaaaaaaagaaaaggaagtttaaggaagaggttgtcaatagtgtcaatgtgaaattggaatttataagaattggggagtaggcatagggaaatattaattaaatattttatagtgaattattgatattattctcttgagttatttagacagtatttgctattttggggacatgttccttccccatttaatcttcttttcctttcttttctttgtttctttttttttttttgagacagggtctcactttgtcacccaggctggagtgcagtggtgtgattttggctcactgcatcctctgcctcctgggctcaagcattccttctgcctcagcctcccaagtagctgggattacaagcgtgcactgccacgcccagctaattttttgtatttttactagagttggggtttcgccatgttgcccaggctagtcttgaactccgagttcaggcgatttgcccaccttgccttcccaaagtgctgggattgcaggggtgagccaccgcgcccggccccttcattgaatcttacgttttggtcttataagtgccttaaagtattttataatacgagcagataggaaaaacattgggaatgcctcagttttattgtgaatgcatgggatactggaaacaaatagttctctgtttttaaatctgcgctctgcagctcactgaaacggtagagtgccagcgaatggtaaacgaacaggtggtgaggggactggatccttgatctctctttgggcctcttgcactaactcgcggttgaaatccctgagaaggactaggtgacctttaagggtcttcctaaatgctgacattctatgcctctggagttgatttttctcaggttagctgaagcataggtcccagccttccactgctttgggtagtttgactaaagtagagaagggattttttaaaaacatactagccaggcaggcgtagtgactcgaacctgtaaccccagctactcggaagactgagatgggagtatcacttgagccaaggagttcaaggctgcagtgcgctacgattgtgccactgcactgcagtctgggtgacagagtgagacgttgtctaaaaaaaatttaaaatacacaaactaaaagtttaaaattgtttatgagaaattgttattgtttgtatagaagagctattttcataccctctttattttggaagtgtaaacctttgtatttactgaagagtcaactaacttgtcttattgatagcttctcttcataaattctagtagttgaacctagatgctatctaagggattatttgatttggtaaaatgagattggtgatttttttattgtgtaagtcatatccagcaagtaggctgaggatctaaggtagtttgtgtttactaaaatttttcataaactttagagctgctaggattaaagtttctgttttatgtaaaatataattctttttgatgacagcattgcccatatgaaaactgtacatctcaactttttggtataaaaatatcaaatataaacaaaagtagagaaaatagtttgatgaacttccttatacccatcaccaagctttgccaatgattaatttatggccagtctagtttcatgtttctattgcacactctcccactccatctctggatatttcaaagcaattcccagataccattattttatccataaacgtttcagtattatctgtaagatataaggatttttcttttttgtatcttttgatgttttaagaagtctgtttgaggaaatactacaatttaaaattttggtcagtgatgaaacggttggcatttattttttaatgttatttattctgttagtattccatcctgaaacttcagccattatttggaaatacttgtgttattttaaaatatataacttcgttatttaaaaacatacagcgtgaagtttgggtaatttttaatatttaagaaaaataaaattgttatttatttggtctgtttttcatctttttagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcaggtgagaaactggggtttttctcaagtatgggcctttgtcaaatcacgccttaatttgttttaaatttacaaatttttatatagcagtttttgtctttttggtaatttttatttttattatttttttattttttcagatacccagacttcaaggagattttttttttttaatgttagggggttatagttaattttgttgggtgttatattttgattttggctatgcagaaaaatattctttttttttttttagacagaatctcactccgttgcccaggctagagtgcagtggcgccaactcggctcactgcaacctgcacctcccaggttcaagcaattctctgcctcagcctcagtagttgggattacaggcgcccaccaccatgcctggctaatttttgtatttttagtagagacagggtttcaccatcttggccaggctggtcttgaactcctaacctcgtgattcacctgccttggcctcccaaagtgctgggattacaggcgtgagccaccatgcccagcctcaaggagattttttgaccatttttaaataaatgtataaatgatctatctcaatatttgtttcctaatacaactttaagcagcctatttttgctccagatcaggggttggcaaactttttgtaagggccacgtagtaaatctttaagtctttgcagtccatatggtctctgtcacaactttttttttttaatgtcattttcaaggtaaggatctatcacgagtttcaactctatttatagtacaaaagcagtcatcgataatacgtaaatgaacgaacatggctgtattccatagaccttatttatgggctgcaggacagatttggtccaggggctgtagtttgccagttcatgctctatatcaagcttgtccaacccacagcctgcatgcagcccaagatggctttgattgtgacccaatgcaaattcataaactttcttaaaacattatgagatttttttgcaatttttttttttaaagctgattagctatctttagtgttagtgtattttatgtgtggcccaaaacaattcttccagtgtggcccagggaagccaaaggattgaatacccctgctctagatggtcatctttcctgtatcacggcacatccaaatctttttctaggctccttaccccagtaaatacagctctgtgcatgcacatgtttgtggattcaaagcccctggaggcatcagtgagttctgcagagacaggcaaattcaggcaaactgctgtattttttattcttttcatcttaggcttaaggcatactcatttgactcaagttaaaattatagttcctatttgtaaaagccgtatttattactacagacttaacagggtgtaatatacaataatctgataagaaattggaagtctttaaagaactatagattgcatatttcagagccacctgtggcgtgaaagttccagcctcagtaatgacctcaagtcaggcatactaaagcagaagaaccaaaaatacatcccattttctgaggtataaaagctggaaggatttttttcatggaatgtttcctcactatccttttaggctctgcggatactataaggagaagggtgtgtagactttatcactaaaaacgaagtcctgtcgccacccttgtaatgattttgtaagtgaaagtccttaagtctgtttttcagagaacatgctctatggttttagtccttttaaatttattgagatttgttttattctaatatgtggtctgtctggatgagtgtcccatgtgtgcttgaaaaaatgtatattcttttgctgaatggaatattctgtaaatgagaattaggcaaagtcgattgataatgttcaagtcttacatagtgttactgatttttttctacccttctattatttactaagaggagtattgaaatctccatctatccttgctaatttgtctttcttcttttagttctctcagtgtttgcttcatgtattttggagctctgttactactggtgcatatacatttctaattgttttatctccctgcctgatttattcttttattatgaaatgacttcctttgactctagtaatcctctgtcaatctgtctttgtatttaaagtggagctcctacacagcacatagttggatcttgatttttatctaacccagtctctgtctctgactttttttttttgagacggagttttactcttgttgcccaggctggaagtgcaatggcgcaatctcggctcaccgcaacctccacctcccaggttcaagtgattctcctgcctcagcctcccgagtagctgggattagaggcatgcgcctctaaaccacgcccggctaatttaattttatatttttttagtagagaaggggtttcttttttttttttttctccttttgagacagagtttcactcttgttgcccatgctggagtgcaatggcatgatctcagctcaccgcaacctctgcctcccgggtcccggttcaagcagttctcctacctcagcctcttgggtagctgggattacaggcatgcgccaccacacccagctaatttttgtatttttagtagagacggggtttcaccacgttggccaggctggtctcgaactcctgacctcgtgatccgcctgcctcagcctcccaaagtgctcggattacaggcatgagccaccatgcctggcgagacggggtttctccatgttggtcaggctggtctcgaactcccaacctcaagtgatccacctgccttggcctcccagttgctgggattacaggttgtgagccactgcgcccagcttcggtctctgacttttaagtgtttagttcatttacctttaatgtaagtgttggattgcttgatgttgtccttatctctgcctctaaaactatgttcttgttttttcccccaaccttgtttctctctaatctttgcattagataatttcttttcctttttttttttgagatagggtctcgctctgacacctcggctggagtggtgcagtggtgcagtggcgtgatgatcttggctcactgaaacctctgcctcccaggctcaagtgatcatcccacctcagcctccagagtagctgggactacaggtgctccccaccaatgcctggctaatatttgtattttttgtagagacagggttttgccattttgcccaggctggtttcaaactcctgagctcaagcagctgcctgcctcagtctcccaaagtgctgggattataggcatgaaccactgggcttgacctaaattagataatttctgttctgtcttcaaggttataaatttttttcttttgccatctcacctctgctattgaactgggctagtaaattttgcttattgtacacttcagctttagaatttccttttttttctttttccttttttttttttttttttttttttttttgagacagtctcactctgtcgtcaggctggagtgcagtggcacgatctgggctcactgcagccaccgactcccgggttcaagtgattcttctgcctcagcctcctgagtagctgggactacaggtgtgtgccaccatgcccagctaatttttgtatttttagtagagatgaggtttcaccatgttggccaggatggtctcgatctcttgacctcgtgatccgcccgcctcggcctcccaaagtgaaagtactgggattacaggcgtgagccaccacactgggcctggttcttttttagagtaaatttccttttcgagattccttatttatttacttatactatatttgtaaaaaaatctttggacatattcataacagctgctttgaagtctttaccaaatccaacacttaggaccacttggattcagcttctgttgattgcttttttcccctaaatatgaatcacgctttcctgtttcttttcatatctagtaatttttttaactgaaacctagatgtgtagataatatgtagtagtaactcctgaatgttttgtttctagaaactgctttattctctgaaaagtataggttttcttgttttagtaggcagttaacttgcctatactcaaactataaactctgtctcatgtgatgtgtggcagctaatgtctgctcagttttttcagctttgctgcttttttagtcctggaggtttaccctgtgcctttgtaatatagtggtcactcagggatttgggaagttaattctcagattttggggttcatcctttctgtggttctgttgcttctggagttcctcctctaagtttccagttgctctgccatctccccacgttttaccccagcacctaaagatggtaagacttcgctttctccaccctgggctttgtgcgtgctgtgtgctcaaaggtgaagcagatttgcagatttcaccaggagtaatcgttacttagtttcaacttctgtaaaatagggatagttcctaggattagtgtgaggattaaatgggataatacaaatacgacacaacacaaatacccaacaaaattagcttttcatttctactttgttaatattttgttggtaggagtggtggtgatgatgatttggaggttcttagatccataaaatgaggtgtgggttaatctgtgaggtgggcaaagggaggaaaaaagcagatgttggcagttactgttaacaggaaatacagtgaaggaaagtaaatgacaatagtaggggttataatcaggtagaattaaattttgattgcaaacattaggactttctgtttccaattttgtagatgcaacatctttttataaaggcaaactaaaaagatgaaacatcctttttttttttttgcttacttttccaaatgggaaaaaactggatatattctgcttccagtttcgtttaataatcagtgctgctgttttttataacaaacaggtgtttcagagttgtgaaccacaaattgtttaataagcctattctatattctacattagaatttgtagccagattggattattcatgattccacattacatgtggaactgctttgtaaactttaaaagctgtgtgtcttactaaggtgatttttaaaattgtggtgaaacatacatatttattattttaaccatttgtaagtatacaattcagtggcattaaatacattcacacacctctctctatacccaaaactttttcctcaccccaacataatctctattatgttcattccctatttccttcactccccacccctggtaaactctgctctacaactatatatatttgagtattctagatactttatataggtggaatcataccatttagccttttgtgtctggctcatttcacttagcataatattttcagggtctatctatgttgtagcatatatcaaaatttcatttctgtttatggctgaataatattccattgtacggccgggcgcgatggctcatgcctgtaatcccagcactttgggaggctgaggcaggtggatcacgaggtcaggagatggagaccatcctggctaacacggtgaaacccgtctctactaaaaatacaaaaaattagccgggcgtggtggcgggcacctgtagtcccagctactggggaggctgaggcaggagaatggcatgaacccgggaggcggagcttgcagtgagctgagattgcaccactgcactccagcctgggcgacagagcaagactccgtctcaaaaaaaaaaaaaaaaaaagttccgttgtatgtatagtatagtaatttgagaagctgatttagattgctctttttggtaaaatatgccaagttatagattttagtgttaaccttaagaaaaacctttaaacaaagagtaaataaaatcaatctaggtagtgttcaggtggaacatttaaattgtaagtaattaagtgtagattccatgtgagtcttaaaaacaaaactatcaaagtaagcatttgtgatgtgttacctaggctggagtgcagtgggcagtggtgcgataccagctttgcgccaccacacccagctaatttttgtatttttaatagagatgggttttcaccatgttgcccaggctggtcttgaactcctgggctcaagcaatccgcccgcctcagcctcccaaagtgctgggattataggcatgagccactatgcccggccagatgtatgtcctttttttatagatgtttcttcctgactagaaagcttcccttctgatttttctagatagctttcaggataatattcttaatattttcaacttcttgatttgtgtcttgtttcttctagctacacccttggcagattttcttctaaccttttgatatctgtttgcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaatttgtggttaatgtcatttcatagttgccattattttctcattatttgacttaaatgttaagccatttatttcatctccctcattcacataaagtgtagatatggattcaataagacaccaaaagaaagtaagatttacccagttaatatttaaaatcattgttcagtgattaggcattttctgccttttagaattatttgactggagaaagagtttcaaaaatagcagagccctaaaccataaagaaactactactgtataatgaacttttgtttgtttttggagacagggtttcactctactgcctaggcaggtcttgaactcctgggctcaagcagtcttcctgcctcagcctcccaagtagctgggattacaggtgtatgccactatacccagctttaacttttaaatccccaaactatgtagattgtcatattaatattaatttttttttgttattttgaagaagtgagtaatttgaagagatagaaacttagggagtggtgtgtgtgtttcttttttggagacagagtcacgcaggctggagtgcacgatcttgactcactgcaacctttgccacccaggttcaagcaattctcgtgcctcagcctcccgagtagcatgtgccaccacacctggctaatttttttcttttttcttttagacggagtcttgctctgttgcccaggctggagtgcggtggtgtgatctcagttcactgcaacctttgcctcccgggttcaagtgattctcctgcctcagtctcccgagtagctgggattacaggcacctgccaccatgcctggctaatttttgtatttttaatagagacggggtttcaccatgttggccaggctggtctcgaactcctgaccttgtgatccacccacctcagcctcccaaagtgctgggattacaggcatgagccactgttcccgggcctaatctttgtatttttagtagagggggtttatgccatgttggccaggctggtcttgaactcctggccaacaccacccacctcgcctcccaaagtgctggggttacaggcgcgagccaccgtgccaggccagaaatttaaggagttttaaaggttagcattgaaaagattactttccagaaattgagaccaccacagttccacaattgggactgtggtagataatcaggaccacttggaagcctttattaggaacagcccacacccagcccaaatgctgtcctcaaaaacattcctcagtttctctagctgaatgtaatctctccttgaaatttccctagttttatatatctatagttgactcatgctgtatttatttataccttgtttaaaattatttattgattatttattggtgtcatatcgcccctaaactgggacaggatctctaacggactcatctttgtgccacaacatgtaagcccaataggcaggtgctcacatatttgctgaaggaacagagaaagaactgcggagaaagacaaaagctcctctgaagttttagactatagaagcaaaaattatagtagcaaaagatgaatgagaaattctgttctagtcccagtgaagcaggaaggaaagggttgcaaacttgaggctggtaaggaagaaataattactgtgaatgcatttagccactcccctctactcaaaaatactggtaaactctgatttttatatttgtttagaatttaaattagaattctgtatctttattttttggaattctgttgttttgccttagtttcttaataaaaagttaaacattaa

SEQ ID NO: 2133 - DNA, 5977 bp, Homo sapiens
gtaattattttcagttttatttaataaacatcaatttccttgtagaaaacatagaatttctaccaactaaacaatattgtaataaggataaatgtatcaaatcacagataatgttgttaaacgaagatgctgtcttgcagatccattcatgaacaggcctaaactggcagtgcctattgttcatttattatgggtggatttcccattttacaaacaaaccttttatttatgggaagaggttcagcgtttcgcaatgtctttagtatgtatttcccgataccggaggggcagaattccccctctgtccatcaagtgacatctgcttgcagctgtagggaattttgcagggtactcttttccagagataaataatataaagatataacacataagaggtaattccctggtaaccatatatgtcccccaatcttgtcttgtcaaactataatttgcttatggttcctcaaaaaaaaaattgtttcttgtccctttactacttcccctctccttcttttcagttgctcttatcaggaatcctacacaagcatctacctaaacactactatttcaagggccaggccacctcctatctctttactaaaggacaaagtcttcccttactattctactctacagtaatatatgctctggccttctttagcctttatcatgcatttggcactaatgtttgtgttgcttaatactgctaattagcttttcacaggttttgacatcttccagtcagattgtaagcttttttttttttttttttttgagatggagttttgctcatcgcccaggctggagtacaatggcgcgatctcggctcactgcaacctcagcctcccaggttcaagcgaatctcctgcctcagcctcctgagtagccgggattacaggcacccgccaccacgcctggctaatttttgtatttttagtagaggcgaggtttcaccatgttggctaggctggtctcgaactcctgaccttaggtgatccacccgcctcagcctcccaaagtgctgggattacaggcgtgagccaccgcacccggcatgattgtaagctccttaaaggcagattcctttattctgtttttcccatactcctcatgcacctacatagtagatgctttaaatgtcctggttttgaaaagtaacatggtcaatcccctataacccaacatatttagtattctttacagcttcttccagaaccagtctggtaataaacatggatattctgctagcccaatgcatgttttgagtgtttggtatcagaactcatcagctgactctgtgtcccagccacaggactgcagttgatcgtcctgtggaaattcaacctcaatgtcataaacaaaatttggatcatccttcttcttctgatttttctcaaaaagttcatccatgatgctctttcttttggcaagctccttgtcatctagtttgttcaggtcttcctcaggatcaatggttgtttcccgttgaatttgttccattgtttctgccagactctgccccgacaagtaacctcgtaaaaaactgaatagcttctctagctgcctcagggatacttgttctaggtaactcttgtgtcgcggattattctttaattgttcagcagctctggtgcaatctgggagagagaagaaaactatataccacatacgtaccacgtacatcatatacgccataaactactgcaacagccaaaacagaacaaaaactctgaaccctgaaaatattatctccattatagtcaagtagctaaatggcttgattggaatgaattactttgtagaaccattcctttatattgagctttcagtgtggtgggagaaggacagatacagttttgacttctttaacttaaaaatcactttgtagagatattaaacactttcaactggagaatatgtctgagaagaaaagtgatattatagcttttagatagcagtagtggtattaataaaatattaagactacaaataaaaaacatttggaatgagagaagggaattaatattattgaataatgctatatcatttaacctaggcagcaatcccaaaaggattattaattatcagattggaaaaaaacactacaattcccttttatagattaggaaactgaagctcactgagagtaagtaattcatccagtgtcacacatccagtccctgacagagtcatgatgtgaacctgtatttagagaatatttaagacaggaggcaagataagacatgaggtacctgaaaactttgaaaagtttcgaactggcataatgcgctggcgaattttccccttgatttcactctcatagattaagataatagctggaggctgaaacctaatcccacatttcttggcagtgcacatcattcccatgtacatgtccgggtaagtcagaggaaatctgatgaatatgtgtaagttgcataatgacttcctgctaaagggaaaaaacaactaggtgttggataaatgtcattcattcccctcgcccctttgccccagaagatctggttctagtccggctctggccacacacgctcagcctgtgaaactcattttttttaaaattaaaatacggactgcttcatgaatttgtgtgtcatccttgcgcaggggccatgctgatcctctctgtatcattccaattgtggggtatgtgcgcgggaacgaccacaaagctcagttattttgagaactgccctgaaagttcagcttggccctgggttagtttcaacctgttggatccctaagatctggttttttcaaggatatagacttgttcatatgtgaatctggggatgcaatccagtttgaacctcttagtgtactgcactcttactgaagatcgaatatgaacccctaagtcagcccaatagctgacctatagggtctttactatttatcaattaagaaagggcatatcgagcatcctcggtatcaaggtactatgataaggtaagttttttaaccttaatcattttgtcctgagaggttcaccaatccagaactgtctcctttgtactttcccaattattttactagagttttttgtcattatttatttaatcatctatcttcccttctagtcaatatgctccatgagggtggggggcatattcattttccaccacaatatctcagcataatacctggaacgtagtgggcattccatacattgtttaatgctatgaattaacatgatggtccctgtacatttttgaaagcatttacagtctagaagcctgatcaaaaagcagacctgctgcagaatcagcttcttcatatacacgtcagtaacgtctgcagctacatcatatacatcacatatctcagcttcttcatatacaatagtcagtaatgtctgcagggcttttattttggcctgtgtgtctcactatatgataattttctagctacaagaaacagctatttgtagatgaatacttactattctctcttcctttccccaccctcagtgcccaaagaatacacttaaccctaagcactgcttttgatgtgactgtgacattcccagaaagatttgtaaatgtcaagaaacattgaggtaaagtggcatagggtgatgatatcttcgtgaactcagttctgctggagaatcactattaggaacatactttttattaaatacttagcagtgattatacacgtcattgtagaatactgggggcaaaggagaggggaaacctatagaaaataatcacccttgattgtgtccagtcttttttctaggcatatagtttatagtatgtttcatacataccttatcatacaagctatttcctgacgttcaaatttaacaacatatattattattttgtcatcaaatgttttactacaatgtaacattttatatgactgctaaatgttttattttatggatgtactataatcatattattcaccacttattgttgggcatgagaatttttactcttagaaaattaatcacatataagcccaggcacagtggctcaccccagccagcactttgggaggtcaaggtgggcagatcatttgaggtcaggagttcgagaccagcctggccaacatggtgaaaaccacgtctgtactaaaaatacaaaaattagctggacatagtggcaggtgcctgtaatcccagctactcgagaggccaaggcaggagaatcacttgaacctgggaggcggaggttgcagtgagctgagatggtaccactgcactccagcatgggtgacaagagcaagactccatctcaaaaagatggaggcaggtgtggtggctcaggcctgtaatcccaacactttgggaggccaaggagaggagataccttgaggccaggagtttgagaccagcctgggcaacacagcgagaccatgcatgtctctacaaaaaatttaaaaattggccaggcatggcagcatgcacctgtagtcccagccacaccaaaggccaaggtgggagaatcgcctgaacccaggagtttggggctgcagtgagttgagatggtgccactgcacaacagcctctccaaagcatgatacgcctattcttaaaaaaaaaaaaaaaaaaaaaaaaaactactttaaaaaattactgtgctctacctctaatctgatgcaatgagctcacaccatttctccttcttttccttctcttttcttgctttttttttttttttaacgaatactattcccaattcacctaactaaaatttgatgttagtaaactacaacctacggggcacatataaactccacacactgaagcaatggctgtactcgtcaaagatgtatgcagttggtactcaaataatgtagttttttttttactagactctttttaaaatttaactttaatttttgctaaagtaatgtttgtatttggaatataaaataattctatgaggcttataacaacaaactatcgtccttggccctactcctcttcatagggagccagactgaattttaaaaggcatatcttccaaaatttctctctccatttcttaagaaacatgcttatactaccattttcagtttttttttttcttttgaaacagagtctccctctgtcgcctaggctgcagtgcagtggcgtgatctcccctcgctgcaacctccgcctcctgggttcaagcgattctcgtgcctcagcctcccgagtagctggaattacaggtgcctaccaccatgcccagctaatctttgtattttcagtagagacggggtttcgccatcttggccaggctggtctcgaactcctgacctcaggtgattcgcccaaagtgctggggctataggcgtgagccacctgcccggctattttcagttttggatagtatgttttgacatacactctgtttcctctttgagacacccgctctagagccctctattccactccaagccgcctggatgctctcttggcctgcttacagattccactctgtttaggaagaaggacggcacgtttatccaattattcttcctggacacgaatactcctctccccagagatcagtaactgcccacaatcttgttaggaagccccacagcacctaagggtacgaatgtccccaaagagtagacgattctctccctactcacgtctccactagtgcaaggctggctttcttacccttagaggaatacagaaatgacatcgtctgcaggccaacgtctaaacaaccaggagtgggtttttccacccaaccgcagtgcacgcaaagcccctaagccgactgtgagaccgggcggagcctggcgctgcaggaagaggcgacagccacagccctactgacgagcccgaggggtgaactccccggcgggaggcccgaaccctcaaacaccgggaagcggaggtgggggccggctgggggaccggtccaccggctcccacctcggcgtacagggattccaggtcccggcgagcgctggcctagcggtttccacagcgacaggc

SEQ ID NO: 2134 - DNA, 78978 bp, Homo sapiens
tttaaatttgagatggagtgtcgctttgtcgcccaggctggagtgtaatggtgcgatcttggctcactgcaacctctgcctcccaggttcaagccattcccctgcctcagcctctgagtagctgggattacaggtgcacgccaccacacccaggtaatttttgtatttttagtagagacggggtttcaccatgttgctcaggctggcctcgatctcctgaccttaggtgatctgcccacctccgcctcccaaagtgttgggattacaggcatgagccaccgcgcccggccttcctggtagtttccattccatctccctgtatttttctcttatcactctcgaagtctatctttcttgttcttttcctccctagctttttttttttaaacactcctttcaagctgtgtccaacacccacaaggaatgactatttttaactaatcttactgacctcatttaatctattcaataaaacctctgccctaaggagcaaagaaacttgcagaggaagtaaggcaaactggaagaagcatactgtcagcggattaaattcttgagcaaggcaatactccttatggattcttcccatgtacaatccgtaactcttcccatgggcctttatatcaaccctaagataattacactcctgcctcaaaataaaataaaataaaacccaccacatcttgtattgtagacatcccagctgcatgttaagctgagtgaaagtaccatgctgtcttttaaatcactttatatctacttaatcatcccacagtaacccgagttgaagaagttactttggtttctcataaatgaatatgcacgtgctgaacatatcggaaagaaccacaccctctcactgatgaacacgttggcagttctcccaactgttttatcaagagaagctagaaggtaaagaaaaggaaacagagccctataggaaaaatgattgacttcacacgtttgagcgatttgggcttcagctatgactttgctggagtacagatgggtgccatcagagcacaaagctgagcaaacctctcttcttaccctgtgccctccctgaatttttggatttctgagcttgtctactaccaacaaatgttttaccctccagtgcacctttgacagtatacagctctatttttcaaacggcaagtatgttatccaagttcagagatgcaactgaggaattaacatgaaaaccatctttcactcaataaatcagaagctgctagttaagtaagcctcaagaacctaagaaaaaacaccaaagtgtaagtattactcagtcaccaatctaaagacagaactttgactcaaggtagaaatgaaaccgtaattatataaatatatttataaatatttatacaattatatacttatacataagcacttacacagacttagaaaaaaatttaagaacattaattcaaaaggactcactgaagaataaacagatttttccatgatttccttgaggagatataaaactcattctttagggagagttcctcaaaattcaaccattagaaaccatatcctataactgtgtactagcaacacatggcatctttttttcttcttttcccaaatcccctaattgccaagagagcaatcttaaagtagatgaaaacctaaaggtctctacgcaacatctgaggaacatacgctcctcagataaaagaatcaatctaaatcctcaactgacaaaaaggtccatttaatatttttcattttacaagttaaaagttctagttttgccaccagaatcacgactacccccccttcagaggactccatttaagctcaaaatacgaaatgagcatagggtgaagttgatgtgtaaatggtattctacagattcaagatggcctcttctaaaaacactgaagaaagctttcaccaactctaatttgattttgggttttgttggcagaaaaagcccaagacatctgaaaattactagtaacctccgccatcctccttactaaatgttgtcttctgaatggagttgaaaggtcttccccttagagaggctttccgttttgataccttttgaaagaaaacagcatgcggactcatgttcaattcagtcaccagagccttttagagactattccaaccaggggcaaaaaatgaaccattatttctaaccaaaagaacatggttagcaactctcagctgaatggttttctttttccccagggacatacctaagtatgcctgaaacaacacaggacaatcaataaccatagtggttacaattccaagccattgtactacatgattattgaccagctgccttcctacagatcactgcagactcagacaatggagggctccaaaggaactaatatgctgtgctggcaaaaatagcaagcaccttcctatcccagtcaccacgataggttcacttcatgtccattcttggactagcaggatcaatacagagtaataaggaaaactgtctcaggttaggacaatgaaagtcaccccatgctatatgctccatatttaacactcattctgccaataacacatgtcatggaaatagtccttatagctgggaacatgaaaatcctttgaaaaaggtttttaagtatgatgagcaatcattacaagggatgctttttccacgtaaacaaaagcctggatattttgttaagcgacatttccacatgaagaacacaacaaaaccaaacccatgttagagaatttcttctccctgctaaacacggggacttacaaaaaagggagggttgttcttactctgaatctagccattcctttgcccgaagagtctggggagtaacgttaacatttgatcccaaaaaagtgccgtgcaagagaccacttactggaacacacaattcctgctgctagtactaggagaggtcttatccttacacttcagtttggtcaccagattaggtaagaaagaaaagtgtggggggagggggaggcagaagggtacggagtggggagcgagaaaacagaagaggagaaagaaacaaagggggagaaagagactgattataggagagatcaagaaataagagaaggaaggtgacttgcttgcccaactttggctctgtggtcctatgagccaaaatgcatacttagtgacatgtatctcacaggaaaagggaaaaaaggggtaagctgagagaggtcaagccatggtgttaatttctttcctgtacaaagacagtctcttgaggacaaaggcctgcctcttgcaatgtaatatcatagtccagatgagataatttccttcgaggaaagttggtgagaagttcaaaacgttcatttgggtatcctttagactgcacgtgcttcaccaaagcctataaaaacaagagaaagacaaagccattagacggaaaaagaggaaagagcatattagtgaattaaatagaaaacattctctttttaatcatattagatcagctattaaatgtaagttcttctttcatataaccaaagcttgcccttggggaagggccaatataaacctttggacggggagataaatctgaccccaattacttacagccattaagtgatactgaaatacacagttattatttggctccccaataaatatacccagtcactattcataaaattaaattattgttctcattttaaaacattttatccgttttcctttctcccttttatcaaggaagatatgtccttcattctgcctacacccaatcttgccacctgtgcactgaatctcttcttgccttctcagaaactggaccattcccatcttttgcaggtttcttcaacatctccctctctgcttcccatcaaacttcaacactgcttgcatttcagtaacacagtcttcaagaatcagcctaattatctccagccacagcaaacggccagcaatgcctgacgcaagggattcattcacaggctaagctaagctaagctagtcagactcaagattctgtttccagcagttaaaaacagagggtgtcggggcacggttgctcacacctgtaatccctgcactttgggaggccaaggagggggacagcttgagcacaggagttggagaccagctggggcaacatggcaaaatcccatctcatcaaaaaatatgggccaggcatggtggctcacctgaggtcagaagttcgagaccagtctggccaacatggtgaaatcccgtctctactaaaaatacaaaaaaattagctgggcatggtggtgcgcacctgtaatcccaactacttgggaggctgaggcagaattgcttgaacctgggaggctgaggttgcagtgagccaagatcatgccacccgcactccagcctgggtaacagagccaatcttcatctcaaaaaaagtaaaaataaaaataaaaactagccgggcatggtggtgtgtgcctgtagtcccagctaccgggaaggtcaaggtgggaggagaatggcttaagcctggcaggcagaggttgcagtgagccaaggtcgtgccccacagcactccagcctgggcagagccagatcgtgtctacaagaaaaggaagaaaaaaacaaaaacaacacaaaccaaaaaccacagaaagctcatcagctgtgttagatgaaaatgcccgcagcgtcaccatgatgaaccacgtgcgagctgaggaataaacaaaagccaccagtatgcagagaatggtgtgaagcagagaatcccaagagaaaacctacaggccccagaagagaaacatagagaaaaacagacacagttcttaaacactttgcagttccagctgctggaaaaccactatcctcttcaaataaccccagtcgtccttttccagaagtagtcatttcagttgggtttctattccatgcaggcatgaaacagaaaaatcttcactggaacataccttacgtggcttacctaatttaatctgggaaggaaataaactaattagaattaagattcacaaccgggtgctcccacctgtaatccctgcactttgggaggctggggaaggaggatgacttgagctcaggagttcaagaccagcctgggtaacatagtgagaacccttctctacaaaaaagaattttaaaaaattagctgggtgtggtggcacacacctgtagtcccagctacctgggaggttgaggtgggaggctcgcttgagcccaggaggcagaggttgcagtgagctgagattgggccactgcactccagcctgagcgacagagcgaccctgtctcaaaacaaccaaccaaccaacaacaacaagatgactcaccacagtttgcagttagagatcagactaaacatctaacacctctttctttttttttttttttttaaacagagacagggtctcgctttgttgcccaggctggtctcaaactcctggactcaagtgatcctcccaccttggcctcccaaagtgctgggattacaggagtgagccactgcacctggcctcccacacctatttcaaagaattatcaagcaaagctcactgaacttactccaatgaattagcttctctgcttcgagaaaatgcttccaacgccctgtttcattgtgcttcaagttactgaaggtctgcggcaaccttgtgtcaagtgcctctattggctccatttttcaaacagcatgtgctcactgcctgtctctgtgtcaccttttggtaatgcttgcagttcattattttatctattataatgaactgtgagcagttacctttgatgttactattctgcttttgggcaccacaaaccacgcccacacaagaccgcaaacttaataaagaagtatgttctgactgctccacctaatgggagttttcccatctctctccctctattcaggcctccttattcccggagacatgacagtattgaaagtaggccaattaataacctaccagtgtaggcctctaagtacccaagtgaaaggaagtgtccatcctcaaaatcaatcaattgctaaaaatgatgaagcttagtgagaaaggcacgtggaaagctgagacagacacaaagctaggcctctggcaccaaacagccaagctgtgaatgcaaggaaaagttctggaaggaaattaaaagtgctactccagtgaacacacaaatgataacaaagcaaaacaggccgggagcagtggctcacacctgcactttcagaggctgaggtgggtggatcacctgaggtcaggagttcgagaccagcctggccaacatggtgaaaccccatctccactaaaaatacaaaagttagctgggcgtggtggtgggcgcctgtaatcccagctactcgggaggctgaggcaaggagaactgcttgaacccgggaggcggaggttgcagtgagctgagatcgcaccattgtactctagcctgggtgacagagcaagactctgtctcaaaaaaaaaaaaaggaaagaaagcaaaacagccttactgctgtgctgctgaaaaggagaaagttttagtggtctgtacagaaaaatcaaaccagtcacacattcccttaagccaaagcctaatccaaaacaaggttctaactcttttcaatcctatgaaggctaagggagttaaggaagctacgaaagaaaagctggaagctagcagaggttggttcatgaggttgaaggaaagaagccatctccataacatcaaagtgcaaggtgaagcagcaagtgctgatgcagaaggtgcagaaacttatctagaagatgtagtgaagacagttcacgaaggtaacaacactaaataacagatttaagtttgacaaaacagccttctattggaagaagatgccatcaaggactttcacagctagagagaagtcagtggctgcactcaaaggttcaaaaaggctgactttcttgttagggggtaatgcagctggtgacttccagttgaagccaatgctcatttaacattccaaaatcccaggtcccttaaaaattatgttaaatctactctgtctgtgttctgtaactgcaacaacaaaacctggaaagacagcacatcaatttacagcataacttactaaatattttaagcccactgttcagacctactgctcagaaaaaagattcaacatattactgctcattgacaacgcacctagtcacgtaagagctctgacgaaaatgcaaataaaaatgaatgctgtttccagtctgctaacccaacatccattctgcagcccatggatcaaggagtcatttcaacttttaaatcttatttaagaaacacattttggccaggcacggagccaaatctcaacactttgggaggctgcggtgagaggattacttgagtccaagagtttgagacaagacctggcaacacagcaagaaaccatctctaaaaaaaagaaaattaattgggtgtggtgatctactcaggagggtgaggcaggaggatcacttgagccggggcggggagtcaaggttacagtgagctatgaccactgcacaccagcctgggcataaatacagattcctttgatgaatctgggcaaagtaaactgaaaatcttctggaaaggattcagcagtctaaataccattaagaacattcacaactcataggaagtcaaaatatcaacatgaacagggctttggaagaggttgattccaaccctcatggatgactttgaggggtttaagaattcactggaggaagtcactgcaagtggggtaaaaactgcaagagaactagaattagaagtggaggatggcgatatgactgaattgctgcaatctcatgatcaaacattaaagggaggggggttgcttcttatggatgagcaaagaaagtgatttctggagatggaatctacttctgctgaagatgcttttaacactgttgaaatgacaacaaaggatttagaatattgcataaacttggtggataaaattgcggcaaattctgagaagactgactccagttttgaaagaagttctactgtgggtaaaatactatcaaacggcagcacatgctacagagaaattttttgtcgaaggaagcaactgatgcagcaacttcactgctgtcacattttcagaaactgccacagtacccatcaccccaatcagtcagtagccatcaatatcaagaccctccaccaacaaaaagatgactcactgaagattcaggggatcattagcactttttagcaaaagctttttttaattaagttatgtgcttttttttagacataaagctactgcacacttaatagactatggaataatgtaaacataacttttatatgcaccaggaaaccaaacaatttgggactcgtcttattgcagtggtcggaactgaaccaaagcaagcctgtacttactagcagtttagcttgctctggaagagtgatctgttccctttttccatctggataccgcaacatcagctgtgcttttggtcctaaaggaagggtttaaaaaaaaaaaaaaaacgggatacaggagtttaagacagaatattagtttaaataaatatgtaaataaatacagccattcagcaattactcaagtgttttgctggagtgcagtggcgtgatctcagctcactgcaacctccgcctccctggttcaagccactctcctgcctcagcctcccaagtagctgggactataggcacgtgccaccacacctggctaagttttgtatttttagtagagacagggttttgccatgttggcgaggctggtcttggaactcctaacctcagtgatccaccacgcccggccccaatatctaagtttgaagtaaagtatgtctaaatgtaacttaccatttacatctatcccctccactactccatctgctttttcaggtggcatctccagtatctctgaatccacagctggcaatccttggtggtttgtggctgttccaggatcagttctgactggtggctcagtcagcggccttctattctcctcttttctatgccccaaatctttgtggggagactttctggacttggcaagattctctacctcttcttcttcatcagagccacaaacggatatgaactcctcactgccagaaaaaagttcagattcagattcttcatctgagcggctatcctgttttgtctgtgttgaatcaaaatgtgtttcttgtaaggaggctctgatggcagcttctagctggctgtcttcacttgcatctataaggctctcctgtgagatggagtcataaaacacaggaaaaagaacaagttaaaccaaaaaacaagtcaaacggcataagaaatataatagcttgccattcattattatgttctgctgactgtatcccttctactttaagagcaaggactgtgtcttacacagccaaattggaatggagatatatatatgtgtgtgtatatacacacacacacgtttttgttgttttgttttgttttgtttttgagatggagtctcactcttgttgcccaggctggagtgcagtggcacgaactcggctcactgcaacctcagccttcccaggttcaagcgattctcctgcctcagcctcccaagtagctgggattacaagcgcccgccaccacgcccagctaatttttatttatttatttttttgtatttttaatagagatggggtttcaccacattggccaggctggtctcaaactcctgacctcggcctcccaaagtgctgggattacaggcgtgagacaccgcacctggcacatacatacatacatacatacatacatacatacatacatacatacataaatatatatatacacatatttttttttctttctttttttaagagacagggtctaagttccccaggctggtcttgcacttctggattcaagtaagcatacgcatttttttaaatatcaaaatgaaggccaggccgggtggctcatgcctgtaatcccagcactttgggaggcccaggtgggtggatcaagaggtcaaaagatcgagaccatcctggccaacatggtgaaaccccgcctctactaaaaatgattaagcttagtgagaaaggcatgtggaaagctgagacagacacaaagctaggcctcttgcaccaaacagccaagctatgaatgcaaggaaaagttcttgaaggaaattaaaagtgctactccagtgaacacacaaatgataacaaagcaaaacaggccaggcacagtggctcacacctgcactttgggaggcttgaggcgggcagatcacctgaggtcaggagttcgagaccagcctggccaacatggcgaaaccccatctccactaaaaatgcaaacatcagctgggcatggtggtgcgcgcctgtagtcgcagctactcaggaggctgaggcaggaaaatcacttgaacccgggaggcagaagttgccagagattgcgccactgcaccccagcctggtgacagagcgagactccatctcaaaaaaaaaaaaaaatcaaaacgaacaaaatcaagaaaagtttatctattacctgcctagagaaagacaagaattaaaagttttaactataaagtcaaaacaccattctttaaaatgactaaaacatagagacaaatgtttactttgttcaccactgcattcttcaactagtaattccattaattacaatgaaggttttcattatgataacaagaaatgcaaacttctacagtttttcccttggtaaagttctaatgccacagattttactaaacttaatgaatcacaaaatacgttgtttgagtggaacttacttagctcctgactcaaacatactatagaggaaagaaatcgtaagataatctaaaattgaacactggatatttcaggatattacagaattactgctcatttttaagggtataataatgacattgtgatagtatttttaaaaataaaaaaggctttatcttttaaatatatatgccagagtattaattaatgaaacaatgaattctgagattagcttcaaaataattcagatgtgatgggatacagaggaaagaagactggccatctgctgataattaccgaaattagctaacaaagaggctcaataaactacttcaacttttgaatatgcttaaaattttccataataaataggtaaaaaaaaaaagtgtgagttgctaataaaaaactaaagaaaccacattttggcttttactatcaggcaatcatgtagcaaaaaattaaagggaaaaacatttttttgctggttgttttttttttttgagagaggttctactctgtcacccaggctgaagtgcagtggcacaatctcagctcactactatctccacctgccaggctcaagcaatcctcccacctcagcctcccaagtagctgggattacaggcacacaccaccacacccggccaaaggaaaattttaaagtaaacttcaggcgaacttaccacccctaaaaagcaagtagaggtgtctatgtgacatgcaatggcttaggtggattgtaaatttatagcaatgacattgcacatatagcatgtagctcgattttaaaaattgtggccatggcagacactgtcaggctcctattgaatttcattctcctctgatttccttacttatataaccctatttaagtttataaaacgtgttcaactaaaaaattcattttactaatttctcttgtagctagaaaatagtattgagcaatagcaattcttatcgaaaaattatagaattaaatgcttatattagaagagagaaaggtatcaaattaatgacctaagcttccccaccttaaaaaaaaaaaaaaaaagagtatacatccaggaaaagaaaataaaattaagctcaaagaaaacacaaattaataaatgacctagaaagcaaatacaatagagaaaaacaaaaaaaacccaccaaaatcccaagagcagttttttgttttgttttgttttttgtttcttaagagacagagtcttactgttgcccaaagactggagtgcagtgactactcacaggtatgatcatagcacactacattcctgaactcctgggctcaagcaatattcctgccaagcagatgggactataggcacatgccacaccccagctggttccgtaagatcaataaaactactaagcctctggccagacagtcgggggaaaaaagggaagccacaaattcccaaaaacagaattaagagaggggacaactacaatctctacattcattcatggcatcacgagggactataatgaactctgacaatatagtaaaatgaacaaatccctagaaagatacaacttgctaaagcttatccaagaagaaacagataccaagtagtcacgtatctaccgataagattgaatttgtagtttaaaattttccaccaaaaaaaaactctaggcccatgtagcttcactggtaaatgtcatcaaacattaaggaagaaataacaacaattctacagacactactgcagaaaacagaagaggaagaaatacttctcaattcattgtgaggtcagcattaacatgttaccaaaagcagaaaacgacattataaagcattacatggaagaaaggaaacaacaacaacaaaatgctctcaaaaaaactataaatcaagcaggagaactgcttgaggccaggagttcgagaccatcctggccaacaagatttctatactatcccttagggcttttccttaaataggcactttattataggtgataactgaaggaagtgttcctcacatcttctaaaactatttttaggctgggcatggtatggtggttcatgcttataatcccagcacttcgggaggccaagggaggagaattgcttgagcttaggagtttgagatcaggctgagtaacatattgagaccctgcctccacaaaaaataaaaaattagccaggcatgatggtgcacacctgtagtcctagctactcaggaggctgaggcaagaagattgactgagcccaggagttcaaggctagcaagttttttttttttttaaagttctctcaaggctgcaaagactacagtgagttaatatcatgccactgcagtccagcctgggcaacagtgtgagaccacatctcaaaaaatacaatacaatacaataaatacaatacaatacaataaaaatgttgctaggtgtggtgctcacacccagaatcccaacattttgggaggctgaggcgggaggattgcttgaggccagtttgagaccagcctagacaacatacggaggcctccgtctctacaaaactttaacagcttagctggcatggtgatgcacatctgtggtcccagctacttaggaggctgaggtggaaggatcgcttgagcccaagaggtggaggctgtagcgagccatgatcacaccactgcactgcagcctgagaaatggaacaagatcctgcccaaagaaaaaaacaggacgggcgcgttagctcacgcctgtaatcccagcactttgggaggccgagaagggcggatcacttgaagtcagcagtttgaaaccagcctgcccaacaaggcgaaaccccatctctactaaaactacaaaaattagccagatgcagtggtgtacgtctgtaatcccagctacttgggaggccaaggcaggagaatcgcttgaacccaggaggcgaaggttgcagtgagccaagatcacaccactgccctctagccctagcaacagaacaagactctggctcaaaaaaaggaaaaaaaaaaaaccaacaaaacaaaactatttttatccctactgctatcaaagccaaacagccatgaaaaccaatgtgagattgctgtatctttgcaagttcagtctcttatttgcaaccaatcttgataccaattatcaaacatgtctacctagtaatagtatattctagaaattaagtatagaagtaaattctaggagggccagagagccaggccctaaagctatattaaccaataaaaatgctcaactataccatgacagttgtttcagcaaaaacaaaaaacaccacttccagccggctgtggtggcatgtacctgtagtcctagctattcgggcagttgaggtgagaaggctgcttcagcccaggagttctaggacagtctgggcaaaacagcaagatcccactccaaaacaaaaaacaaaacacacaaaaaaaccaaccactttcactgctatttagacctggatatcagaagccctcccagagctgcccctcaggaagtagacacctttaccactaggcttgccaggtcagtcctcctgcccaacctattcacattgcttccttctaaatccagatcctggggcatctgcctgcactctagctgcaagacagactggcaggagtatgagtatcatgatttcaccaagaagatggaactctcatgtgggaaattatcaaaatataaggaggatatctaagatgctatagccacagtgatagttgtccactagttagattatctttaccatcttaacatcgaacattttatataagatgcttatgaccaattacatttattttcccatcaccacctcctaattatacttactgaacgggcacattttttggggggactgctagaaagtccatccagttgtccatgttcacccagaaatcccgtcacttggtccaagaaagaagatacatctaactggtgccattctactagcttctgacctaaggattaaaaaccaagatctataaataaatataatatctagaatccttctgaacattctccaggatctataaatataatacctagaatccttctgaacactctcattaagtatctctttcagcatatgcatagattaaaaacctggatctataaaggtaatatctagaatctttctgaacattcttattaagtatctctttcagcatatgcatagattaaaaaccaggatctataaaggtaatatctagaatctttctgaacattctcattatctctttcagcatatgcatacattaaaaaccaggatctgtaaatataatatctaggatctttctgaacattctcattaagtatctctttcagcacatgcataaagtgtactgtaaagacatatcctctccaccagcttatgctacatagtgtcttcataacctagaagtcacatcaattatactcacctaacagattcccacccgtaatgatagggcaactatcttatctgctgctatcacttactgccatttaggaagaagagattcagacaaagcaatatctatataaaacaccatcaattaataaaaccagctccaccctctgcttctcaggtgggattacaactagtatctgggcaatcttaatattttaatgataaaaaaaacttttgtcttgttttgtttttttgagatggagtctcactctgttgcccaggctggagtgcagtggcgcgatctcggctcactgcaacctccacctcccgggttcaggccattctcctgcctcagcctcccaagcagctgggactacaggtgcccgccaccatgcccggctaattttttttgtatttttagtagagatggggtttcaccgtgttagccaggatggtctggatcgcctgacctcatgatccgcccacctcggcctcccaaagtgctgggattacaggcatgagccaccacgcccagctggtaaaaaaacttttaaaaaatcccttaaaaaaggtaagatgaacatatcagttattcttcaaaagaacagaactgcacaaacataaaatactaccatctcccaatgttgccagaaaaagatgtcctaaatacatacatcaatagatgtttaaataattataaagggaaaaaaacgaaaccttcacctaaattactgcaattctgaaaacagatccagtcaaatattaaagatcaatcatttaggtaactgaaagacaagtaataggttaaaagctgcgtgctgatataaatcttacctgtccgtgggtccaatatggaaacataggggaaatcccctaacttataaaactgtatgtatctctgaccttcctcactgtcatgataaacctgttaaatcattgatataaaaaaaaaagtcagcctctaagaaaagaaccaactataaccttcttatacaccaacatcaattagctctccaaatatacctccggcctatgtattaagatctcactcctacactaaaaagaaaataaatctggtttgaactccttcaacttcccacttccagcactctctggaaatttaccataaacatattgacccattcctcctcctttcccagttcagatgaggtattattcttcctgctcaagttatctgtcaactatgtcattcataactctcaaccatatacatcttaataaatcacaatatattaagattatgggccaggcatggtggctcacgcctgtaatcccagcactttaggaggccgaggcgagtggatcacaaggtcaggagattgagaccatcctggccaacatggtgaaaccccgtctctactaaaatacaaaaattagccgggcctggtgacaggcgcttgtagtcccagctactcgggagactgaagcaggggaatcgcttgaacccgggaggcagagactgcagtgagctgagatcgtgccactgcactcctgcccagcgacaatgcaagacttgtctcaaaaaaaaaaaaaaaaaaaaaagattatggctccacatggtggctcgcacctataaccctagcactttgtagggcagaggcagaggacagcttgaggccaggagtttgagaccagcctgggcatctccacgagaagtttttttgtttttttttgtttgtttgtttgtttttaaattagccaggtttaatggtgtgcacctatagtcccagcaactcaggagactgaggtgggaagatcccttgagcctataggggttagagcctgcagtgagctatgactgcaccactgtgttccggcctgggtgacagagcaagaccctgtccatttatttaaaaaaaaaaagaaaaaagaaaagaaaagaaagaaagaaaaaaagattataagctcaagagtccagcacagtgctaagcaaagagctgctcgatcaatatttgttgaataaaatacaaggaattttaccattaaagttacattaaatttaggggcctgtaaaatataaacaggcaaattaataacattaatagcatatcttacagtaggggaaaaaattaagctccttcataagtttttattttctataacttttcacaaaataaaaaataaaaaaattgagccggcacggtgattcatgcctataatcccagcactttgggaagccaagggaagcagatggcttgggcccaggagttcgagacgagcctgggcaatatggcaggaccccatctctacaaaaaaaaaaaaaaaaaaaaaattatatgggcatagtggtgcatgtttgtggtcccaactactcaagaaactgaggtggaaggatcatttgagcccaggaggtcaaggctgagccatgttcatgccactgcattgcagcctgggtgacagagcaaaaccctgtctcacagtgggggaaaaatgatacaaggtctgtaaccttatctcattagctgggaagactaaagtgacatgtctaagaacacagagttaaaaagtatcaaactcaagctaaaatctaagtcttagccaaatgcttccaattacctcaagatcttctatacctgcactgtctaatacagcaaccactacccacaagtggctactgaagcacctgaaatcttgctactccaaatggagaaggggtgtaagtataaaatacaaaccatatcttgaagactcaacaccaaataaatgcagatcatctcattatttttgtattagttatatagatatattgatttaaccaaatacattattacagttaatttcatctattttgattaatcttttttaatgtggctactggaaaaatttaaattatgtgtacagcttacaatatatttctactgaacagtacagtttgtttgttttgttttgtttgagatggagtctagctctattgttcaggctggagtgtaatggtgtgatcttggctcactgcagtctccgctacccgggttcaagtgattctcctgcctcagcctcccgagtagctgggattacaggtgcctgctgccacacctggctgattttttgtatttttaggagagacagggtttcaccatgttggccaggctggtctcaaactcctgacctcaggtgatccgccggcctcagcctcccaaagtgctgggattataggcgtgagctactgcccccagccggctttacctttttttaaatgtcttaattcattataacccaattcctttccctcaacaacccacactacaaaagtaaaattctacaaaacttctgattaactctccttctcacctgccagaaaatgaaatgttcccggataatattcttcacagcttcgttgctccacacatcgcggttgaggcactgacatgcaaagtcttgaacattttgaatgtttatcatcagccacttattttgcatctggccacactctttggcctgcaagagtaaagttacacatttgttagaaataatttctacttagtgacagatgtttccgtagttgttcagaggttgttgtctttcattaaaaatactaagtttttgccagatacgacatctagagttttcagcatttatacattctatatatttacttcgcatatgcatttatagctatactgtccatttcaagcactgctcaaatttaaatgaactcatttctcttttatccagttatttgttataatagctgattctctctctctctctctctctctctcctttctttctttctttcttttttttttttttttgagacagagtctaactctattgcccaggctagagtacagtggggcagtctcggctcactgcaacctccacctcctgagttcaagtgattctcccgccgcagcctcccaagtagttgggattaaaggcgtgccccaacacgcctggctgatttttgtatttttagtagagatggggtatcaacatgttggccaggctggtctcgaacttctgacctcaaatgacccgtccaccttggcctcccaaagtgctggaattacaggtgtgactcatcatgaccggtaatggctgaatttttaatgtatgtttaaacatctttacctgaaaaggattcaacaaacttaagatcaacaagtcacgtaattttattctcttgcaacctccatcaacaattttttttttttttgagacgagctttgctcttgttgcctaagtcggagaacaatggcacgatctcggctcactacaacctccacctactaggttcaagtgattcttctgccttagcctaccgagtagctgggattacaggtgtgtgccaccatgcctgactaattttttatatatttttagtaaagagacggggtttcaccatgttggccaggctggtctcaaactcctgacctcaggtgacgcacccatctcagcctcccaaagtgctgggattataggcgtgagccaccgcgcccagccaattatacttctttttaatgaatgcaattggtgtgtatattttactttgttttcttcaacatcatttctggaacatttttaaacatcatattaatctcagttattaggcatatatgctgttttggagaatcaccctaaacattttagtaaaaactgctgagagttttttctcttaagagttgtcttcctaggagtagattccaaaaattgggattacaaggtcaaagaatgtttgagaatgatccccaaacaactctacgattcgtacaacagatatcgatacatcaatcgttagtgcgtactttttgcctgtcagtcccttgtcagcataaagacccatgaaatgctgctgagtggaaaacaatggcagaaaagcaaataagcaaatgctgcctcaaatctttgcctaggaaagaacagtgacacgaaaccacagttttggaataaatttatcctagaacagtattcttttccaaatcagtgtgacatgggaaaatcttaagaatcaatgaatttggtgtaataacaatccaagaacatactggacatcattttgtgggtactgaaaaatgtgagactgagaatatcttctgttttaagaaggtctacatcatctcacaaatagctttttttttgtatgaatcccccagaataaattattttctttttttgttgtttatattttttgtagagacaggggtttcactatgttagccaggctggtttggaacacctagcctcaaatgatcctcctgccctggcctccaaaagtcttgggattacaggtgtcagtcaccccactcagccccagaataaattatcttctaatatttgcttactgattccatgggtgaaaacccaaggtctaaaaagaaatatcctcatattgagccaggaagccgcatttaactggtcaaaggcttattttaaaatatacaaatataataattccttgcttataggaagtaatatttccatttacttccttataggacaaagatttaaaaagtgaatgataaatgaataattaagctgctttaactacagaaacagtatttgaaaataaacggaaaaatgaccatacgttctagagatagactagagcgcacatattcctacagcagggtaaatttacataagtctgccccaaaaacaatgacaagaaaaaaatgtacaaaactgaaaatgaataaaagtccagagtttaaaatggaagagtcacttttttttttcgcttttaaaaatttgtttactcacattcatgctttcattatctcagatttattcattcaacaaatactgagtacctatcatgtttcaggtacagttatagatattaaagtaatagcagttctaaaatataaaaatctttgcctttgtgaagcttccaatgggggagaaacctaatactagcaaaagaaacttggaaatgatactaaccacattgaagatattgttaaaaaattgttactgctaaaaggaagggtgcaaagacacaattttcaaacaaaacaacaatattgggagggaataaaagagtcttgaataggccaggtgcagtggctcacacctgcaatcccagcactttgggaggccgaggtgggtggatcacctgaggtcaggagttcaagaccagcctggtcaacatggtgaaaccccatctctactaaaaacacaaaattagccaggcatggtggtgggcacctgtaatcccagctactcaggagactgaggcagaattgcttgaacctgggtggcagaggttgcagtgagccaagatcgtgccattgcactccagcctgggcaacagagtgaggggaggggaggggaggggagggggaggggagggggggagggggagggggagggggaggggaagggaagaaggaaggaaggaaagaaagaaagaaaaaaaggaaggagggaaggaaggaagggagggagggagggagggaggaaggaaggaaggaaggaaggaaggaaggaaggaagggaaaggaaaggaaaaaggagaggaagaaagaagagtcttgaataagtctagagatctcatgtacaacatgaggactatacttaataatatcgtattatacattgaaaatgtgctgagagcagattattaggtgctcttaccacacacacacacacacacacacacacacacacacacacacacgtaaaaagacaattatggaaggtaaggacaggttaatttgcttgactgtagtaatcattttactatgtatatccaatcttcatgttatacatcttaaatatgtacagtagtctggagcagtggctcacacctataatcccactgccttgggaggccaagacaggaggattgcttaaggcaaggagttcgagaccaccctgggcaacacagcaagaccccatctctaaaaagatttaaaataattgaatatatgcaatttaaaaagagagagtcttaaaaataatctaagtataccaattatgtgaatcaaggactggaggtgagagtgggccatgagaaaaataatctcctcatggaagattatcattgaagaagattactggaatccttggaatctattaggttgttctgaatcaacatttcaaagccattataatggagaccccagagtaaaacagcgggagactaacgtctgtcccagtaccagccagatcaggaaggcatgataaaaaaggatttaggcctggcatggtggctcatgcctgtaatcccagcactttgggaggccgatgtgggctgatcatttgagcccaagagttcaagaccagcctggtcaacatggcgaaaccccatctctactaacgatactaaaattagacgagcgtggtggcgcatgcctgtaatcccatctacttgggtagctgaggtacaagtattgcttgaatctgggaggcagaggttgcagtgagctgggatcatgccactgcactccagcctaggcaacagggcaagactgcctcaaaaaaagaaagaaaaagaaaatgaaggatttgaacaaatttaatatgtttcagtaagtatatatgcataaagtcgagaagaaaatatattaaaatatacacagtacttttttatggaaatggaaattacaattttatttttccttgttcattttctaaatttcaatgatttgtctaatttgaataaaactaaatgtaaacaatataaagtttaatcagaaaaatgttatatattgccaggggcagtggctcttgcctgtaatcacagcactttgggaggccgaggtgggtggatcacctgaggtcaggagttcgagaccagcttgaccaatatggtggtgaaacctcgtctctactaaaatttaaaaaattagccaggcgtggtggtgtgtacctatagtcccagctactcgggagggtgagacaggagaatcgcttgaacccaggaggcggaggttgcagtgagctgagatcgcgccactgcactctggcctgggcgacagagcgagactctgtctcaaaaaaaaaaaaaaaaaaaaaaagaaaagaaaagaaaaaggaaaaattagttactaactaggctcttcttcacattttcggctacatattttcacttgcatttatactaaatacttatgaaattaacaaaatattcttagtaattagagctaggtgcatgtgtaatgggataccaatttaaaatgtgggttttttttcctcatgaaataagaaatattggccgggtccagtggctcacactggtaatctcagaactctgggaggccaaggctggttaatcactggagctcaggagttcaagaccaacctgggcaacgtggcaaaacctcatctctacaaaaaatacaaaatttagccaggcatggtggcacacgcccataatccaggctacctgggggactaagttgggcagatcacttgaacccaggaagttggggctgcagtgagccgagatcgtgccactgcactccagcctgggtgacagagtgagactctgtctcaaaaaaaaaaaaaaaaaggaagaaatattaccgaaattgttctgattctttctgtacaatattccttctggcataatcatgatttcatgaaggctaattaaactgctttagaccccgtggacacacaacagtcaagaaaatgaagtccctgtgttcatacagcttacagcatggtggggaaagaggaaaacgtaggaaacattcccttgcccaggtcagaccatttggcctcagtgctctgctcactcagctggtcttcttgacggtaccagctctttccaacatcagtatgctcacactgtattttccctcagacctccccatcgttcgcattccctcgcttcactaaggtttctattcatatctcatcctttcagaaatcttccctaatcttcctaatacagtcctttctcttcacaattataaacatatgtggaacctacgaaatcaatctggctttcaatttggctgtaagaagaaactgaatttggcaacacggacacatctacttgcaaaggacactagaaatttccagatgcttaactcaattcagaccacacacatcaaatggccctgaacaaaatacagcccccctctctccttcccttattgtattttattctcctttttttttcttttgagacagggtctcactgtgttgctcagggtggagggcaatggcaccaccacagctcactgcagcctcaacctcctgggctcaagcgatcctcctaccccagcctcctgagtagctgctggggaccacaggtgtgcaccaccacgtccagctaattttttcgactttttgtagagacagggttccaccatattgcccaggctggtctcgaactcctgggctcaagtgatctactcccttcagcctcccaccaaagtgctgggattacaggcatgagccactgcatccagctacattttattctttctccaagcaactactataacttgaaatgaatgtcacactctctctctccatcaaagacaaacatatgtattatattcactgttattatatatatgtgtttgtgtgtgtttgttttacgttatttgtttatagtctgtttctcctactagattataaacgctacaatggcaaggattttatataatttaccactatctccctgtggcagaaactgcttataggtaccaaataacccattctccccttgtccctcttacttatagaacctccagtttttaactaagcatctggatttcctagtgtcccttgcaaatgggtgtagccatgctgccaagttatagtagatggaatgtagacagaagtgctgggtacaacttctaggttgttcccttcaagggaaatttgtacccttatcagctcctccctcttccatgctgtttatttttttttaagtgaaagcaagtttattaagaaagtaaaggaataaagtatggctattccataggcagagcagcccaagggctgctggttgccaatttttatgtttatttcttgcttatatgctaatcaaggagtggattacttatgagttttccaggaaaaggttgggcagttccgagaactgagggctcctcctcctttttagacgatacagggcaacttcctgatgttgccatggcatttgtaaactgccactgcactggtgggagtggagcagtgaggatgaccaggtcaccctcatcaccatgttggttttgggggattttagccagcttctttccatgttggttttggggggttttagccagcttctttccatgttggttttggtggattttagccagcttctttccatgttggttttgggggattttagccagcttctttccatgttggttttggggggttttagccagcttctttccatgttggttttggggggttttagccagcttctttccatgttggttttggggggttttagccagcttctttccatgttggttttgggggattttagccagcttctttccatgttggttttgggggattttagccagcttctttccatgttggttttggggggttttagccagcttctttccatgttggttttgggggattttagccacagcttctttccatgttggttttggggggttttagccagcttctttccatgttggttttggggggttttagccagcttctttccatgttggttttggggggttttagccagcttctttccatgttggttttgggggatcttagccagcttctttccatgttggttttgggggattttagcttctttactgcaacatgtttcatcagcaaggccttcatgaccagtttcttgtgctgacctcctatctcatcccatgacttagaatgtctaaccttctgggaatgcagcccactaggtctcagccttattttaccgagcccctattcaaaatggagttgctctgttttaaatgcttctgacatttcctccctcccttttacaagagaacccttaatcctaagggttgtagagggaaaaagattcaacttccgtaacttcttcatgcttaatagggacgatggtattcctgtctattagatctcttgcattcagagtagagaggacctcagtctgaaagcatctgtatggcgagcgccattcctaactcttgagtcccaacagaaggtggtatccttcagccaactggtgctcacagatgattttcctttgggttgggggtatcttcggtatcatcccttctgtgattcgccagaaagatgttactgggccccaccacttaaccaaagttagcctttgggttgggggtttcctcagtattgtcccttctgtggtcgccagaatgatgttactggaaaggggtccggatccagatcccaagagagggttcttggatctagtgcaggaaagaattcagggcgagcctatagagtaaagtgaaagcaggtttatcaagaatgtgaaggtcatgcctgtaatcccagcactttgggaggccaaggcgggtggatcacgaggtcaggagatcgagaccatcctggctaccagggtgaaaccacatctctattaaaaaatacaaaaaatcagctgagcgtggtggcgggcgcctgtggtcccagctactcaggaggctgaggaaggagaatggagtgaacctaggaggtggagcgtgcagtgaggcaagatagcgccactgcagtccagcagtccagcctgggcgaaagagcgagatttcatctcaaaaaaaaaaaaaaagaatgtgaaggaatgaagaacagccactccataggcagaggagccttccatgctgtttagtaagcaaacatggtggtaaggcaacttgaatcatgcagacaagggcaagcaagacctaggggatggcagaacaagacagaaaaaaattctgcaactctaataactttacagagctaatcatcctaatagcctggacttccatcttgcttaagctactgtttgtttgtggtggggtgttccaagatggccaaataggagcagctgcagtctgcagctcccagcatgatcaatgcagaagacggacgatttctgcatttccaactgaggtacctggttcatctcactgggactgggtggagagcgggtgcagcccacggagggcgagctgaagcagggcagcgtgccgcctcacctgggaagtgcaaggggtcggggaaatcatttccctttcctagccaagggaagccgtgacagactatctggaaaaacggggcactcccacccaaataccgcatttttcccaaggtcttagcaactggcaggcaaggtgattctctctcgtacctggcttggcaggtcccacgcccatggagccttgctcactgccagcgcagcagtcagagattgatctgtgaggtggcagcctggctgagggaggggcgtccgccattgctgaggcttgaataggtaaacaaagcggctgggaagcttgaactgggcagagcccaccacagctcaacaaggcctactgcccctaaactccacctctgtgggcagggcatagctgaacaaaaggcagcagacaacttctgcagacttaaacgtccctgtctaacagctctgaagagagcagtggttctcccagcatggtgtttgagctctgagaacggacagatggcctcctcaagtgggtccctgactcccgtgtagcctaactgggagacatctcccagtaggggccgacagacacctcatacaggcggctgcccctctgggacgaagcttccagaggaaggctcaggcagcaatatttgcagttctgcagcttctgctggtgatacccaggcaaacagggtctggagtgaaactcctgcaaactccaacagacctacagctgagggacctgactgttagaaggaaaactaacaaacaaaaaggaatagcatctacatcaacaaaaaggtcatctacaccaaaatcccatctgtaggtcaccaacatcaaagaccaaaggtagataaaaccgcaaagatggggagaaaccagagcagaaaagatgaaaattctaaaaatcagagcgcctcttctcctccaaaggatcgcaactccttgccagcaacggaacaacgctggatggagaatgactttgacaagttgacagaagtagtcttcagaaggtcggtaataacaaacttctccaagctaaaggaggatgttcgaacccatcgcaaggaagctaaacaccttgaaaaaagattagatgaattgctaactagaataaacagtgtagagaagaacttaaatgacctgatggagctgaaaaccacagcacgagaacttcgtgacgcttgcataagcttcaatagctgatttgatcaagtggaaggaagggtatcagtgattgaagatcaaattaatgaaataaagtgagaagacaaggttagagaaaaaagagtaaaaagaaacaaacaaagcctccaagaaatatgagactatgtgaaaagaccaaatctacgtttgattggtgtacctgaaagtgacggggagaatggaaccaagatggaaaacactcttcaggacattatccaggagaacttccccaacctagcaaggcaggccaacattcaaattcaggaaatacagagaacaccacaaagatactcctcaagaaaagcaaccccaagacacataattgtcagattcaccaaggttgaaatgaagggaaaagtgttaagggcagccagagagaaaggtcaagttacccacaaagggaagcccatcagactaacagcagatatctctgcagaaaccctacaagccagaagagtgggggccaatattcgacattcttaaagaaaagaattttcaacccagaatttcatatccagccaaactaagcttcataagtgaaggagaaataaaatactttacagacaagaaaatgctgagacattttgtcaccaccaggcctgccttacaagagctcctgaaggaagcactaaacatggaaagaaacaaccggtgccagccactgcaaaaacatgccaaattgtaaagaccattgatgctaggaagaaactgcatcaactaatgggcaaaataaccagctaacatcataatgacaggatcaaattcacacacaataatattaaccttaaatgtaaatgggctaaatgccccaattaaaagacacagactggcaaattggataaagagttaagacccatcagtgtgctgtattcaggagacccatctcacatgcaaagacacacataggctcaaaataaagggatggaggaagatctaccaagcaaatggaaagcaaaaaaaatgcaggggttggccgggcacaatggctcatgcctgtaatcccagcactttgggaggccaaggcaggcagatcacgaggtcaggagatcgagaccatcctggctaacacggtgaaaccccgtctctactaaaaatacaaaaaaattagctgggcgtggtggcaggcgcctatagtcccagctactcgagaggctgaggtgggagaatggcatgaacccaggaggcagagcttgcagtgagcccagatcgcaccactgcactccagcctgggccacaaagcaagactccatctccaaaaaaaaaaaaagaaaaagaaaaaaacacaggggttgcaatcctagtctctgataaaacagactttaaaccaacaaaaatcaaaagagacaaagaaggccattacatattggtaaaggggtcaattcaacaagaagagctaactatcctaaatatatatgcatccaaattcaaaaagcaagtccttagagacctacagagaagagacttagactcccacacaataataatgggagaatttaacaccccactgtcaatattagacagatcaatgagacagaaagttaacaaggatatccaggacctgaactcagctctgcaacaagcagacctaatagacatctacagaactctccaccccaaatcaacagaatatacatttcttctcagcaccacatcacacttattccaaaactgaccacatagttggaagtaaagcactcctcagcaaatgcaaaagaacagaaatcacaacaaactgtctctcagaccacagtgcaatcaaattagaactcaggattaagaaactcattcaaaactgcacaactacatggaaactgaacaacctgctcctgaatgactactgggcacataacgaaatgaaggcagaaataatgatgttctttgaaaccaatgagaacaaagacacaacgtaacagaatctctgggacacacttaaagcagtgtgtagagggaaactcatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacataaaaaacccttcaaaaaatcaatgaatccaagagctggttttttgaaaagatcaacaaaattgatagaccactagcaagactaataaagaagaaaagagagaagaatcaaatagacgcaataaaaaatgatcaaggtgatatcaccactgatcccacagaaatacaaactaccaccagagaatactataaacacctctatgcaaataaactagaaaatctagaagaaatgggcaaattcctggacacatacaccctcccaagactaaaccaggaagaagttgaatctctgaacagaccaataacaggctctgaaattgaggcaataattaacagcctaacaaccaaaaaaagtccaggaccagacggattcacagccaaattctaccagaggtacaaagaggagctggtaccattccttctgaaactattccaatcaacagaaaaaaagggaatcctccctaactcattttatgaggccaacatcatcctgataccaaagcctggcagagacacaacaaaaaaggagaattttagaccaatatccctgatgaacattgatgcgaaaatcctcaataaaatactggcaaaccgaatccagcagcacatgaaaaagcttatccaccatgatcaagtcggcttcatccctgggatgcaaggttggttcaacatatgcaaatcaataaacataatccatcatatcaacagaaccaacgacaaaaaccacatgattatctcaatagatgcagaaaagaccttcaacaaaattcaacagcccttcacgctaaaaattctcaataaactaggtattgatggaacgtatctcaaaataataagagatatttatggcaaacccacagccaataccatactgaatgggcaaaaactggaagcattccctttgaaaaccggcacaagacaaggatgccctctctcaccactcctattcaacatactgttggaagttctggccagggcaatcaggcaagagaaataaataaagggtattcaattaggaaatgaggaagtcgctctccctctccctctcccctttgcacggtctccctctgatgctgagccgaggctggactgtactgccgccatctcgactcactgcaacctccctgcctgattctcctgcctcagcctgccgagtgcctgggattgcaggcgcgcgccaccacgcctgactggttttcgtattttttggtggagacggggtttcgccgtgttggccgggctggtctccagctcctgaccgtgagtgatctgccagcctcggcctcccgaggtgccgggattgcagacggagtctcgctcagtcagtgctcaatgttgcccaggctgaagtgcagtggcgtgatctcggctcgctacaacctccacctcccagccgcctgccttggcctcccaaagtgccgagattgcagcctctgcccggccgccacccagtctaggaagtgaggagcgcctctgcccggccgtcatcccatctaggaagtgaggagcgtctctgcccagccacccatcgtctgggatgtggggagtgcctctgccccgccaccccatctgagatgtgaagagcgcctcggcccggcagtgaccccgtctgggaactgagaagtgtctctgccccgccgccacccactctgggaggtgaggagcctctctgaccggccgccccctctgagaagtgaggagcccctctgcccagcagccgccccgtctgggaagtgaggagcccctacgcccggcagccgcccatcagggaggtggggggcagcccccacccggccagccgccccgtctgggaagtggggggggtgggggcgcctctgcccggccgccccgtctgggaagtgaggagcccctctgcccggccgccaccccatctgggaggtgtacccaatagctcattgagaacgggccatgatgacgatggtggttttgtcgaatagaagggggggaaatgtagggaaaggaaggagagatcggattgttactgtgtctgcgtagaaagaggtggacataggagactccattttgttctgtactaagagaaattcttctgccttgggatgctgtttatctatgaccttacccccaaccccatgctctctgaaacatgtgctgtgtccactaagggttaaatggatgaagggcggtgcaagatgtgctttgttaaacagatgcttgaaggcagcatactcgttaagcgtcatcaccactccctaatctcaagtacccagggacacaaacactgcggaaggcagcagggccctctgcgtaggaaaaccagagacctttgttcacatgtttatctgctgaccttccctccactactgtcctatgaccctgccacatccccctctccgagaaacacccaagaatgattaataaacactaaaaaaaaaaaaaaaaaaaaaaaaaggaaatgaggaagtcaaattgtccctgtttgcagatgacatgattgtatatttagaaaaccccatcgtctcagcccaaaacctccttaagctgataagcaacttcagcaaagtcttaggatacaaaatcaatgtgcaaaaatcacaagcattcctatacaccattaacagacaaagagccaaatcatgagtgaactcccattcacaattgctacaaagagaataaaatacctagaaatccaacttacaagggatgtgaaggacctctttaaggagaactactaaccactgctcaacgaaataaaagaggacacaaacaaatggaagaacattccatgctcatggataggaagaatcaatacctgaaaatggccatattgcccaaagtaatttctagattcaatgccaaccccatgaagttaccaacgactttcttcacagaactggaaaaaactactttaaagttcgtatggaacctaaaaagagcccacattgccaagacaatcctaagcaaaaagaacaaagctggaggcatcatgctacctgacttcaaactatactacaaggctacagtaaccaaaacagcatggtactggtaccgaaacaaatatatactatatctgtttcaaactatactacaaggctacagtaaccaaaacagcatggtgctggtaccaaaacagatatacagaccaatggaacagaacagaggcctcagaaataacaccacacatctacaaccatctgatctttgacaaacctgacaaaaacaagaaatggggaaaggattccctatttaataaatggtgctgggaaaactggctagccataggtagaaagctgaaactggatcccttccttacaccttatacaaaaattaattcaagatggattaaagacttaaatgttagacctaaaaccataaaaaccctagaagaaaacctaggcaataccattcaggacacaggcatgggcaaagacttcacaactaaaacaccaatagcaatggcaacaaaagccaaaatagacaaatgggatctaattaaactaaagagcttctgcatggcaaaagaaactaccattagagtgaacaggcaacctacagaatgggaaaaaatttttgcaatctacccatctgacaaaaggctaatatccagaatctacaaagaactcaaacaaatttacaagaaaaaaacaaacaaccccatcgaaaagtgggcaaaggatatgaacagacacttctcaaaagaagacatctatctatgcagcgaacagacacatgaaaaaatgctcatcatcactggtcatcagagaaatacaaatcaaaaccacaatgagataccatctcatgccagttagaatggcaatcattaaaaagtcaggaaacaacagatgctggagaggatgtagagaaatagggacgcttttacactgttggtgggagtgtaaattagttcaaccattgtggaagacagtgtggcgattcctcaaggatctagaactagaattaccatttgacccagcaatcctattactgggtatatacccaaaggattataaatcatgctgctataaagacacatgcacacgtatgtttattgcagcactattcacaacagcaaagacttggaaccaacccaaatgtccatcaatgatagactgcattaagaaaatgtggcacatatacaacatggaatactatgcagccataaaaaaggatgagttcatgtcctttgcagggacatggatgaagctggaaaccatcattctcagccaactatcacaaggacagaaaaccaaacaccacatgatctcactcacaggtgggtattgaacaatgagatcacttggatacagggcagggaacatcacacactggggcctgtcgggggctggggggctggggggctgggggagggatagcattaggagaaatacctaatgtaaatgagttgatgggtgcagcaaaccaacatggcacatgtatacctatgtatcaaacctgcatgttatgcgcatgtaccctagaacttaaagtataataaaagaaataaataagctactgtttgttttttttttttccagtctctctcacatgcagtcaaacccttactcttgatcacctagaactaggtcctgcaacacaaggcctcaataaatatgtattgagtgaacaagtgaattaatcagtctctctcatctggttagcatgagccagaaagaatccttgaacatgacctacctctagttacactagcttctaagcctgtaaaactgtggctcacatttacatctaatatgaggaacaaacctatgggccctccttggtcagccaaagagtatccctctaatttttaacatttatctttctaaacttcaatgacttaattttgcttgttatctccctaattgttataaaactaatacatgtatcattaaccataatgaaatacctgcttttggaagggaatatttatttcatttaaagtcttgcagatggttaagtataatattatcagtgaaaaaaaaaatggactgctgtaaacacaggccatgaaatacaaggcaaaaaaggtgatataacttaaatttcaggggacaacatcaaaagagattcgtattttcccttaatgaccaagcagaaaagtaactgctttttcactccaaagtgaccaaactaaatcaagcttagttactgcattacgtcctagagcaactcataagctaataaaaatagaacacgtgccaaaacaaactaagatccttttctgcctttaatattgctgctattctctctctcaatggctgtagtatcaccagaatactagaaaggataggcagctgccatgttgagaccatgaaggaaagatgaagaaaactgaggagacatctaacctgacatctttgagcttatgaatgaacagcaataatttcttcaactctaggcttattactgacaaaaagaaagcattgtttggtcaaattatcatcatttgggttttctgttacatgcagccaaaccactttcaaggttttctgattcagaaaattgaaactggagagcacgctgatatggtttggaaatttgtcccctccaaatctcacactgaaatgtaatccccagtgttgggggtggggcctcgtaggtggtgtttgggtcatgggggcagacccctagtgaatggcttgaccccttgctcctcgcaccatgtgctacaccggcttcccctttgccttctgccatgactgcaagcttcctgaggcctcaccagaagcagatgtcagcacaatgctttctatacagcctgtagaaacgttgagtcaaaatatacctttttctttataaattgcccagtctcagggattcctttctagcaatgcaagcaaactaacacacaagcttacattgaaattccttctcctaaatacttcatgtatgacagtgtaaaagtatatcaaaggacacatttaaaaaaaaataatcataacatattcaaatatgcagctgatatacatcggttgtttattttaagaaatggggtttcagctcatgcctgtaatcccagcactttgggaaccaaggcagaaggatcacttgacaccaggaatttgagaccagcctggggaacacagcaagaccccctctccacaaaatatttttaaaattggccaggtgtggtagtgggtgtctgtagccctacttatttgggaggttaagaccaggggatcaattgagaccataagttggaggctgcagtgagccatgattttgccactgcactccatcccaggtgacagaatgagaacctgtctcaaaaaaaaaagacaaagaaaagggaaagatagggtctcactatgttgcccaggctggagtgcagtggttttcataggcatgatcatcacacaccacagcctcaaactcctgaactcaagggatcctcccacctcagcctcccaagtagtagttagtttggggcacctgttgggcttgatacacatcattcttgcagttattctttggcctacagggtcctaacaggtaagacttaactgaaggctgggcgcggtggctcacgcctgtaatcccagcactgtgggaggctgaggtgggcagatcatgaggtcaggagtttgagaccagcctggccaatatggtgaaaccccgtctctactaaaaatacaaaaaattagccaggcgtggtggtgcgcacctgttttcccagctactcaggaggctgaggcaggagaattacttgaacctgggaggcggaggttgcagtgagctgagatcgtgccactgcactccggcgagactccatctcaaggaaaaaaaaaaaaaaaagactcaactgaaatgtaactgatttacatctatggaaatgctattgtaattcaaaagagcattaacatgttaatcaacacgaaaaggcaagctgtttgaacacctcaacagaagagtatctaaaatctttactaaactccttcatttaacatatgtgttcctcctaatgcaagagaatgggtcccaaggattattaaaaagaatgatctttcctctgccctaagtaagtctgtaagttagcatacaaccaagtaaacatactctggaaagtttttgtttgggtttagtcacgataaaaccaagaagaactgagggtgaatgtgttctccaattagagatattcttttcaaacacattacgatccgcacagaaatatagacaaaagacacctatcaacaatttacaaatggctaacaaaccacacacactattctcagtagtagtcaaagatatatgaacaagtgagatattttaaaaagctatcaaaatggcaaagattctaaaatgacaccgcacaaggctaataaaaggatttcatcaatctcatatactgctggtagaaatatatttcatatattgctggtagaaatataaatcaatgtaacctttaggcatatcatgtagatatacttattataatgccaattccctatacactgacaatggttttttgttcttataaaaataaaaaatgccactgaaggccaggtgcagtggctcacacctataatccaagcagtttgggaggctgaggcaagaggattgcttgaacctaggcattcgagaccagcctgggcgacacagtgagaccctgtctctaccaaaaaaatttttttaattagctgagtgtggtggcacatgcctatagccctagctactcgggaagctgaggtaggaggatcccttgagcccaagagttcaaggctgcagtgagctatgattgtgtcactgcagtccagcctggacgacagagcgagacctgctctaaaacaagtaattttttaaaaaaaggcattgaaaatgcaaaaggattcatagttaaggcactgactctccaacaacttactgtttcaaagctgcctttatgcatcaaatcaatgggtggccggaatagatctgcaagggtagttaatttcttatcgatagctcctccatttcttaattcttgttcttgccgaactataatacagaaggatgaaagtttcagttagccataatcatgaatcacactgaaaaaaaaaaaaaaaaaaacacaaacttctgtcaattgaaggaattgctgtcaatatgcttgacctcaaatacaaagatctaatgttgactctgaaaaaaaaaaatgcaaagggagataagaggaatcttaagacttggtggtattccctatcccaaggatacaaagaaaattaactgaaaatattcacttaatcaaagtaacctcttcacatattcagaaactaactgtaacatgggagaggctgagtgcggtggctcatgtctataattctagaactttggatggccgaggtcagcagatcacctgaggtcaggagtttgagatcagcctggccaagatggtgaaaccccgtttcaactaaaaatacaaaaaaaaaaagccgggcatggtggagcatgcctgtaatcccagctactcgggaggctgaggcaggagaatagcctgaaccctggaggcagaggttgcagtgagcagagatcgcgccactgcactccagcctgggcaacagagtgtgagactccatctcaaaaaaaaaaaattagccaggtgtagtggcgcatgcctgtagtcccagcactatgggaggctgagatgtgcggatcacctgaggtcaggagttcaaggccagcctgggcaacatggtgaaacctcatctctactaaaaatacaaaacttagccgggtgtggtggcacaagcctgtagtcccagctacttgggaggctgaggcaggagaatcgtttgaacctgagaggtgaaggttgcagtaagctgagatcatgccactgcactccagcctgggtgacagagcgagactccatctcaaaaataaatagtaataataaaaaaaagattatgacagtagagatgatgaccactgttgtcaccttccactggaaggacacaggattccctagatgacttgagtcagtttaggttccccatcaattctctccaaagtcacaagacctatctgtgcctcaatgaactcattctaaataaactacaaaatcaagcatggtccaagggtttctcatatatcctaacctaactgtcctttctttaggattccattgctaaatcaatactaaatcctctaaaagcataagaccaagattctcattctaatttattacacaaaaatatttcaaataactgtagccaaaatattaatagtggctgctttgggtggcatggcttttcctcctatttttcaatctcttataataaccattttcattatatattcctttcattgacagaagtcaggatcctgagggaaatcagtttattttattatagtaagcattttaagtgtttattcacaagcgaattaagtttatcaattaccatatttcctacattatctccatctcctttactatttttctataaccaaataggttagaatttggaacaatttagctcaggggagaattaatcacattctggatccataatttcactttttaaagaaggtgaaaacttaaaagtaattgggcctaatagtaatcatctttgtctttttaataggaagagaagagggagatgataaactggtccatagatacctactagtttcagtctgaaaatcccggaaaccatcaaaaattgaacgtgcaggccgtcgtcttttaggagctttggggagaaaaaatagaattgaaaattttttaaattaattttgaaacaattctaaaaatgtccttatctaaaagtatttttttaataaaacatatgaaacccttcacgaactgcatgtcacccttgcacaggggccgtgctaatctctgtctcgttccaattttagtaaatgtgctgccgcagcgagcacagtatttcttgttttaaaacactcaagattcatatggtgccttccctcaaaaaataaaaaagtttaaaaactttcaaatcattcatgtataattaatccaaacatcttccatccagtcatcttgtattacaaatgagaaaattcaggcccagttacaatagacttaatcaaacttgtgtaaaaagtttactatcggctgggcatggtggctcatgcctgtaatcccagcactttgggaggccaaggtgggtggatcacctgaggtcaggagtttgagaccagcctgaccaacatggtgagcccctgtctctactaaatacaaaaaattagccaggcgtgatggtgcatgcctgtaatcccagctacttgggaggctgaggcaggagaatcacttgaacctaggagacagaggttgcagtaagccaagactgccattgcactccagcctgggcaacaagagcgaaactccatctcaaaaaaaaaaaaaaaaaaagtttactatcctggccaggcactgtagctcacacctcctgtaatcccagcattttgggaagccaaggcaggtggatcacctgaagtcgagttcaagaccagcctgattaacataatgaaaccctgtctctaataaaaatacaaaaaaactagccaggtgtggtggcacgcacctgtaatcctagctacttgggaagctgaggcaggagaatcacttgaacctgggaggtggaggttgcagcgagccaagatcacgccactgcactccagcctgggcaagaagagtgaaactccgtctcaaaaaaaaaaaaaagtttactatcttaatatccaagtggtgatatcaggaagaaagaagattttgaggatgatgccacgtagagatgaagccacacacatgctgcagatatccaattcaggttagccctgttgtatagagtaactctacattctaaaccataagacttaaggactatttcttagggattggattggacccacgtgcagaaccataaagacaaaaaacatctttaattctggaaacttttttcacagttacacaatggtttaatgacagaaaagtaaacagatccacctaaggtattccactacccctgtagagtgtctattacccagtctttaagtattttacagataaggtgtagaatgctagaatcaaaatgttatcttcctatatctatgtgttcttaaacctaaacaaattaccagatcatttatgtacattacaataaataaaggcttttcatgattccctcaatatgggtaagtaactaagttggcttatggcaaggctggccagcatgtaaccagaataattatctgttaataaatgattagtatcaagattagacagagactacagaatccccttaacgcgtgtcaaaacatctttcccaataactcgtgtttgtgattacataggataattctttatatccagaactaccgagtaaaaggcaaaacaaagcaacaaaaaaatgcacaacatattaaaaacttcatttttgtttaaaacatatattcatatgcatatcattcctgtgtatatgtgtatgtttttatgttaaacaatcacactatcatctctgggaaaagagattttgtaatacactgtcatgttttattttatttttttttgagacagtgtctcactctgttgcccagctggagtgcagtggtgtgatcatggctcactgcagactccatcctcctaggctcaagccatcctcctgccttagcctcccaagcagctgggactacaagtgtgcagcaccatgttcagtttttttgtttgtttgtttgtttgtttttttaagagacgggcatgtcactatatcgcccaggctagtttggaactcctgggctcaaggaatcctcccatctcatcctcccaaagtgctgggattacaggcaccagccaccatgcccagcctgaattaattaatttatttatttattgcgacagagtctcactctgttgcccaggctggagtgcagtggcatgatctcagctcactgtgacctccgcctcccaggttcaaggcattctcctgcctcagcctccctagtacgtgggacaacaggcatgtgccaccacgcccagccaatttttgtatttttagtagggagggggtttcaccatgttggccaggctggtctcaaactcctgacctcaagtgatccacccgcctcggctaccaaaagtgctggaattacaggagtgagctactgagcctggcctgaattttatttttaatttaaatattgcaccctgtgtcgctctctaccttcctccctccctcctttcttcatttctattcaagaaaaagcaagaaatgtcatacttttcaatcttagaactatttttgatcaagagctcctatttcaaatgtacatggcctctagcaggaataatatagcctgccaaagaatgcctctaaaactagttatctggccctggtgcagtgatgtgcgcctatagtcccagctgcccaggtggctgatgtgagaggatcgcttgagccaaggagttcgagtacagtctgtgcaacatactgacaccctgtctcttaaaaaaaaaaaaaaaaaattaactttttaaaaataactagatatctgaaactttttaactgtaacaattaagaaactggctggaggctgggcatggtagctcacgcctgtaatcccagcactttgggagaccgaggtgggtggatcacgaggtcgggagattgagaccatactggctaacacggtgaaaccccatctctactaaaaaatagaaaaaattagtcaggcgtggtggcgggtacctgtagtcccagctactcgggaggctgaggcaggagaacagcgtgaacccaggaggtggagcttgcagtgagctgagatcgcaccactgcactccagcctgggccacagagcgagactccatctcaaaaaaaataaaaaataaaaaccaaggatgtcttagaataagaatagctgcctaagaaagtatattattttaggaaggtagcacataaaaggtaattttcttctacttttaaactgccaaagataggttagtcaatattccacatcacctttccaacctcccccttctctataagggactgatctccgtatactcactagttcctcttattgctatccttctacccaattccttttacttcttgggctaataaccctcttcccatttgtcttcccttcgtttaccctatttctaagcaaaaacctctcctcagaccacaccacctctagccctaagactattactgctacctgccttttcaatgtggtctcctggctcttccaagccgtctgccacaaggaaacatcagtcctctgtcctcactctactgcccacataatagaagtactggtcactgaagccaaagagactaagctataaagagctaaaagaaattcaggagcttcaaagtcagcataggggagggacaggtggagaaaaaatgtagtgagaagagtggcactgttttacatgtccacatatctgttcgtatttggcttcagagaagacatctggatcttcagatctgcttctgcattcctttagatctgctgctattcttttagttcaagtatagaaagaaaactaaaatttactctcacgcagacacgcagttgtaaaagggagtagtgggctttttgttttaaaagatgggggtctcactatgttgcccaggctgaagggcagtggctattcacaggcacaatcccactactgatctgcacctgctccgtttcctcttccttaggtcatctggtgtcctccactgctggcaggtcaccatattgattccgaacttagtgcagacacccaatcagcatagggccctacagccaagaactcctggggctcaagccatactcccgcctcagcctccagagtagctgagactacatgtctgtgccaccatacccagcagggaggagtgttttaaagtcttagatgattgtggatattcctctttaacagtacaccaatacttaaccaatggtagtttcttagaggacagctgcaaagtggaatctgaaatcttatcaatgagtttttcatactgtttcattaaaacccactgtactatgtggtaggcagtgtctaagacagcccccaattttccctgtctcccagtattgataacctgtgggtgaataccttgagtacaggcaggattgaacagaatgtggcagacatgatgggatttcacttccagattacgttacaaaaagacagtggcttccgttttgggctgccctctctggctctctcatttgctctgtgttaagaatggatgcccccaggcaatagccacatgaatgagtttaggagatcctcctccattcaggctttgagatgaatggtagcctagctgacatgttgaccacacctttgtaggagaccctaaccaaaggccacacccagattgctgacccaaagaaactgagataacaaacgtttgtttttttcaggcagtttaattttggaacaatttttcactcagcaataaatatctaatacaattcatctcgcagtctgaatggatcttttacctatgcacaattttgtagtatcatgcattggttattcaaaaatacttgtttactgagtaatgcaaacatttcaaatattaatggtttcattacacagtattttaaaaatcatctgtttcatgtcaccactgatcttatcagaaagccttcaagtactgggaaagtatcaagctcacaaaggtgggtacaaaaaattttctaaaatcctgttttttgcctgaaagctcttttgtaatttatcattgtttttgagatgaggtctgtcatcagtaggctgaagtgcagtggtgcaatcatggctcatgccttgacctcccaggctcaatccatcttctcacccctcggcctcctgagtagctgggactacaggcatgtgccaccacacccagctcatttttttcttaattttttgtagagatgggggtctccctatgtagcccaggctggtgtggaactcccaggctcaaacaatcctcccgcctcagcctccgaaagtaatcccaaagtgttcggattacaggtgtgagtcaccacgtccggccaaacctcttttttaaaatcactgataacaaacactctcagttgtattgaagtaacaagctcacattttcaagaaaatgccaactgtcaaagtgtaaactgatagtctgtcagcgatttttcaagtaaaaagaatgttccatgaaaaaagctgcctacttcagctcgctactctaacaatcacacaagtgcttttccttaaggtaatcatagtacttcattatgccaaagtgctttgtgcatacatcctatttcaaacaatattttaaaactgtgtactcaaggatcaggatttaatgaaattaatcatttttattgcttcatcaagaacattattaaagaaaactgcttttaaattaatttattatttttttttgagttggggtctcaatacgttgcccaggctggtctcaaactcctgggctcaagcaatcctcccgcctcagcctcccaaagtgttgagattacaggtgtaagccactgcaactgtcctatttatgtttcttttatagacagggcctcactctgttatacaggctgcagtgcagtggcatgatcatagttcactgcagcctagaactcccaagctcaagcgatcctcccacctcagactcccaagtaactaggactacaggcacgtgccaccatgcctaacgaatttatttttattttttgtagagataagagtcttcctatgttgtctgggctactctccaactcctggttgcaagtgatctgttcaactgtggcctcccaaaggactgggattacaagcatgagccactgcacctggccctgccttttagattttttttgtaaacttcaaatatgcagcagtgaagaattcactatctagtgatacagcctgaagccaccacatgaattcaaccaagatgccagcagtctgactcatcattgtttctgaactatcagtctaaatgtcaccacaatgaaaataatttgatgtccagtataatggtgcatgcctataatcccagctacttaggaggctgagataagaagatcacctgagcctaagagttctggcctgtagtgtgctatgccagtcaggtgtctacactaagctcgacatcaatataattacctcccggaagtagggggaccaccaggttacctaaggaggggtgaactggcccaggttggaaacagaggtcaaaactcctgtgctgatcactagtgggatcacgcctgtgagcaaccactgcactccagcctggggcaacacagcaagaccccatcttgggaaaaaaaaaaaacccttagtattattacgtaagttgttttaactttacagacaacctgaaagggaatattagggacctgagcccacacctgaactgtgatttaaatcaatactgtcttaagaaaatagtttctaaagacccatttcaagttataacgtctaataatgaaaggtaagaatgacttcctaactgtaaaaagtcattctcagtgtcgtccttactgtacaccaattcagagataaaaaaaggaagaaagcggccaggtgtggtggctcacgcccgtaactccaatatgggccaaggccaaggccaaggcaggcaggaagcttgcttgagatcagttccatagcagccagggcaaacagcaatgccctgtctccacaaaacaaaacaattagccaggcgtggtggcatgcacctatagaaggctgaggtgggaggaatccttgagcccaggagtttgagactgcagtaagcaaggattgtatcactgcactccagcctgggcaacagactccatttctgcaaaacaaaagaaaaaaaaaagagtaaagtggggcttccaaatggaattcttctgcctctgttcaaaagcaatacagcacagaatttacttcctatagtcctacaaagacgctgtattattccttgcaataaagagaagataaagcttccaagggcattactcttttgctccaaatctattcctagcatttatatttttaaaattatgagcaatatggtatattaacagcataatgactatctgcagtgagcagtccagaaagcacttcattacactacagtattcagactttacagctttcctcttgccttttatttccaaatctagacagtatattcttttgtttcttgctataataaacaccaaagctgccaagttaaaaacatttatctcggccgggtatggtggctcatgcctgtaatcccagcactttgggaggccgaggcgggcggctcacctgagctcgggagttcaagatcagcctgactaacatggagaaaccccgtctctccaaaaaaaaaaaaaaaaaaaaaaaaaaatatatatatatatatatatatatacacacacacacacacacacacatatatatatatacacatatatacaaaaaataaaaattaaaaaaataaataaaaaggtttatctcataaaaactctcaactaaagtactttatcaaaagacatacatataattttattcatccttttgttacaacgtatatttcctcctcttagtttaccgatgaaggctatgtatgtattatcctaagtgaattaatgcaggaacagaaagccaaataccggacgttctcataagagagagctgagtacaaacagacacaaagaagggaacagacaccagggcctggttgagggtggagggcgaggattgaaaaaaatacctataagccaggcgtggtggctcgctcccgtaatcccagcactttgggaggttgaggccagaggatcgcttgagcccaggagtttgggaccagcctgggcaacatagcaagactccatctctattttaaaaaaaaaaaaaaaaaaaaagtaaagaaaggaaagaaagaaaagaaaagagaagagagaagagaagagaagagaagagaagagaagagaagaaaaactacctattgggtactacgctcattacctaggtgataatctgtacaccaaacccacgcaacatgcaatttacccatgtaacaaacctgcacatgtaccccaaacctaaaataaaagttggagggaaaaaaatttgtatgtctcttgtactcaattgtatttatttatttattttgagagagagtcttactctgctgcccagactggagtgcagtggcagtatctcggctcactgcaacctcagcctcccggtttaagcaattctcatgcctcagcctcctaagtagctgggattacaggcatgtgctgccatgcctagctaatttttgtacttttagtagagatgggattttgacatgttggctaggctggtcttgaactcccggcctcgagtgatctgcccacctcagcctcccaaagtgttgggattacaggtgtgagccacctcaacacaaagtatttctctgcattaactgttctcaatatatactatatacagttttctgtcttggtctgcccaagcagattgtaattccatcttgtatttttttctatataaactcatgattaacacaaactctttggcttacaaaagggaaataaatgcttaacgataaattaatctgattaaatgtcccattctctatcgccagtctctatccagattcatatcacaatttttcacatgaatgaggggttactgtgcccttcatccacatgaggaacagcacttctacaaactaagagagaaggtaaggcatatctagagagtaaggatatggcagtcaagtaggtatccagaaaataaaaataatcagaatcttttcattattcattcccattacaaggcagtaattctttttgctaacgtccctccttttggcattttccaacaaatatcaatttttaacatctgcttcactctttgtgagtcaactgtgcaactttcttgacaggactatagaaaaaataagaaatgacaccacacttctaacagtctcctagcaagccttcacatcttttgatggtttcattaaaatcctaaagaacaaaatcaaataaggctaagggaaaaaagtgaacttaccaccaaataatggttctggttccaccagtatttcctgcttttgaggaattggggcacgaacttcttctctattaaaaaaaaatgggaaaataaaaaatgaaaactgttttctgctacctgtttgctttctgtaaatactgtgaatatattcaaattaacgtagtgacttttagaagcacagtaataataagtttttgtgttgctatttttttgggggggcggtggagacagtgtctcactctgtcgtccaggctggagtggaccgacacgatcttggctcactgcaacctccacctcccgagttaaagcaaatctagtgcctcagcctccctagcagctgggactacaggcatacaccatcacacctggctaatttgttttcatatttttagtagtgacagggtcgcgccatgttggccaggctggtctcaaactcttgagctcaagcaatccacccacctcagccttccaaagtgctaggattacaggcatgagctactgcatccggctgataaatgagttttagatagtttccacataaagctcaagtggaaaagagtacctggcatatatagctcaaatggtttggaaataaaaacaatttccccttccctctcaagtttcctaccttaaattctgtcagaaaaaaagaaaaaaattttcccccaaaaaatcaggcagaaatgaacagaaaaatataggcttaatagaagcaatatcacattactactatatcaaagaataattaaatcacaaggacatattaaaataaactttaaaaggcagtgaatttcatgctaattatgaaagaggctaacaggtatgatcttggattatttactaaaaagatcctaatatacagaacaaaaaaagtaattactcatcttttaaaagcctattttcttcaaagtttacattcatagggtttactgataatccatctcttccaataagaaaaaactcatttagatatactgtaaaaatggtgtgtgcctttaaagattagtttattttaggttgggcatggtggctcatgcctgtaatcccagtactttgggagaggaggcaggaggctcacttgagcccaggagctggagaccaaccttggcaacatagtaagactccatctctaaaaaaaaaaagaaaaagaaaaaaaaaaattactttgttttacagttgtaactcaactattgaactttgctgattaatgttcacagcaaatagtaacttcctaattcattatcttcctgcttataagtattattatataagcatgcaaattccatataaatttatgttagccctaatggtttttttttttttttttttgagacggagtctcactctgtggcccaggctggagtgcagtggtatgatctcggctcactgcaagctccgcctcccaggttcacgccattctcctgactcagcctcccaaggagctgggactacaggcgcacgccaccacgcccggctaattttttgtatttttagtggagacggggtttcactgcgttagccaggatggtctcaatctcctgacctcgtgatccgcccacctcggcctcccaaagtgctgggattacaggcgtgagccaccgcgcccggccaatggttttcattcaggtgttctgaacagtattaactaaagatcttgtttttgacatttaagtgttggaactccaaaacatcctttatgaaatgaagtaggaatactcatttgtcaataattacatcctgtaatcaaagaacaaccagttaaagaaatttccaataaaccaagtgacaaaaggataattcaaaattatgttaagtaccctttcctactgctcacacacaaaatttcgataatctgaagaaacagacgacacatctataagagtaagctctgtcaatcctttcatcaaaaggaaataggccagccaggcatggtggctcacacctgcaatcctagcattttgagaggccaaggcaggtggatcgcttgagctcaggagttcaagaccagcctgggcaacaaggcaaaaccccatctttacaaaaaatacaaaaattagtcaagtgtggtggcatgcgcctatagtcccagctacttgaggcgccgaggttgcttgaacccgagaggaggaggttgcagtgagttgagagcagtaagcagagatcacacccctacattccagtctgagttacagagcaagactgtgtttttaaaaaaagagttaattatcttaagaaaactggtgcacacagtggctcacgcctgtaatcccagcactttgggaggccgaggtaggtggatcacgaggtcaggaaatcgggaccatcctggtcaacgtggtgcaaccccatgtctactaaaaataagaaaattagccgggcgtggtggagtgtaccagcagtcccagctacttaggaggctgaggcaggagaatccacttgaacccaggaggcagaggctgcagcaagccaagatcacacctctgcactccagcctggcgacacagagagactccgtctcaaaaaaaaaaaaagaaaagaaaaaaaaagaaagaaagaaagaaaacttttacctaaacaaaactttccattattgttatacctcgctttacagtgtgtgtgtgtgtgtgtatatatatataattgtctcaatctcagacaactcagttgttctataaacaaactttaatctgatgaaatgcatcaattagaggggtggattaagtagtacacttgtccttacacgaaaagacttgattactacattatctgagggtatctgtaccaagactgtcagctaccaagaatggaaggatggaacagaaaaaagtgaataaagaaaatcacactttaggaattaggagccattatcaaatgttaatcaattagcaatacaaactatctaagccaagttatatatagggcaattcattaggaaaagatattcatttatcaaaactatttttcaacacaattgagaaaacatgttttatacaatgaggataaatatgctctcccaaaacaactatgaatatttgctattcaagtttctgtattaggtggttttttgtgttttttttgttttttgttttttttttgagacaggaggcctcactctgtgtcatccaggttggagtgcagtggcacaatcatggctcactgcaacctcaacctcccaggctcatgtgatcctcccatctcagcctgccaagtagctgggactacagtcgcgtaccaccacacccggctaatttttgtattttttgtagagacagggttttgctatattgcccaagctggtctcaaactcttgggctcaagccatcctcctgccttggcctcccaaagtactagaattacaggcatgagccaccatgcctggactttttttttaaatattaaggttttcatactgatttctgttaagagtttgagctatattgggagcgaaatacatggccaacattaacagaaaaaactctacacaatattatttttattatttttttgagacagagtcttgctctgtcacccaggctggagtgtagtggcacgatctctggtcactgcaacctctgcctcctgggctcaagcaattcttgtgcctcagcctcccgagtagctgggattacaggcgcatgccaccacgcctggctaatttttgtatttttttttttagtagagacacggtttcaccatgttggtcaagctggtctcgacctcctgacctcgtgatcagcccacctcggcctcccaaagtgccgggattacaggcatgagccaccgcgcccagcctagcttcaagcatttttcatagcaactcaaaacatttctgtgacaatgtagaaaaacctaaaattgggaaatctgaactttactgggctctactgctacttaattgctgtgtagcttggggaaatggctatgcctctgcttccttattggtaaaatgttgataatgccatccaataaggtgtttgtttatttgctgctgccgtgaggcacacaggccctgctggccacgggccaatcctagcagagcaccaccacacactccaaccaaccccatctccccgacttcacagagcctacacggttcctttgaggattaaataagcaagacagtactctaaagaatttaaagtatgtaactacaaaaatttccacttcatactttttcagaggctttcagcctttcatttatttcaaaaccagagaatcgacctagctttgataaaaatgcaactacttaatttaggcaatggatagctcctgacaacacataataaattcatactctgtgtgtggtctgacagtagagacacttgctgaactggtactgggctcttcagcgattcctccaccatccaaaaacatagtgactgccatttccagattattgttgcacgcttcaagcatatgttttcctacactttcacttgcacctgaaacagtaaaaagacaggaaaaacgttaaaaaaaaaaaaaaaaaagacagcctctttcttcagctcatattagaattcccaagtaaattaatagtatttttcccttttagaatgaatgactttcttgtgaaatacacagagctagaaaaaaatgtagacattcttgaagtgaaatacagagctagaaaagaatttagcagcattaaagagtaatcatccttcataataaaacaaaaactaaataaagcattttttggccatttctttggccatttatttaaatggccaaagtatatatttgggaataagctgaaaaaagataaagaaaaatgaaagactacattctagaaagttagaaatgctttgttagaaagaatacatttcagttagcatttctgtttctgttaaaaagaaagcatcaggctgggcgcagtggctcacacctgtaatcccaacaccttgggaggctgaggcgggcagatcacgaggtcaggagttggagaccagcctaaccaacgtggtgaaatgccgtctctactaaaaacacaaaaatttgccaggcatggtggtacacacctgtaatcccagctacttgggaggctgaggtaggagaattgcttgaacccaggaggcagaggttgcaatgagccgaagtcacgccactgcactccagcctgggcaacagagcgagactctgtctcaaaaaaaaaaaaaaaaaaaaaaaagcatctttaataccaatggcaaagaagtgagatggaacattttttgtctaagacataactaagtcaaaatctggtaagaaatgtcaatcttcatcatttaaaaatgtccctattacaaatgtactcatttgtaaataaagtaaagctaacagagtctgctaaatgaaatgtaaattggtaaggtcctttaagacaacaattttacaacatgtattccagaaacaaaaatactcattccttttttgactcagtaatttgggcttctagtcaaaagaaaataaaatctacataaaatactatatgcataaacatgttcatacacatgtccagcatagcttcagtttatattgaaaagttggaaataacataaatgtctagtgatagaatgtaaattgaacattttctggccactaaaaagcacctcaagctttccatttgggatgatttttcttctatctgaattatgtcccttagaatctccttctcttggtggtaaatgctcttaagtttttgtctgcaaatgtctttatttcgctgtcattcctgacagttttactgggtattccatttcaaagctgacagctattttctctcagaatattgaagacagcattccaatgtcctctggcttctgttgttgctgctgggaaatcagttgccagactaaagaaaaatgtttttatagcaatctgttgtttctagttgcttttaagaccctctgtctttagccttctgcaatttcactctgatttgtcagggtgattttatttatcctctttggaattcaatggacttctaccacttgaagattatcttttatcaattctgaaaaattcccagtgatttatatttgatcgttgtctcgccccctccattcatacttatttcctctgtaactccaattagatgtatgttacaactcttcactctaacccttatgtctcaacctttctttcatatgcatattgtctctttgagctgtctatggtgcattgtgggtaatctcttcaatgctatcttccagttcacacattctccctttagctgtgccaatctgtttcttcacttgctcactgagcttttgatttcagctaattttttataactagaagttctgtttttgtttacgtcctcatctgcttgatcatgttttggagatccttaattcctactattccaatctttcatttcttcaaacatattaacccaacttattggaatcactaatcactaaggaaaaaaataaattttctacagtttctataggtcactgtttcttgtttctgctggatcttgctcactgtgtcacagtttttgtgtgatttgtgatttttttactgtgatgtcatgtgccttgaaattttaatctacagaattctgaagcctgggttgaaggtacatttcctcctaagaggatatgatttgacagactttgcaaggcacccacaggcactaccaaactgagaccactttaaatacacttctgacttggaggtttttcaagaccacatgagaaatgtgactgtaacaatctttgttataaattctctgtgaagatgttcatctccatacatcccctccccactgccaaggtagaagcgtcctactctctgctttatgaaggggaggagccttctttcaggcccctttccttgctaaggccccaagctttctttcctgtgacccatgagtctaccaaaagggaagttcaaagccatccagtgtggacagattccaccagacctgctttaaaggtagctaatttctgcattcttcatttttagcctggtgctaaccaataatgtattttaaaagaaactttttttttttttttttgagacggagtttcactctcatcacccaggctggagtgtaatggtgcgatcttggctcactacaacctccacttcagggttcaagcgattctcctgtctcagcctcccaagtggctgggattacaggcgcctgccaccacaccgggctaatttttctatttttagtaaagacagggtttcaccatgttggccaggctggtcctgacctcctgacctcaggtgatccacccgccttggcctcccaaagtgcagggattacaggagtgagccaccacacttggcctaaaaaatgttttttaaatacatacattcttcagcactttttttctcagcagcagggttactcatgttatcactctacattacccttactgcaagaaatggaagtgctaactctactcttaatgtctctcatttgttttctcttctgtactactgtctctaaggcaaatccttaatacttacctcaattacttcaataggctactaactgatcattattccattttctaccttgctgcagagggtatctcccaaaatacaagtctcattatatcatccctctgtttaaaatcacttcatggcagccaggcacggaggctcacgcctataatcccagcactttgggaggccaaggtgggcagatcacgaggttaggagttcaagaccagcctggccaagatggtgaaaccccatctctactaaaaatacaaaaattagccaagcatgtgagcacacacctgtaatcccagctactcaggaggctgaggcaggagaatctcttgaacctgggaggcggaggttgcagtgagctgagattacaccactgcactccagcctgggcaacggagcaagactccatctcaaaaaaaaaaaaaatcccttaatggctttcttctgctgcctgcagtataaattcaagtctttatgatctggaaagccctttgtgatcaggcctcagcttatttctctggctttgcctttcttcttcctcatcctacacagtttactatagtcaaactaaattacatgcttagaatgcccttatcctccccatcgtcccctcatctagttcatgcatgctgaaatcaaccgaaatgttactctgttgatctgtgcactagcctacctgcccgttcccatccctgtgataatgttctattatatccatggatatactactagtaaatgctggttccttttctggctcccccaaaagaatagaaggttcttgaacagaggaactggttttcttgccttggtatctcccagcacctggcatcacactttgcttgcatgtgatcaatgtctgataaacttagtgatatctcatagtactttaactcattagctacatactagagagagggagtaggccttagtcaaaaccactggcaacccttttataacaatttaattttgcactttgtgcatatacttatgttttaaaattaatttataaagcagtacagttatgctgtggaaataaatagcaaatggatacgctggattcatggatttaagataaatttaaagagaagtgaaaataacaggcttcaaaaaactagcagatggccgagcacagtggctcacatctgtaatcccagcactttgagagaccaaggcaggcagatcacctgaggtcaggagttcgagtccacctgaccaatatggtgaaaccccttctctattaaaaatatgaaaattagccggacgtggtggcaggcgcctgtaatcccagctactcgggaggctgagacaggagaatcgcttaacctgggaggcggaggttgcagtgagccaagatcgtgccattgcactccagcctggggcacaagagtgagacttcgtctcaaaaaacaaacaaactagcagatgacatggagtagctatagccttttctgatagctgataaagatatatatttaaggtgcaaatgaaaacaaccaaataaactcatttcataaaatatgactgaaaaaaggcggccggccaggtgcggtggctcatgcctgtaaacctggcactttgggaggctgaggtaggtggatcatttgagctcaggagttcgagaccagcctggccaacagggtgaaaccccgtcttctactaaaaatacaaaatcagccaggcgtggtggcaggtgcctaatagctcccagctattagggaggctgaggcaggaaaattgcttgaatccaggaggcggaggttacagtgagctgagatcacaccactgcactccagtttgggtgacagagcgagactttgtctcaaaaaaaaaaaaaaaaaaagaaaaaagaaaaaagcatgaatatacaacgtgtgtaataatgttaaatcaataaatattaccaaagaaagcacctgatcatttcacttaaatctctagaaacgcaaatagttgacggtcaactgttttttttagtaccagcttatacccattaaaaaggctactattaaaaaacaaaaaataacaagtgtgggtgagcatgtggagaaactggaaccaccatgcactcttgatgggaatataaaatggtacaacgagggtggaaaactatggagattcctcaaaaagctaacaacagaatatgatccagtaatttcacttctggagatatacccagagaactgaaagcagggtctcaaaaatatatttatatgcccactttcataatagcattattcacagtaggtaaaacatggaagccacccaagtatacatcaacacatgaatggataaacaaaagtagtatattcatacaatggaatctcatggagccttgaaaaagaaggaaattcggacatgaatgaaccttgaggacattatgctaagtgaaataagccagtcacaaaattacaaacgccatatgattctacttatgtgagacatttagagcactaaaaatcgagtcagaaagtagaatgatggttgccaggggctggaggaaggtagaatgaggaacagggagttcttgtttaatgggtatagagtttcagttttacaaaacaaagagttatagagagggacggtggtaatggttacacattattaatgtatttaataccactgaactgtaccctgaaaaatggttaaaatgggccaagcacggtggctcatggctgtaattcagcactttgggaggccgacgtgggcggatcacttgaggtcagttagagaccagcctggccaacatggtgaaaccccgtctccactaaaaatacaaaaattagccaggtgtggtggtgggcacccgtaatcccagctactgggcaggctgagggaggagaaccgcttgaacccaggaggcagaggttgcagtgagccgaggttgctccattgcacttcagcctgggcaacaagagcgaaactctgtctcaaaaaaaaggttaaaatgataaattttgttatatacgtgttaatacaatttaaaaaattgaaaaaacaaacaccctttttgggaaatttagagaaaatcgcctttcatttggggtctgccttttatctaggtatatatggtaatttaagttacacagaaccagggaggtttttcctttaaaagagcttcatacattactcaaatttgagaaacattcttagacccttctttctcccccgagtgaacatcccatcagttaaccaaagagagctatagttccttctagttaataccactcctaaccaaccttttctatgtccactgctacagtcttagttcaagccctcaacatctcttacatgaattactgtatctcacacctcatggccccctttgatatagtcatccctccagtatccatggggcactggttccatgactgtccaaggataccaaaatttgagaatgctcaagttcttcatataaaatggtacagtatttgcaaacaatctatactttaaatcatctctagattacttatagcacctaatacaatgtaaatgctattacattgtacctaatacaacgtaaacagttgttatactatagagaataatgacaaacagaaaagtctctacgtgttcagtagagatggaacaatgttttctttttccctgaatattttgtttcttttttgctggagtgcagtggtacgatctccgctcactgcaacctctgcctcccaggttcaagtgattctcctgcctcagcctcccaggtagctgttctgttgccaccaccatacctggctaatttttgtatgtttagtagagacagggtttcaccatgttggccaggctggtcttgaactcctgacctcaggtgatccgcctgccttggcctcccaaagtgctgagattatttacaggcatacgccactgcacccggccttttccctgaatattttcaatacgcaggctaaattcaccaatacggaacccatgaatatggagggccagatgtaccttcgacacagcaaaataatgtaagttcaattgtctgtcttcctatttcaacagttctgtattgctgattgaaaaagttttaatccatctcaagctgcatacaagatttgttccttacccctcccatgttatatccctctactctcatctcacctctgtaccattcccttcagccacatggacctaccggcatcatctaggcagttcccttggtaggactttataaaaccctatctttgcatgatttggatagtggttgggacaacaaaccaaacacccacctttctgttacgttctgaacatttcctctgcctcctcactctgaagcaggaacaaatatatacttttccattgagtcataatctttacccttgtctctgctagctgctctgtctctcagactttaaaagctcactcaactagcgcagatctcacttttctcatcccagttacattcttcctaagttctcagtggagctgaaccaaaagttaagttgtagtatatacaaatttaacattctaaccaacagaaaacactttaaaaaatgaaatatcaaaacaaaaacacaaatgcaactttttgaaggaaaggaaaagttctaatatccccacagccaaccttatgtaactaaatacaaattcttggggcaaaaacagcacaaatttgataaacaatttcaagacacatatgctaccatattcttactcataaaacctgaggctttgtttcagtgtttccctaatatttgtacattgcctccagttacattgtgttgtattatcatacttcttttttttttttttttttgagacagagtctcgttctgttgccaggctgaaaagcagtggtgcgaatcttggctccctgcaacctccacctcctgggttcaagtgattctcccgcctcagcctcccgaggagctgggacaataggcgcacgccaccactcccagctaatttttgtatttttagtagagacgggatttcaccatgttggctaggatggtctcgatctcctgaccttgtgatccgcctgcctcagcctcccaaagtgctgggattacaggcgtgagccaccgcacccagccatattatcatacttcttgaatgctggactatacaagttcagcaggctgggtgcggtggctcacacctgtaatcccagcactttcggaggccgagacaggtggtcacgaggtcaggagctcaagaccatcctggccaacatggtgaaatcccgtctctactaaaaaataaaaaataaaaaaattagctgggcatggtggcgcgtgcctgtaatcccaactactcgggaggctgaggtaggaaaatcgcttgaaccagggagtcaaaggttgcagtgagccaagattgtgccactgcactccagcctggtgacagagcgagacttcatctcaaaaaaaaaaaaagttcagtgactactgtgctctaccattttaatttagacagcagctaaaaattaaaggtttcttacaggaagactactttcggctgcttgttctagcagagatgcacaatctgttaacatctgcgtcccaatgaaccctaaaactagcttctcaatgtatggaccaaactttcttttcagagaattaagtggccaagttcacactattttggctcttgtctaagtgctcacaccgcattacagcaccacaaaaaagcagaaagaacatgttgatggtgaagtgaaactcacttctgccataacagcaaccaatgctggctactttcattcacaaacttatctggtcataggaaattcaacttacaccgggtgcggtggctcacgcctgtaatcccagcactgtgggaggctgagcggggggcggatcacctgaggccaggagttcaagaccagcctggccaacatggtggaactccatctctacaaaaattacccgggcacgatggtgggtgcgtgtaatcccagctactcgggaggctgaggcgggagaattacttgaacccaggaggcagaggttgcagtgagctgaaattgcgccactgcactcctgcctgggcgattgagcaagactctgtctcaaaaataaaaaaaaaaggaaaaaggaaattcaacttaaaaatgccactgcatacaaatattgttgccaccctttctaccacccttcatctaccagaactccaatgccactgccaggggaaccatttagagaatttgtgggttctgatgagaatcagaacttgtgaagtcaatcctcaagcaagcaggcctgtcaacattttagtctgcctagcccaagtcttttcctaagtgcagtttttttccacgttattatgctacctaaaatacttccaattcagagattaatttgggtaaacaaacattctatttaaaaatatgaagacttactagagttaaggatgtatcaatcatttcataacataaattaattcaatcatattgccttctcttaaaagctagtaacaatacatttagagtcgatatacagaggaaaagggtgttgatttagaagaagagggatgtaagtagctttagtgtcacaagtgcctttttggggagaggtaagaaaggcctgcagtaccacgtgagggcaacttagggcaggaaaagacactgaacacctggagccacagacacagcaagaagttaaaataaatgtacacacaggcgcggcggctcacgcctgtaatcccagaactttggggggccgaggcgggcggatcacaaggtcaggagatcgagaccatcctggctaacacggtgaaaccccgtctctactaaaaatacaaaaaattagccgggcgtggtggcgggcgcttgtagtcccagctgctggggaggctgaggcaggagaatggcgtgaacccggcagcggagcttgcagtgagccgagatcgcgcgactgcactccagcctgggagacagagcgagactccatctcgaaaactaaataaataaatcaaataaataaataaatgtataaaaacctttgcctccgccctgtcttatgcccagtaacaaagagaaaatattcttcaaattcccttctgtactcatgctaaggagcacagaagatatgatttaataagagcctgggaactactcagctaaacctgggttcgaccttctacttctgtcattcactagtgtgactctgagtaagatactaatttctctaggcatcagtttcctcagttataaaatggggatttatcaacttcatgaagtgctaccatgaattaaaagaattcagctgggcgtggtggctcacactgtaatcccaacactttggaaggccgaggcagacggactgcttgagctcacaagtttgagaccagtctgggcaaaatggttaaaaaaaaaaaaaaaaaaaaaaaaaaaaaaaaaccatctctacaaaaaagattagccaggcgtggtggcacatgcctgtagtcccagctactcaggaggctgaggtggaaggattgcttaagtccaggagttttgaggctgctgtgagctatgatcataccactccaacctgggtgacagagcaaaatcctgtctctaaaaaaaaaaaagaaaagaaaattcacattaaagaacttgggatacctcttaattagcagttagctattaataaagactggccaggcacagtggttcacttgaagtcaggaattcaagaccagcctgaccaacatgtgaaaccctgtctctactaaaaatacaaaattagctgggcgtgatggtgggagcctgtaatcccagctactcgggaggctggggtgggagaatcgctggaacccaggaggcagaggttgctgtgggccgagatcacgccactgcactccagcctgggcgacagcaagactccattgaaagaaagaaaggaagaaaagaaggaaggagggagggagggaaggagggaaagagagaaggaaggaatgacggaatgacggacagatagtcccaagtttacagtactctatacgtaaatgacatggaagtataaagtgtgaatatatatagcttatggagaaatacatttttgacagtaaacaggcagagaaagacatctcagttttctttttctcactcatctgatgctatgaacatgtgtctcattcaagttgaacactcatttttttaaaagcagtacaatgaagacagcaaaaacctattacactagaaaaaagtgaatggtatgcatagagaacaacatgatacacgaaagggatctgcttcaaagacatctataacagcactccagtgtgactgagaagcactgagaggtgatagggaggcagtagaaaactaaatacaagtacagtatgtatgtattctagaatttctaaagattcacaggtctatagagctaaacattaaaacagaaaggattctacagagaatgacattacgacacaacaaataaaaccatagtaacggaagtaacaactgtaatattttggggcacatgatgtcaacactcagggtccagagttagaggatagggaaagactactttgccatcctatctacaatcttcacacaatcatttaatgcgagaacctaacctttagggagcatattcctgagatggtgctaccataccactggtaacaatctgaggtcgagcgcggtggctcacgcctgtaatcccagcactttgggaggccgatgtgggtggatcacttgaggccaggagttggagaccagcctggcccacatggtgaaaccccatctctactaaaaataaccaaaattagctgggcctggtggcgggcgtccacctactagggacgtcccagctactagggaggccgaggtggaagaatcacttgaacccagaaggcgtaggttgcagtgagccaagatcacgccactgcactgcactctgttgcctgggcaacagagcaagaccctgtctctaaataaattaaataaataaataaataaataaataaataaacaatgtgacaggatgacttccatctttggagtctgtcaggatagtgaactgcaagagcgttccaaagaaagtaccactacacatgcagattttttaaaaggaagcacatgctaaatcttggttaagtctgaacaaagccagtgctagaaagaagcccatgaagcaaagtataccatccactttcttaaacaaagccaagctaagccatctgttcccgtatcatcagttgttcttagcgtatcacttagtgaatcatttcagaaacaggagctaactgaaagataattaaaggttccagtggttcttagtgtcgaagcactagaggcattcagtaacatgagagaccatttttggtgtttcatgcctggggagtcggggatactactggcatttcatggagagaggccaggggtgatgtggtggactgaaaaacgtcctccaaaagactactcgaaccttcatttcagacttccggcctccagaaccatcacagaataaatctgtgttaaaccactcaatttgcggtaatttgtcagcagtcaaaggcaactaaaagtattaaacttctggaatggatagaacagtcctactgtaattgccaataacactaccactgagctacacagaggaatatgaagaagtgaaggttaactgaaagggaagaggaaaagtaaggagggctaaatgatgtaagtgagggaacagtgataaacaagtttagtgaagttacacattttacccacattttacctatgcacccaagagggacttaacaatttctgatggatcagctgtaaagaatttggacttctatcttactacagttagaagaacatacctttttttttaagggggggctaataaaacaagtttgacaagtttacgatttaaactatttgcaaacttgttaaaaatgggctttttgggactgggtgcagtgtctcatatctgtaatcccagcactttgggaggccaaggtgggtggatcacctgaagtcagaagtttgagaccagctaacaccgcgaaaccccgtctctactgtaagtacaaacaaaattagccaggcatggtgatgcgtgcctgtaaccccagctactgaggagtctgaggcagaagaatcgtttgaccccgggaggtggaggttgcagtgagccaagattgcgccattgcactccagcctgggtgacagagcgagactccatctcaaaaaaaaaaaaaaattaaattaaattaaaaaacggacttattttgaggctccgatattgtaggcagcagcagggtggcttaatctaatccagtcatctatactccatgacaggagtcctactttgtttctcaccacatgaacccccttctaaaacatcctttatctgtccttctctccatctgttttacacttgctactgaatggcaccaaacggccttccttaacccagctgtggcacacaacttatgatggccattttcatgctgctatctcctagtttatactctaatgcacattgtctacactactctcagtgccaaaagacggacagtgatcatctcttcactaccatccagaaaccaaagtatagcagtcacagagacttttaaaaacaatcatcatcatccctctatagaaatgatagggacaagaggttacttttcggttccacattttccccagcaatgataccaaagtaagctaaactatttgccaaggatatgggagtggatgacagttgtgagaaataagctgaaattttaacctcagtctctaatcctggagtttttaagctttcaaatatcgaaaacatttttaaatgcataccagaaaaaactgagtacagagaaatcgaattactaagttaggggacagataaggcaaacattcattagttcacaaaaggaaccaatggtgcaggaagtagtgctaatggtgggaaatgcatgcgcccaggagccaagatgccagagttccaggccctgttctgccatcacctaggccagtactacccaaatggtagtccttagaccagctatctcttactagtctgtgacaagataaaaatacaaattccagtggaagcattcagaaacgtttacagcaatttgagagagtaattttatgtctgttgaatctcataattaaaagttggggcttgaaagatttatggatagtggccgggtgtggtggctcatgcccataatcccagcactttgggaggctgaggcaggtggattacaaggtcaggagattgagaccatcctggccaacatggtgaaacccccccccagtctctagtaaaaatacaaaaaattagctgggtgtggtggcaggcgcctgtagtcccagctacttgggaggctgaggcaggagaacagcttgaaactgggaggtggaggttgcagtgagccaagatcgcaccactgcactccaccctggcaacaaagcgagactccatctcaaaccaaaaaaaaaaaagatttatagatggtaagttattacatgaaaaatgccccaaatcattagtcacctgagaaatgcaaattaagaccacaatgacataccattacacacttattgaaatggctttaaaaaaaacaatggccaggcacggtagctcacgcctgtaatcccaacactttgggaggttgaggcgggcagatcacttgaggccaggagttcaagaccagactggccaatgtggtgaaaccctagtctctagtaaaaatacaaaaattatccaggcaaggtggtgcacgcctgtagtcccagctacttgggagggtgaggcaggagaatcgcttgaacccaggagacagaggctgcaataaatcaagatcacaccactgcactccagcctgggtgacagggtgagactccatctcaaaaacaaaaaacaaaaaagcccaggcgtggaggctcacacctgtaaccccagcactgtgggagaccaaggcaggagtttgagaccaacctaggcagcacagggagacctcatctatacagaaaattaaaaattagctgggcatggtggtgtgtgcctgtagtcccagctactcaggaggctgaggcaggaggattattgaccccaggagcttgaggctgcagtgagctatgataacacggctgcactccaccaggggcaagagaatgagatcttgtctcaaaagaaaaaaaaaaaagacaattaaaaataccaaatgatggaaagaatgcagaacaactggaactctcttttattactattttttaatacagatgtgggggtctctctttgttgtccaggttggcgtcaaattcctggcctagagcaatcctcccgcatcagcctctcaaagccactatactttccaaagtgactttggaaagtcactataccagaaagtcacaaattatttgtcagcttcttagaaagttaatataactattattatatgatccaataaacacactcctaggtatttatcaaaagatattcacacacttgtacacgactgtttttggcagctttatttataatgtccccaaactggaaagtgtccttcatttgataaatgcataaacaaaccacagtacaaccatacaatggtatactattccccaataaataggaaggaactactaaccatgacaacatgaatgaatctcaaacacaatagtttaagagcaagaagccagactcaaaaggttacatattgtgattacacttacatgacattctggaaaacaggagactaaaaacagactaggctatgggcagcccagcccgccaagtcctcgcctggctgcatgccagcctgatcaagccataaccagaggacacaacagcccaacctagcggggccagtcaccacctggtctggggatcatctctaccacaagcggctgaggcacagctgccctggggagggcggaaggccaggcatgtgggctaaactggcaggtcaccgcaacatgtaagtgtttccacgccagcaaacatttactgagtatctaccacgtataagaacattggcaacaagccctccaacaagccggtccctgagaggagcatgtggacagtgcctgtgtgggccaatggaccctctgtggagctggccccctcatccgctccagattgtggcctggccactgtgcctcttttcttggctgtgatggggcttggggtacttgttcccctcctgcctgaccattaggtgccagctggcttcactgtatccttgggaaactgtggagctgggtcatggaagagtggggacatggcagaggcctgaaactcagctcagagcctcagggagcataaggtggggcatagcaggacaatcccagtcttggagacaagttgcttatctgcctggcctccaacccccatctgacttatccacttgacaaggtgagtggataaacccaaagtaccttggggcacttaaagtcctgcatggatgtgaattttatcaactctaagattctgaagcaccacagggacagaagagagccatcttgaagctaattgtgttagctaaacaaaggactaattagagactaattattccatttacaaaataatttttcactttttttttttttttttttgagacagagtcacactctcttgcccaggctggagtgcagtggcaagatcttggctctctgcaacctctgactcccgggttccagcgattcacctgcctcagcctcccgagtagctgggattacaggtgcccaccaccatgcccggctcattttttgtatttttagtggagacagggtttcaccatattggccaggctggtctcaaactcctgatctcatgtgatccacctgcctcaacctcccaaagtgctgggattacaggcatgagccaccacacgtggccactcctgatgctttaagtgccatgatactctcctggttttcctcctacatctttggtttttcctgagtcttctctgcactttcttctttgcagtcccccggatgttggtgttccttcagcattgtgtcctggagtctactatttcccacactacactccctcctgcaagatgccatcctttctcttttcctaatttttttttttttttttttttttttttaagagacaaggtctctctctgtcacccaggctggagtatagcagcaggagcatagttcactgcagcctcaaagttctgggttcaagcaatcttcccaagtcaaccaggattacaggtgcacaccaccaggcccagttaatttttttttactttttgtagaaacaggctctttgctatgttgcccaagctggtcttgaatttctggcctcaagcaatccttccaccttggcattccaaagtgctgggattaccggtgtgagccactaggcctcgcctcatccatttttataacctttttttttttttttttttgagacagagtctcgctgtcgcccaggctggagtgcaatggcgtgatctcagctcactgcaacctccgccttccaggttcaagcaattctcctgcctcagcctcctgagtagctgggattacaggcacacaccaccatgcccggctagttttgtatttttagtagagacggggtttcaccatgttggtcaggctggtctcaaactcctgacctcaggtgatccactcgcctcggcctcccaaagtgctgggattccaggtgtgaaccaccgcacctagccccatttttataactttaactgccatgaatatgacagatttctcactcttctttctagacccaaatattcatctgcttcaacagctccatctggaagtcctattagcagcaccttaacttatccaaaactgagctaaccatcttctccccacacctttctgctattccataccttcataaatagcactgttacatacctaggtgtccaaaacagaatcctaaacttcattttgactctgatttcttcccataccttttggagtccacttctccgccactaacttttttcaggacaccactatctttcttgggttaatataacagccttctactgatctctgtgcctatctcttctccattatagccaagtaactctttctttaaaaaaaaaaaaaaggtcaaatcagatgtaactccttttttaataaataaaattttaatacattttgtagagatggggtctcactatgttgcctaggctgatctcaagctccaggcctcccacctcagcctcccaaagtgcgggaattataggtgtgagccacagtgcccagtctcactcctctaattaaaacccttgactccccactattctcagaataaagacaagattttttttaacatggcttataaggcccaacccaatctcccatttatctcttgaggtccatttattgcactagctgtgctttactcatttggaattatcaattccctaaaccgattgtctcccctctctcatctctgtctgtatacatgtctgcccaattcccctccaagtctctgcatgtttctcctgcaagaaacatcttccagattttagataaaaaagtatttattctgggaaggttttcttgacctccctcttttgtgctccagtattagctccttaccattctctcactgtattctaatacctattcgtgtgtctctattcctgttaacctttaagctttctgaggacagacaccacgccttgctcacagttgtatccttaagatgtgaaccatgcctggcacgtagcagtctaccaataaatgaatctactagtaagattccattcgcaactcaaaattacctcccttaaatttctgaaacttcagccaggcatggtggctcaagcctgtaatcccagcgctttgggaggctgaggtgggtggatcacctgaggtcaagagtttgagaccagcctcgccaacaagatgaaaccccatctccattaaaaatacaaaaaatttagctgggtgtcgtgacgcgcatctgtggtcccagctgctcaggaggctgaggcaggagaatcacttgaaccggggaggcggaggttgcaatgagccaagatcacagcactgcactccagcctgggtgacaggataagacttcgtctcaaaaaaaaaaaaaaaaagaaattctgaaatgtattccctattgaaactattcttaaaattcctgaagttttctcttaacatctataatactgtgaccacctttccagacacagagaacttaatcatagtttaatattaacccaagagaaaggaaatgttctgtacaaaagcatatgaatgaggccaggcgcggtggttcacaccggtaatcccagcactttgggaggtcgaagcaggaggatcacctgaggtcgggagttcgagaccagcctgaccaaaatggagaaaccccgtctctactaaaaatacaaaatgagccgggcgtggtggcgcatgcctgtaatcccagctactcaggaggctgagacaggagaatcgcttgaacccgggaggtggaggctgcagtgagccaagatcgtacctttgcactccagcctgggccacagagtgagactctgtctcaaaaaaaaaaaaaagaacatgaatggaaattggccataaagttaaataccacaaacatgacagcccctaatttttataataaatatgcactcatcaaccatctgaaagattaaggtctcttctacaactgaggttctataattttctcaagtatgttattgccgctatgcacaaagctctatgaatttccgtaccagtaacctcttgtactcttcttagcctccactttctatgccctcacatttgtccttagactgctagcttatttttcacctgttctatagtgtctatgtatccctcaccttcactccatgaattattctgattacacatgtgcaccagtgtatatgtgtagtggatgtcagcccaaagttggtgctaatggaatactgccatggctcaaaacatttttacttttatttactttttctttttttgagacagggtctcgctctgtgctcgcttcagcagcacatatactaaaattggagacagagtctcgctctgtcgcccaggctggagtgcagtggctggatctcggctcactgcaacctccgtctcctgggttcacgagattctcctgcctcagcctcctgggtagctgggactacaggcgtgcaccaccatgctcagctaatttttgtatttttcggagagacagggtttcaccaggttggccagactggtctgaagctcctgacctccggtgatccacccgccttggcctcccaaagtgcctgggattacaggcgtgagccaccgcacctggcttcaaaacatttttaaaaattgctctttcagaatagatccagctgcatatttttccttcatgttttgagaattgatatgacttctgagttttcaacagtaattcaaagccatgtatgataaatatcagaggagatcaaacagtagtattgtaaaatgtggaatgactataaaagtaacaagactggttttcttatgtagctttaaatgacacagaaagcatcagtggggccggttgcagtggctcacgcccataataccagcactttgggaggctgaggagggcagatcacttgaggtcagtttgagaccagcttgcccaacatggtgaaactccatctctactaaaaatacaaaaatcagacgggcatggtggcttgagcctgtaatcccagctactgcggaggctgaagcaggagaactgcttgaacccaggaggcggagacagcagtgagccgaaatcatgccactgcactccagcctgggtgacggagtgaaattctgtcgaaaacaaaaacaaaaacaaaaacaaacaaaaagcaagcatcaatggtaaaccatactgtatacagcttctcagtgtggttacttcaaaggtcatcacttctcttggctacctgcttatcagtctgaccatgcaaaaaaggtttgtagcataatgttaagtgaaaatttcagaaccgtgtattttagctgggcatggtggcacatgcctgtagtcttaactgctctggaggctgaggcaggagaatcacttgagcccaggcggtaaggatgcagcaagctataattgtgccactgtactccagcctgggtgacagaacaagaccgtctttaaaaaaaaaaaaagaaaaagaaatctcagaaattgtatatactatgatccacaatgtaaaaataagcatataaacaagaagtggaagataatatgtaaaataaatattgctgttgtgagaaggagaattagttcttttcccttttatcaaaattatttcggccaggtgcagtgtcccacgcctgtaatcccagcactttgggaggccaaggtgggtggattgcttgagcccaggagttcaagaccagcctgcacaacaaagtgagaccccatctccacaaaaaataaagaaagttaccctagaggctgcagtgagccgtgatcacaccactgcactctagtctgggtggcagtgtgagacccagtccgtctcaaaaaaaaaaaaaaaagtttttatgatattgtctttttaataatcttttttaatcagccattactgaaccaggcacagtgatgtgcacctgtagccccagttactgggagggctgaggcaagaggatggctgagcccagaaactggagaacagcttgggcaacaaagagaggagacctccatctcttaaaaaaaaaaaaaaaaaatcaaaaatccgtcattaggccaggcgcggtggctcacacgtgtaatcccagcactttgggaggccgaggcaggcggatcacgaggtcaggagatcgagaccatcccagataacacggtgaaaccccgtctctactaaaaatacaaaaaattagccaggcgtggtggcaggcgcctgtggtcccagctacttgggaggctgaggcacgagaatggtgtgaacctgggaggcagagcttgcagtgagccaacatcacgccactgcactccagcctgggtgacagagcgagactccgtctcaaaaaaaaaaaaaacatcagtcattatttcatactcactgaatcagagagagatctgttctattcagtaagaaataagacttttctaaaatctttcaattttccgttctatttctaaatgccaaaaaaagataagactcacatttatttttattttttctttttcttttttttgctcctgcctaaaaagtaaggactcacatttttgatgatgcatttgtttttacaagaatattgagcttccaagtaaaacctttgtgaaatcagagcataagctattaaggtcactaaaataaatataaaataccttttaattataaacactacgattaaaacgtatgtggagagaaccccaaaaaaattttaagacatgtaaaaaaggcaaaaagaaatcaatcatgtgtttctaacggttaatcactatcttgtaaaaagaatcccaaaaattatcaatagaaattcacaatatttgaagaacactcaaaggtattttcgctctgtagatctccagataccactgtctactgattgagggactccaacttgatccagcaatcaagctacgtagacgaacagaaacagaattaaagcaattaagtgagtcaattcaactcaccacacttcggtttttgtgtgtacctaataaaaatgttgcaacagaagaagtaatgtggcgttaaaccaatcagagtttgggaagagtagtaattagcataagaaactgaaaattaattaagtggcttttagggccaggcgcggtggctcacgcctgtaatcctagcactttgggaggctgaggtgagtggatcatttgaggacaggagttcaagaccagccaggccaacatgatgaaaccccgcctctactaaaaatacaaaaattagccgggcctggtgacaggcgcttgtagtcccagctactcgggaggctgagacaggagaatcgcttgaacccgggaggtggaggttgcagtgagccaagatcgtgcctgggagatctgcactccaacctgggcaacacagcgagactgtctcaaaataataataataataataataataagtggctttttttttctttttgagaaatgatcttgctctgttgccagggatggagcgcagtggtatgatctactcaccgcagccttgaactcctaggctcaagcaatcctcccacctcagcctccccagtagctgggactacatgtcggtgccactacatccagctcattttcttatttctgtagagatggggcctcactatgttttgcccaggctggtctgcaactcctcgccccatgtgaatctccagcctccgtctcccaaactgctaggattacaggcgtgagacaccgcgccaggcccaagtggcatcataaaccatctctaggaaatctaaaggattaataatgatattcacttctctatcagattcactgcaaagatttttctatataagcataatgcagcaacactaacttatatacacaataatcttctccatagcaatgatttgtcagacattaggaaatcctttacatatttaatataataatccaatcctttatatcttcaataatccaatcacaaagttcaaaaatattaagagaagttatcatgcaactcctcaccccaattttattgcaaattttactttactttgacctgatgttccatgcccacaagctagataacaatgcgtcaaatatctcgttatcattgcaaagcaaaaaaataaaacttgctttaatataaaacggtaactagtatacaacctgtagtagttaaaacaatataaaattttacttaaccagatattgcacgttaaactctaggaacattaacagtggaaacattctccgcatctaacaaattacgagataaagtatagatccgttgagagggaactaacattctgacctccttccaaaacgacaaactagaacggcaaaattacactcaggcacattggagtactcttctctcaaatcactccacagagaacttcatcatttgctccgccctctaataactcatgcaagaaaagttcagcaccatcagagagaaacaagacagagagaattcatagaatggctttagggcctttcctccaggcggtaagaggatctgcgtgtgtccttcgcaggggtccaaagggagagaacctaggcctagggtttcggggataccgacacccagaaacagattttctctcaaagaagtttctgccgccatccctatcttatcagcaggaggccccggcgccatcgtctccgtctttatgattttattatggggaggtgggaaacgccaccctggattcttccaggcctcccctattcagcttgggggttccccctcattcttccctcaaagcctcagtccctgaggtcctcctcagcaccccccgcttctggcggcctgtcccccgtgaagtgtaaaggcacggccgaacccaccggccttgccgtgaaggcgggagggcccgaacccgccagggccacggcgatggctccgaggggcccagaaaggggaagggcaggccggggaccggggcagaatgacctggccggggaagaaaggaaaaaaggaggtgaggagatgcaccgcaccgcagggctgcacagagaagggaagatgatgaaggaggaggaggagggcggtggcccgggtgcggccccctactcctcccgcccccgggtccccgggccggcgggggcggacggactcggcccattcccaggtctgggctggcggggggttgggggatctccctccacgctactaggagacagagaacgagggtatcgggagcgggggggggctgtctcccgcctgaacccggagaccccgacgccgtcgtcgcctcttcctcaggagggaggacggcagctgtgggtaaagcccgaaggaggaatgcctgaaggtaaggggaagcccggggcagacccgctgcccgctccggaccccactctccaccttccggtaaccgcgtctcttaccggtaatggtggtgaactgttgaattaaccccttcagcgccgaggacgccgcggagcccccgtgggcagccatcttaccgccgccgccgccgccgaacaacaacacagacacacacggactgccctcccccacttcgccgtgcggtgt

SEQ ID NO: 2135 - DNA, 14356 bp, Homo sapiens
attcttcaaatgtttttattggatttaaaattcatttaaggggtatacagatatacaactagtttgatcagctactaatatattttggtgtccctttatttttgtacccaagagccagttcactttttctccatgttcaatatttagctttggtaaaatgttgccatgttcttcctcatctgttactgaagcgttagtatttccaccctgcttggtgcaagttcctcttttaggtttcttcctgtgggtacgttttgtgggactcttctgttttttctcaacttcactgtttgcatcccacaacgtgatcttcccatcattccctccagtaagcagcaaataggattctgggagaaagcagacctgggatacccctgaagtgtggcccttaaatcccagttcctgttcacacttaactcccatcacccgaaagattcgaaccttaccatcttctgcaccacaactaaaaatattaccacacgaagccacagagatagaatgggctagggcagggtttaagagctgaccaggtgactgtgggccttccatttcttctgtttcatcctcctgtaaatttgtaatccagagtggtcgggctttttgaagactccacagcatcacctttacataagaagaaattacacagtcatacaaaatgctagccaatttgctcaactatcatgcttattcagcttctaataaaatcgttaaagtagtctgagaatgagcagtagtgcacgttctcagcagtattaaaaaataatcaaatgctgccataacatgccagtggaatgctaccccgggactaaaactagagtgcggttaggtagaattaaacaagatcctgaataatttttgattaataaactccattaaagtgtaattgttaagcagctgccagtttctaaaggtttttctgctctcatctcttcaagtaaaaccaaagattatcaaatttgctagttttagtctatgctggttataggtcaaaaggcctatcaactaaataaactcgatctggactatcattgaaatgctttccatctggaatgccttcctttcctttcacattacccaattacccatccaaggggcttaagctcagtcctggtgcctccaagaaggctttcctatttcagcccgcttctccttcctgtatctagtttctattctattaattgacatattctactagcttatcagtttcttgagacttacttagtctttgctaatgcctagcataatggctgagaaagaggagaaattccaaacatgtctgttgattaatatgacatcctggtattaatttcatttggcttttcgttgttcccgacctggtgctttttgttttttttaaataagctttgtgaatgggttttacattatcatctagtgattcattcttttcctgtatcaaccattttgcaaagaaaaatactcttaatactttcaaagcaaacagacagctttatcatgtagtttaccatcatccctgaattataactcacaattttaacagacactggaagaagcatgagcttgtttagacagtgaaaagcatagatctgaattggcaagattactattgctaatgctattaagaatttggtttcctattcaaggtaacttcccttatgattattctcagtggcctattttcaaaagcagtgacatctagtaacacttacattctgcttctcttagatgaaaatctctttgaattggatttataacattatactatgtgactaacaatcactgtttgggtgaagttaaagtacgaacaaattgaaataagctaaagtaaaataaataaatattagaaaatataacacgaaggagtgctgaaacttgatatgaaaatagttttttttttaaaaatagggtctcactttgtcacccaggctagagtgcagtggcatgaccatggctcactgcagccttgacctcttgggttcaagtgatccttccacctcagcctcccaagtagatgggactacaggcgcatgctaccacacccagctaatttttgtatttttttgtagagatggggtttttgctatgttgcccaggctggtctccaactgctgggctcaagcgatccactcatctccacctcccaaagtgatgggattacacgcatcagccacaatgccccaaaacagtttctattaaaaaatctgaacacggctgggcacggtggctcacacctctaatcccagcactttgggaggctgaggtgggcggatcacgatgtcaggagatcgagaccatcctggctaacacagtgaaactgcatctctactaaaaatacaaaaaattagctaggcatggtggtgggcgcctgtagtcccagctactcgggaggctgaggcaggagaatggcgtgaacctgggaggcagagcttgcagtgagccgagatcacaccattgcactccagcctgggcaacagagcaagactccgtctttaaaaaaaaaaaaaagaaaatacacacacacacacacagaaaatggacattctagaatctgctagcttcactgtattggcagatagacccagttctttctcatacagcccttatgaatggactgtattttctgtcctccaaagacattcaaacatgcactgcacccagagtgtttcagcagctgaaacaccttttgtatttgacttaaatcatctaaatgtgttaacagccatcccagattctaccaagtctagaatcatttccacgtattgaggattccagactgttcctgtctggacattccctttatgcttcttgacttttctaaaatgctaaagactccaaggtgtttcacacttaatttctcaaccagctgttcaagcagttctcatcctaatcaagagagctagagatactgaaagaaaagaataaagagtttggggcttatggttctgcaaaacatcgaagggagaaaaagtggggaaccagcaaatgttcagaagtgaatgtaatcataacaaagtgacctttcaaaacaaattccccttttacaaaaacatttctttccacataaaagactcgtcttcaagataaagagcctcttcaggccaggtgcagtggctcatgcctataatcccagcactttgggaggccatggcaggactgcttgagcccaggagttcgagaccagcctggggaacacagggagccagccctcctctgcagcaaaaataaaaaaaattagctgggtgtgtcggcttgtgcctgtagtcccagctatgcaggaggatgaggtgggaggatcacctgagggagtgcgaggctgcggtgagctctaattgtaccactgcactccagcctggatgacaaagaccctgtctcaaaaacaaacaaacaaaagagccttctctaccatcctggtctgtaagtgttgggattttggttttaaaaatccagaaagaacaacaaacctttcaatcatttgttttcagatgcagaaaggggcagggaaagaaaatcaacatgtatgctacagaaatatgacagttttaattttctaagtctttcaagaaaaaaactatagttgaatggtaggtatacaggtatttatttaattttttttcttttctttttttttttttgagacaaggtctcactgtcacccaggctggagtgcagtggcacaatcttggctcactgcaacctcaacctctcgggatcaagcaattctcccgtctcagccccccaagtagctgggactacaggtgctcactacacacctggctactttttgtatcttttgtagagatggggtttcgctatgttgcccaggctggtcacaaactcctgagctcaagcgatccacctgccatggcctcccaaagttctgggattataggcatgagccactgcgcctggcctaatgttatcctttacacctcatatatataaatattactttgtacctattaaataaaaaattaagcagtctcacgtgtcttaaagaaccacactttgcttttagggtccctgcctctttgaatgcgctttgcctattttatttttttgagacagggtctcactttgtcatccaggctggagtgcagtggcgagatcatggctcactacaacctccacctccctgggctcaggtgatcctcccacgtcaacttcctaagtagctgggaccacaggtggatgctagcacacctggctaattttcgtattttcggtagagatagggttttgccatgttgtccaggctggtctcgaactcctgggctcaagtgatctgcctgccttggcctcccaaagtgctgggatcccaggcatgagccctcaggcacataagctaccacacctggccctgcctaattatttaaacctaagtcaaaagacataactttataattactgttacataagaaaaaagataggtatgctgaacatggcaatcattcaattcctgccttgagataaaatttgtttgctcagagagaagtaactcaaaatagtcagaactcccttccactattactgtgcctacattcttgggctcccccatagactggctatccttaaagtttaggataatactggatcaacaggttttaggaagacaactgtggaaataattatagagtttcaacttcagttaaggaagtcatttcttaaaagcatggttgtatggctgttacatcacaacccagtgtagaaacaaatctaccatgaacctttagcaattttaccaggcaaatcaaaataagaaattacctgagcctccctttttcaaaatacttgtttccagggctgttcactagcaagtgcctgccactaaaacgtcttacctggaactgggggcaagacagtaaattctgaatgcccattcctcatctaatctgaaaagtacacatcacttttgcgtacccaattgtctattgccatgcctagtggttaatgaaccactgatggaaaagtggtacagctgaaggatgacagaatgactactcaaagacacactgtacaatctgcctacttaaaacatatccatctggttgtataggtctttctttacaaccacaagggcagattatcaccactagggtggagaatgtaggagatttataaagggcttggtcaaaacctaggagtggaaaaggaagatagaggttgtagggtcactatgccccatacatgtagagtgagtctcaacccaggcactacagatgtttttggggagacaattctttattgtttggagactatcccagcactgcaggacacccactgattctgcctactgaatactggtagcttgcaggagaggggaacagcatggtgacaacaaaaacagtctcatcattcttcagttatgaggggtatgcagggttggggagggaaaggtaaagaccactagccaagagggtggaagtcataactgatgctattaaaaagaacatggaatcttagaagatactgtatgtaactgagaacagagattaaatgcctgaacagtgctggacacatcggtcattcacaatggttctctctctagaagccacctgaccccaaaccaagaaacttttctgtgacattattgatgatactctgcttgaatacctgtcatcttagagaaaaaacatagcctttggagccagagagattgaggtttgaatctcagtcaggtggcaatgtagatacttcatgtgaatttcagtttctttatttattaaaaaaaataactaggagggtgtgattagaattaaaactaatatacacaaagcattggcaagaactaagtgctcaacagacagaaatcatgacgactcactccagtgatgagatttactctctcaagaggaagcacatcctgccatgggaacgttcaagctatttgaaaacgtttacattaagcccaaatctgctttcccatgacttctcttatgaagaccagcacattccattttttcccctcatgaaaactaagaattaaacacctccagttctctacataatgggtttctagatacatctactctcctgatggacttcctctgtatttgggcaatttgtgatgctcctttcttttttctttttttttttttgagacagagtctcactctgttgcctaggcaggagtgcagtggcatgatctcggctcactgcaacctccacctcctgggtcaagcgattctgctgcctcagcctcccaagtagctgggattgcaggagcccaccaccacgcctggctaatttttgtatttctagtagagacagggtttcaccacgttggccaggctggtcttgatgacctcaagtgatctgcccacctcggccttccaaagtgctgggattacaggcgtgagccaccgtgcccagccgtgatgctcctttcaaaactcagcattgaatacagtgctctgatcctgatcaccaatacacactatttcagttaatgtaccccagaactttaaagtaaaaacagacccctctaactttttgtttaaacagagtttacagagagtgggtggaccaactctgcctttagtactcactgtttgtttaaacagatgtttacaatcaaatatttgcattttcaggttttaggagtatcttacagtatagagaaaggaaaagtaaaggattaatgattactttgtgaataaattctattaggttttatcagactagcattaaatgtagaaataaggcttattgttcataaatggatatgttagtagaaaacagaaaaagcaaagatatttcgtgtgatcaataatttgatcctgttagcaaatcccacttagaaattccccaagtactctgtgcaaaagcatcacctgcatatccagtccacatgacaccaggctctgaggcctctgaggccgaaaagccactgaggagcagatattggaatgtctcttcaaggatctgataactttcttgttttccaagtctaggattttgattgccccagagtcgtcagcagaagccagcaggttttccgtttgattcaatgaaagacaattgatttcttcttcattcacatgaaaatggtccaaggaatctttgagggacctgacatccagtacactaatggtttctccatgtgaggcatagagcttggtgggacaggagggagaaaataagacactggtaacatcatcagccccttggaaccgcgtgtgtcctaatggagttccatcttcaccccaagccgtgagatctccgccctctgctccagaagccagcagcccttctttacttgcattcaggcagaggacaggagaagaatgcccacccgtccacttgactgccataatggtcccggagactctgtgaagtgggggaaacaactgtaatctcatgttttatacatcgacttgatgggaggagacagatgtaataaacaatatttcatcttttaaaatgttttaaaaatacatcttaaaaaaactcaattaattaaaaaaaaaaaagacacttaaagatcacatctccaaaagcctagctgaacacagggttgtatcctggctggcaaatacttcagtgggcttcctttgccatcagggatctaggtaaggccagtcctccagtctttcatatggaacccacagaagaataaacactacatattttaaattaagaaaaattattttaaagagagggctgcaaaatcatcaggttatgcctcttatctgaataatgttttagatggtgagctctgcagctaggctctccaggtttgcagtagctaggggactgggcaaattactgaacctgtcacccacttttcttctctataaaatgaggataataatgacactcatttcataggatcataatatatgtaaatcacacataatagtgcctgatacataatgaatcctcaacaagcattgctattgttactttttcgatttttattaggccggtgcaaagcggcattacatacactgcaccagtactctcaaagtgtggtctccacactagcagcatcagcatcccctaggaacttgtcagaaatgcaaattgtcagacccaaccctagatctactgaatctgaaaatgggggtgagaccaagcagtgtgtttttgttgttgttgttttgttttgttttctgagatggagtctcgctgccgttagcccgggctggactgcaatggatgatctcggctcactgcaacctccgcctcccgggttccagcaattttcctgcctcagcctcccgagtagctgagataacaggcacccggcaccatgcctggctaatttttgtatttttagtagagacggggtttcaccatgttggccaggctggtctcaaactcctgacctcaggtgatccacccaccttggcctcccaaagtgctgggattataagcgtgagccaccacgcccggctgcaatgtgttttagtaagtcctccaggtgatcctgatgtacagtggaattgcagaatctgtattaaactaatgaccacctggggaaatggtgaaaatggcaggcccttggtctccccaccagacacttattcagtaggttatctaattttatctcaaaacaacccttttgattggtattattccattttagggataataaaaccgagtctcagaaatgttaaataattttcccaaggtcacttgactcttaggatttgtaacagatcccaaatgttttgtttttgttttgagacagggttttgctctgtcacccaggctgcagtgcagtggcacaatcgtggctcactgcagccttgacctcccaggcctaagcaatcctcccacctcagtctcctgagtagctcagaccacttatgtgcaccaccatgcctggctaatttttattttattaaatttttttttgcaaagtcggggtctccctatgttgcccaggctccaaatatttaaataatgaaggtccttttctaacaactccacctgacaacagttttgttattattctttgaagaaacagaaaatgaccaaaagttactagtaagtcatcagtgcttgaaaatgtactcacatatgtttaatcatattatcatctacctgcacttacacaacagtgtaaaatttagatttctcatcctctaggaatcccagatatacacacactggaaatgccacataataccggcctgccgtgcccgcctgctggtcaaggcaaaaaggaaatcagggcaatttatacaactctaatcttggtcaagacaaaaggaagcaaataaatctacctggacaaatttaatttttcatttcataagcgaaaggagagcttacccgagtgccagcccccagagctgttgtgctattttcagataagatacttgaatttagcccagtggtacagagataaaatcatttaaaataatctggcaatctgcccaaagtttccattcccaacacaaagcttttttttttttttgagacggagtcttgctctgtcgcccaggttggagtgcaatggcacaatctcagctctctgcaacctctgcctcctatgtttaagcgattctcctgcctcagcctcccaagtagctgagattatagacgcctgccaccacgccaggctaacttttccatttttagtagagacagggtttcaccatgttggccaggctggtcttgaacttctgaccttacatgatccacccacttcagcctcccaaagtgctgggattataggcgtgcgtcaccgcacccagcctccccctacttttagtcacacatacgatcactaattagactgcaaaaaaatcactgatctattagtaatcaaggtaacggaaacgtgatcacaaaatcaaatacagaaatgttcataaaaataacaaaataaaaaacaaaattaaacttttgttttcaagcagaagcactcaactaatatacagaggaaactaactggagactgaagcaataatatttaaaggagagaattggagaggaaatgactcagagggaggtaaaaacagggagccctggtggtttgatttttgctgacaagtactgaaacagcagcaggtaaatatgccgtaacgaagactgttgccaaaagttccagataaacctagattttaaacgaaaggcactgatagtatttaggcttaggaactgtaatactgacttacctcatgataaagatgctatcctacaaatttgaattgagtattgaaaagtcaatttaagttacaaataattttgtttaacgatttcaattttttttcttttttcttttttttttttttttgagacagggtcttgctctgtcatgcaggccttgacctccccaggctcaagtgatcctcccgccttagcctcctgagtagctggaactacaggctctcaccaccaaacccacctaattttttgtattttttttgtagagatgaggtttccccacattccccaggctgttcttgaactcctgggctcaagtgatcctcccgtctcagcctctcaaagtgctggcatcacaggcatgagccactgcacccagccaatgctttcaaatctttagaatgtcgatcacttttttgccaagttatagttttaattttgctatgatgaatcaactttgaagtcaggaagtctgtactctagagcattaagatttgctgatatttgtgtgcatacaggttttggatcccagctgggattttaggttttctctgaaacaagaatgaggcaaggtttctagtgctcctgtttctccattacaaatctacccacaggagagccaaataaatgctgactgacagacaaaagttttagcaggttttcttcctaatttaattcttttctagaaaagattaactcaatcttcaaggttcattcagttaagttttgctccgaagtgtgagaagacaggcaataaacgaattttgtccttaaagggattattataaagactacagttcctataaatttttccacagtggaaccagtagtaactcttgttctattagtctcacaagaccccaagaacactttcatcttattaaactctacacactaaactcctactctctaaatcacatagataatatttactgatcatttatctagtcagaaaaataaataactgttactgggaatgttaaaaaaaaaaaaaaggcaggggccaggggaggctgggcgtggtggctcacgcctgcaatcctagcactttgggaggctgaggagggcggatcacttgaggtcaggagttcaagaccaccctggccaagatggagaaaccctgtctctactaaaaatacaaaaattagcagggtgtggtggtacgtgcctgtaatcccagctactcgggaggctgagggcttgaacctgggaggtggaggttgcagtggtgaactgagattgtgccactgcactccagcctgggtgagagtcggggtgagggggcaggggggagtttggaaagccccagaaacagaaatccataaactctgaggctattaattttagtcaatcaagatttattatgcaaactattgatcagcgattcaactagagcctccaaaattgtttacttagtctataaaactaaaatgatttgttattatttgaaacacaccaaagaacactatgaaaaagttaatcagattgctgtgatagaagggtagtgggaaaaaatgtaattaaagttgggttaaatcaaaacaatttttcagaaatgagttggcaagccactgtttcttgcttttctatgactgcaactggaaagcctggcagaaagaggtgaagtgtcaccatccccacattcacgtatcaagtcaacaagcttctcttttcctatggagttgcctaaagcgttaagcacagcagttaatcatatcctactgtaaattactttaattagataatagatcacttccttctaatacctaaagaaatcacacagagtgggtgagggaaaggtgagttttttcttgtgttttttttttgagacagtatctccctctgttacccatactggagtgtagtggcccaatctctgctcactgcaacttccaccttcggggctcaagtaatcctcccacctcagtctcccaagtagctgggattacaggcatgcaccaccacgcccagctaattatcttattttttgtagagacaggatttcaccatgttgcccaagctggtctaactcctgagctcaagcaatccacccacctcggcctcccaaagtgctgggattacaggcatgagccactgtgccctgccaggtgagttattttgagagcatttttttcttttttttttttttgagacagagtttcgctctcgtcgcccaggctggagtgcaatggtgcaatctcggctcactgcaacctccgtctcccaggttcaagcgattcttgtgcctcagcctcctgagtagctggaactacaggcatgcaccaccacgcccggttaatttttgtatgtttggtagagatggggtttcaccatgttggccaggctggtctcaaactcctgactgcaggtgatccgcccgcttcggcctcccaaagtgctgggattccaggcgtgagccacggcacccggccgagagcattttttaaaagggtgaagtgccacagccggcagttctcatcagccagagcgcagaatgagagtactgaacatggggaaggggcttggtggggtgggtgatgagcaggtgaaagatttgtaaaaaagaaaaggaggggttgagaagggtaatcttactttgaaattctacctggggcgctcaggagacggtctgccgttgaaagtcacctcagcggctggactagattagtaagaatgacaacatcgcatccttcaaaggctctgcctcggctgcactgagacacgataaaggccagtctttaaaaactgagtgatctctaaacactctgcactagtcataccaccaccgtcccgttcaagagtctgtgcctctaaggctgttcattctgtctagttcatgatccctttctcagatggatcaactctgcttatccttgaagacttcaaagaaattagtgagagacagtcaccatcaccagagtcagcacaggtcaacttttctctacaggcttcgggtttctgaagttggacttgatgtggagaagctggatagcaaccaaaatgattgaagggctgtggcgctggcactggtaagaatgaaaagaattagggttactggacttggtgaaaaagacatgaggagaagggacaggcaaataataatcaaacaccatgaatcagagggtagggaaggtagccaccgttcctttgcttttactagagactaagaaatggattatacatagcaagaagcttcagaaaagatttcttactacataaaggttccaagacattggagttgaccaagggagtctgtgaaccctattattttaattactcagctcatggagttgttttgaggattacgtatataaaaatctgcgtaaatgacgtagtatacagtgcctggttcacaccgtggctcaaatgatggttattattattctcttactaagcatgctttaaaggctgtcggaaaactttggggccacctaggaaatcgtagtataatcaaataatgctgaaattcttgtgtgtgtgtgtgtgtgtgtgtgtgtgtgtgtgtgaggtaggggctcactctgtcgcccaggctggagcacagcagggcgattacggttcacctcagcctcgacctcccgggctcagcctcccaagtagctgggaccagaggcgcacgccaccaccctcggctaatttttctatttttttgtagcgacactgcctcgcaatgttgcccaagctgggatgctgaaattcttccccttccaagaatccatctataattatagcctccacgtcattctccctattggaatgtttaattgactaaaactacattgccttcatctgcttactaagcggtggatccagtaaagaccacatcttgtccaaaagacggcagcacttaattagcgctcaaatggcactcgaacgtttgggcgagggggtgttcagtcgcagccaccttactttgcgaaggcacacagggacagacgttcgctaagtgccgatacttagggagaacgagagggcctgaccaggtaaagacggcctccgctgcccaagctacacaaaaaggttggggagccaggacccggcaagcaaggagagaaaagtttcatgcgttgagctggagtctgaagcaaggacctaacggacacagggaaacgtcacaggaaagggagcccaggagagcagacgcggagccaccagaccagaaaaaggaaaaagcactggaaaacagcatcgaagtcaccggaaagcagcatcgaagccaccggcgccagcctcatacctgcgcttcccgctcccctcctcg

SEQ ID NO: 2136 - DNA, 92792 bp, Homo sapiens
cgtcttcctcccccagggttgtggccacgcgcagcggcggcggttgttccgcttcccctccggcccgggccgtcgccattgccgaaggctccctcccctcccctccctggcgtgcgcaggactccgccgccgctgggcctagcggtagcagcggctgctccagcgcggcgtctcttcccgccccgcttccccttccctcccctcccctccccgcaccgcgcgctagcccggggcggctccgcagcccgccgggagctctgaccgaggcgcctcgctggggcggggaccttgccttgcccggggtaagtgcacacaggccggccggcgcgggacgcaggccgggtctcttcctcctccttccttctccgtggcctggcgggcgggagcggcccgggacggccgacctgccccgcgcggggccggggagccgccacctgcgtgctgggagccgcagctcctggggcggtggctcattgtctgctccccagggccgttttcttcgctggctttagccagaaatgggaagctcgctgggctgcggaggtctgactcttcctggacccagccctgctctgaacctcgcggcaccacggtctctgccgactctcggtcttccctcccctcgcgtttcaccctcttcctttgctccgttttcttaatgctggaccagactctccggttttgttccttgatttttcctctcactgattctcagcccctgcttgctcgctctctgttcacccgtttcactgctcaggaatattgtcgcgagtagcttgactgttttctcagctccagcctgtaacctcttttccacattccacattggtaaaaacgtagagcgtcccgggcgcttgagggccaccgcttacgaactgatctttcggagcttctcctcgctcctgtttgagcttcagcctaggggtgaaatttgcttctttagataacttaggtgaagttaagattggtttttcaccatgtttggctctcttggaaacacacgcacgcacaaacacaaaacgttgccactcaaccttttaactaattctttaaagataagtcatccaagaacagaagcgtgtcatcgtcagtgggtgtgaggttgtacccatccttgtatcttaattttagtagtactctccctgggcagtgtgagcgtgatttgttgtcccttgataaataacgaactccggttgatatcattatctcacttctgcgttacaggcgatgtgtcctttctttgttttcttttttaacctttataaaaagacaaaatggttaggcctaaaattaaactacgaagagctgtgttttggatcaaggttgtgcacgtcacgttttttcccctgctgtgttcgactcttccgctcttataagtaggcaggatattgaaatgtacaagaatttgctctggggattttgtttttgtagggttgtccaatagaataacactcagtaaagttacattgggatgaaggcagtgaatagtaatttttaaagcaggttaaaacttgtcaactttgccagaaggtctgtggcttctgtaaagcccactcatgctcgtgtatatatgaagagcctttttcatgttctgttaggagtatggatttcaggcaactttttcactgtgtcatcctcggctattaaatctttcgagctacttattagccaagcacattgattgacacttattacggaaagtgaacctgtaatagatgtaggtcttaaaccaactttccgatttggtaacaggttgacctaaattcagtgtattttgtgttttcactaagtagcccattgttacctttccctccagcaaggctctgaaaaaagtggctccaatactcagcttcaatactgtcatcatttcttaaatagtagtatcagttgtccttaacttaatggatgttttattggcctgagggattaaggtgtagaaaggttggagttttgttggagtttgaaacttggtctgtagatgttggcttctctgccagtttcttctaatcagcagatatttttatgaaggaagagttcctgggtatttcacttcccttagggccttggtttatggtttactctcattcagagagagatactattctggactccgtgctatttaatactaaccttgcaaacccaaattcaaaattaagtttatagttcgagtatacaggcgatagggctctctgatctttatgatagacaggttcccaagtagatgcggttaacaattaatatttcttttttttttttttttttgagacggagtttcagttgcccaggctggagtgcaatggtgcgatcaccgcaacctccgcctcctgggttcaagcgattctcctgtctcagcctgctgagtagctgggattacaggcacgcgccaccacgcgcggctaattttgtatttttagtagagatggggtttcaccgtgttggttaggctggtctcgaactcccgacctcaggtcatctgcccgcctcagcctcccaaaatgctgggataggcgtgagccacggcacaccaccaacagtttctatttcaattatactttttaagagagactagaacttgttcaggtagctaaagataaactttcaattatacttttctaatatttaagaacttcaagtagccaaggataaaatgagtaggaattgttagattcttccttttatccatcaaaatcgattattattataataatatttgagtatatttcttttggctttctgacttttacacttttggttaaaatttgaaactgggtcttcttcgccgggcgcggtggctcacgcctgtaatcccagcactttgggaggccgaggcgggcggatcacgaggtcaggagatcaagaccatcctggctaacacagtgaaaccccgtctctactaaaaatacaacaaaaaattagccgggcttggtggcaggcgcctgtagtcccagctactcgggaggctgaggccggagaatggcgtgatgaacccgggaggcggagcttgcagtgagtcgagatcgcgccactgcactcccgcctgggctacagagcgagactccgtctcattaaaaaagaaaaagaaaaagaaactgggtcaacttcaagactttaagtcgtaaaggtttccatcagtttggtataagagttgagtttccagactaatcagagggagggtgttaattgcaaattgtgtgtccaagctcttcctagtatcctttttgtgccttaacagagcagaataggaaaggaaaaaaatccctcattgcccccaaaaaataaaatactggttgttttcttctgtgatcagagttgagtttcatcacttcttcccttctagggtcacctgcctggttaagggtagtcagtctgaacattcattcaggatttcagtgttccagcctactatctctgagtttctttagtacttactccatgtatcccatgtggttaggagctagagtcctgcgtttgaattcttgctgttctactttaccctgggcaagatatacattcttttcaagacttgcttttctcacctgtaagatggggataataataataataccaatttcacagggatatttagatcaaatgagggaatgcaggtaaaggattctgtaattataggtcttaataaacgttagttaatagtctgttcttacatgctgtagagtcgatactcctaaacttagaattaaaactgccttctaggccgggtgcggtggctcacacctgtaatcacaacacattaggaggctgaggtgggccgatcacttgaggtcaggagttcaagaccagcctggccaacatggtgaaacctatattctctactattctttagtagagaatttagtattctctactaaaaataaaaatattagctgggcgtggtggcgggcgcctgtaatcccagctactcaggaggctgaggcaggagaactgcttgaacccaggaggcagaggctgcagtgagctgagattgcgccactgcacttcagcctgggtgacagagtgagactccgtctcaaaaacaaacaaacaaacaaacaaaaaactgccttctaaaagaacgaagtttctgagaccgtaactaaaaataaaaattacttttggatgaataaaatgtaatttttcaggagaaaaaatatgtaatagtttcaccactgaaataaaacatagggtttttgaacacaaatttctcagatttaaaaatatgcatatttcctgtataaaagttgaaaagtgggcagtggctggtggtgcctgtagtcctagctacttgggaggctgaggatcctttgagtccaggaatttgaggtcagccaggacaatacagggggaccccatctcttaaatcagacaaaaataaaagtagaaaaaaatattaaataagaaatttggaaagtggtaaaaacttttaagacaaaattaccttagtctcagctggcagaaccattgtaacaaactggaacagtggttttgttccttattttaaatttaaattctaaaagcagtacatatttattataaaaggttcaaacaagtcaattaaatatttaaagagtgaaaattctttgggagactgaggcaggaggatcacctgagctcaagagttggaggtatagtgagctatgattgcaccattgcattccagcctgggtgacagagcaagaccctgtcttataaaattcttaaaaagtgaaaattactttctctttttagtcccattccttagaagtacctacccgctgttaatagttttacttactgagttagaaataagtagtaccttttgtgtgtcggatactttttatgttgattttaaaataaaaaatctgatcattaagtattgttttccatatcatgacatatagtggcacctctactttttaagtcattagatattatgctgtatggtagtactttaattatttgtgatcatttatgttatttctaactttgagcaactaaaactagagccttaatgaacttatacgtatgtctttgtgcacatgcatatgtagataagtatttccattaaaacgacttgtaagtgtgcatttaaatttcttttttcttttttttttgaattgcattccaaaaagacttgtaatgtatatttccttattgagttgtagaagctcttcacatgtaatagatattaatctattgccttctgtttaagatcttcctcattccacctttacaaaaaacattcttatgtgttttcttctggtacttttaataattattgtgtttcaatcttttttttttttttgtgacagagtctcactctgtcactcaggctggagtgcagtgttggatctcagctcactgcaacttccgcctcccgggttcaagtgattcccctgcctcagcctcccgagtagctgggattacaggcaccataccatcgcacccaactgattttttttttttttttttttttgtagagacggggttttgctatgttggccaggctggtctcaaactcctgacctcaggtgatctgcctgccttggcttcccgaagtgttgggattacaggcgtgagccaccgtgcccagcccattgtgtttcaatcttaatctttctggaattttttcatgcctggtggggataaaagagttttaaaatagttttgctacagaaataaaatacaggtataaaaatatttggccgggtgcagtggcttacgcctgtaatcccagcactttgggaggcctaggtgggtggatcacctgatgtcagcagttggaaacagcctaaccaacgtggtgaaaccttgtgtctactgaaaacacaaaaaattagctgggtgtggtggtgcacacctgtagttccagctactccggaggctgaggcaggagaattgtctgagcccgggaggcggaggttgcaatgacctgagatcaagccactgcactccagcctgggcaacagaacgagactccatctctaagtaaaaaaaaaaaaagaagaagtagtaactagatttttctgttcattggtatttttattatcttactggacttcagtaaacgtctttattttgttttccaggttcattgttttatctgagaataatagtaacttcagtcacttttctatggttacaatatttaaccttttttttttttctttttctttcttttttaaagacggggtttcaccgtattagccaggatggtctcgatctcctgacctcgtgatccgcctgcctcagcctcccaaagtgttggacaggcatgagccaccgtgcccagcccttaaccctgttttaggtctttattacattggcctgaagttccaagacttggttaaacaagagacgtgtcgttgtcttgaaatgactctggtattaatatttttacagttagggatgatggcagctgttggatttagagaaagattattattttattctgtttctgctttacaaaaaataggaatggcttctgaattttatgagatgctattgtaacatttagatgatgatatggttttcttcttttaactattgctgaggatatgtaatagtaaatttgctattaatcaaaggtatcacaaggtatatatcgtgaataaccaaaatcccactcatattagtcctgcgtacggaatttattgaaaggttagaggagaatctcatataaatttagattaataagaataggccgggcacagtggctcatgcctgttatcccagcactttgggaggccgaggcaggtggatcagctgaggtttggagtttgagaccagcctgaccaacatggagaaacctgtgtctactaaaaatagaaaattagccaggtgtggtggcaggtgcctgtagtcccagctactcgggaggctgaggcaggagaatcgcttgaacccgggaggcggaggttgcagtgagccgagatcgtgccattgcactccagcctgggcaacaaaagtgaaactctgtctcattaaaaaaaaaaaaaaaaaggataggcctttatgataacttctgtagttaacttctataacctattcaggaatccttattcatgagtcacttttgataattcgtatttcctagatcatttcttttagattttcaaatctgttactatataggtgtgtataatcttttgtcattaagatctgtggtattcatttccttttttttattagtgatttcactatttttctgaatttgccaaatgtttgtctacttagtggttttttttactaaccagctttgagatttacttattgtattggtttttttttgtttgttttctgaatgcctgatttctacttttctctttattttgctctcctgctttttttttttgttgttaacaatgttaacattaagttaatgttaatgttattaattcttaatgaattcttagttcctttaatgtgttttcgatgagcggtaatcgctcctcggatagacctcattggctacgataccgccactgtgcaaagctagttcattttaatgtcttttaataataaaaacctttaatgttcttaatttgcttttgaatgcagcgttggctgcacattctaatttacatggacaatgttcttctgctcagtattttccaaatagctggtggttctagttttgatttcctctttgactcaggaggtatttaggataattctattcactcatattttctttcattgttgtcagcttctataatcttttaaaatatcttttaaacttattgagtgtttcttgtgacttaaaacataatccattttggaaaatgttctatgaaaacttagaacattttctgttggtaatatacagagttttatacataacctattgattaaatttaatgactaagattatttgtatgaattaccagtttttataaatagttcttactaaatataggacttagtctttattagtcctagtaagaactatagtcgttattaataattcttattaatgtaaaaatcttcctaatctgccaaagacaaagaggtagcattgtttctgagaagcttgttctcacgttgggacctttagatttttatttcttctgcctgaatgtcactgaggccatatttgaaagagatctttcatgatcacctctgcctacccccactccgcatctaacttcctgcccttcagtgtgtttattttcctttatagcacttccatctgaagtttctttttcatttatttggttttctttaatatactattctgttttacagagctttgaacaaataggtatgaaataagtatgtgttggttgagtgtcactctcttatttctaatgatttttagaaatttttattcattttaattaatagactttgcagcattttaggttcacagcaaaactgagcctaaggtacagagttcccatataccccatgctcctcatgcccctcttctccaagcctcctgctcatcaacatcctgcatcactgtggtatatttggcacagtcagtgaaccagcattcacacatcatcactgcccaaagcccacagtttacgttagggtttgctcgtatggtattgtacattcagtgggttttgacaaatgtataacaacatgtctccaccagtatcataccgactggtttccgcaccttaaaactctctgctccacctgttcctcccacttttactgcaacccctggcaaccgctgatccttttactacctccatcgcaatgccttttccagaatgtcccgtagttggaattatatagcgtgtagccttttcaacttggcttctttcacttagcagtatgcatctgaggttcttccgtgtcttttcatggcttgatagctcatttcattttagcactgaataatattccattgtctggatgtacattcacctattgaaggaccaggtttggtgattatgaataaagctgctgtaaacattgatgtgtggagttttttattgtggtgtaaaatacatgtaacagaacttaccatcttaaccattttgaagtatacagttcagtggtactaaatacatttatagtgtgcaattatcaccaccatccatctccgaaactttccatcctgcaaaactgaaattctatacccattgaaccataactcctcattctcctttctgtctgcatgattttggctactcttatgtaccttatgtaagtggaatcatattttgtgtttttgtgacttatttcacttatcctcaagcttcatctgtgttgtagcatgtcagaagttcttttcttttttttttgggtgaatagtattcccatgtgtgtatttaccttattctgcttgtccatttattcatcagtagacacttggattgcttccgtaatttaggtactgagattaatgctactacgaacatgggtgtacaaatacctctttgagaccttgttttcagttatttcgggtacatacccagaatggaattgctgggtcatatgataattctgtgtttcattttttgaggaactaccgtattgctttccacagcgcctgtatcacttcacgtttccaccagcagcgcacagcagttcagtttctctacatcctttttaacacaaccgttgttgtttttaatagtagccatcctaatgggtattaggtggtatcatgttagttttgatttgcatttctctagcagttagtgatgttgagcattttttcatgtacttattgaccatttgtatatcttctttgaaaaaatgtctattcaagtgctcatgtgtaggttttcgggtggacataagttttcagctgatttgggtgaataccaaggagcatgatggctggagtgtatggtaagaatgtatttcattttgtaagaaactgttcaactttcttccaaagtggctgtaccattttgcattcccaccagcaatggatgtgggggttcctgttgcttcacatcttttccagcatgtcatgttatcattgttttggattttacccattccaataggtagtagtgtttcattgttttctgttttttttttgagatagagtcttgctctgttgcctgggctggaatgtagtggcacgatgagaactcactgcagcctcgagctcctaggctgaagcgatcttctcacctcagcctccagagtagccaggactacagatacgctaccttacctggctatttcttttttttttttttgaaacagagtttcgctcttgtcgcccaggctgtggtgcaatggcatgatctgggctcactgcaacctccgcctcctgggttcaagtaattctcatgccttagcctcccaaatagctgggattataggcgcctgccaccacgcctggctaattttttgtattttttttgtagagatgggatttcaccatattggccaggttggtctcgaactcctgagctcaggtgatccatccacctctgcctcccaaagtgctgggattacaggcgtgagccaccgtgcctggcctatacctggctaatttttaaaatctttttgtagagacggttcactctgttgcgcaggctggtagatacttcttttgcagatattttttttctaagtctgtggtttaagttctcattctcccaactctgatgatttctgtcatgttttgattcagtattatttggtacgtgtgtaaattctacactgctcaagatcttcattatgaattgtacctcatccatgaaaatgattgtcctgtacgatcatgatttaacatttttgcatcttatattttgcttgtcttaaattcctgttgtactttgttttttgttcaataaattattcaacattatctttccttgctgttttttgttgtgtctttttaaaattgcgtgtagtttatttttgctttattccaaagtgaatgcttaaaacatattaatgcttaaagcattaaaaatgaatgcttaaaacctaaaataaagtttaaaaaaaaaaaaaaccaaaacatgtttattataataaatgctttctggtatgtttctgttattttatttaatgctttctgttttttaatgattaattgttgctttttttaattgttgtaaaatacatgtaacataaaattaccatcttaaacgttcttaagtgtacagttctttggcattaagtactcacgttgtggtacaactttccctaccatctgtcttcagaatttttttcatcttccccaactgaaactcggtactcattaaacattaactcctcattccctacctccagcccccagtagcctatctctaatctgttttctgtctcaatgaacttgcctcttctggatatttcttataactggaatcgtgcaatgtttgtccttttgtgtctcgctcattatttcatgtagcgcagtattttcagggtttatccattttgtagcatatagtataggttgagcatcgctaatctgaaaatccaaaatccgaaatgctccaaattccagcactttctgagtgctgacatgacatcacaagtggaaaattccatatgtaagtacttaatgcaaaccatgtttcgtgcacaaaattatttaaaatattggccaagcatagtggctcactcctgtaatcctagcactttgggagggcaaggtgggtagattgcttgaggccaggaattcaagaccagcctggccaacatgctaaaaccccgtctctactaaaaatagaaaaattagccagcgtggtggcacgcacctgtaatcccagctactcgggaggctgaggcatgagaatctcttgagcccagagggcggaggttgcagtgagcccagatcacaccactgcagtccagcctgggtgacagagcaagactgtccccccaaaaaacacacaaatttatttatatacatatatatatatatatatataattcaggctatatataaaaggcatttatgaaacacaaatgaatttcttttttttttttttttttttgagaccgtttcactcttgttgcccaggttggagtacaatggcgcagtctcagctcactgcaacctcctcctcccaggttcaagtgattctcctgcctcagtctcctgagtagctgggattacaggcgcatgccaccactctcagctaatttttgtattttgagtagagataggatttcaccatgttggccaggctggtcttgaactcttgacctcaggtgttctgcctgcctcggcctcccaaagtgctgggattacaggtgtgagccaccacacccagccacaagtgaatttcatatttagatttgggtctcatccccaacatatctcattatgtgtatgcaaatattccagtattagaactctgagacagttctagccccaagcattttgcattttggataagggatactcaacctgtagtacttaattcctttttaagggtgagtaatactccattctatgtattataccacttttgtttatctgttcacctatcaatgttttctttttttgctttgtaaattgtatttggtttgcttttatctcagatatttggaatgtatacatcctgtttttaaagtatattagcttaagtgaattcaagtctaaatctaaattgaaaaaaaattttctgatctgtaagcctgaaaaagaaaattgttttgactcttcctatatctgaagattataagatttttttctcttaaccctttctcactttatcctcctttcacctccgtggtgagcttgggacacagaatattgttaatgtattttttgtatatttcatgtttctaattccatcttcttttggtaattttgttttatttatttgtttgtttgtttgtttgtttgagacagagtttcactctgttgcccaggctggagtgcaatggcgcaatctcagctcactgcaagcacctcttccctggttcaagcaattttcctgacctcagcctcccgaatagctgggattacaggcgtgtaccaccacgcctggctaatttttatatttttagtagagacagggttttgtcgtgttggtctcaaactcctggcctcaagtgatccgtctgccttggcctcccaaagggctggtagtaaaagcatgagccaccacgtctggcctatttatttttgagacaaggtctcgctcttgtcccaagctcaccatggaggtgaaaagagggtaacgtgagaatgggttaagagaaaaaaaaattttttttttttttgagacggagtctccctgtgtcacccaggctggagtgcagtggtgccgatggctcactgcaacttccgcctcccgagttcaggcctgaatagctgggattacaggcacccaccaccacgcctggctaatttttgtatttttagtagagacgaggtttcatcatgtgggccaggatggtctcgatctcctgacctcgtgatccgcccgcctcagcctcccaaagtgctgggattgcaggtgtgagccaccgcgccgggcctgagaaaaaaatcttataatcttcagatataagaaggttgcccagtttggagtgcagtggtgcaacctcagcttgctgcagtctttcaggcagtcctcccatctcagccgcctgagtagctgggactacaggcacatgccaccacacccgcctaatttctgggctcacgtgatcctatcttcctgccccagcctccctaagtgctgggattgcaggtgagagccaccacacctggcctaattatttcttttatctcgctaattacatttagtattaacacaagttattgaaaccttgtttatgtgaattcattgctcattgccagctttctgttttacatttaaattcattagtcatgtataccatctagtgtacattttcagctagtattttcactaggagtacctggaagccacatttaatgatttagattgctaacttccctcagaaattctgttgatgttgttctatcgccttgcattaatcattttgtttttttcctgtgcctggatggtggtaggaattttcctttttctttttttaaaaatattttgacagattctgtcttgtacatgttcactaatgttgcctgaaacattagttccttatgatctttgtacttggtgctttttaaaaaatttccaataatacttttggtgattacttttgtttcaattgttctgtttccttccttgaaaacacatgtaattattaggttggctcaccatttctgtcccctatgtgaactgctcaaaagtttgcccttttttaccactcgtttgatttttctttttcacttctaatgttggctttatttctgctattgcaatcttaatttcttagtatccttttaaaatttatctcacttttcttaaattatcttatctcatcctggtttcttctctccatatactcctgttttgtgtcatttgctaaattgtgactggaagttcctgaagtaatttaccttgtaagttaggttctgcttttgtgtgaagggtaatcttccttgtggttttcttttgctattaggatcagtgctggatttcttactgcctacttaccattgaacagtaactgttatgtcctgtctcatgtgcatttgtcagagatgtgtgtgtgttttccttgcctctccaggggactggagttctgatgaaaccgcttctcagatgtatttctgagggataaatacacagctcccggcctgatttccagtgatgaacagacattcctcttcatatggtattctgggctagggtagtaggatcttaccctaccctgtttctgtctttgtgagtctgaactgatgatgtatgagagtggccctcatttctagcatgtgctgctgttacaggttttctgattctgatcttacacccacaacataacactctccttgttacttcactaaacctcccaggaagcagtgtgtccattcgggttttcctgcccttacacagccccgctggaaccttacctgcacacgggcgcagacacacacttcctggtttgctttctggaatttgcgcctggtaatctccctgaatgtatgttgagagatcacagaagataaggaactgtggctgccacaaaaactgcctctgtgtagcaaggagtggctgaccaattcttgattctgctttgattcttcaaagccgactctgagtctccaaataaagcgatggctagtagggagagacaagatatcttcatagttcttttaggcagatgattgaactttgttttatgaggcagagcatggctgggtcacgagtctttttgcagtacagttgaccttaaagctaattgaaatccttcaaagatctcatataaattgtattggtggagatttgggacagactacgttggagatttctgatttgatagcattatttactagagtaaacctgttccaattttttgaaacttaggtaatcacttaagtagtaacatcagtcttgaccttcatcttttaataaaagattttacctcagattgatagattttcactttggtagtaggagaatggtatcttgttccattttgcatctgtttgataaatctagtgaggctgaaaatttttcctatgtctatggaccctccctccccatttttccattttgaattgctatttggggttcatggccaaaattaggaaaaactagacttcagagtgtttacgcatttcttcttccgacttttttttttttttttttgagatggagtttggctcttgctgcccaggctggagtgcagtggcacaatctcggccctctgtaacctctacttcccgggttcaagtgactctcctgccttagcctcctgagtagctgggattataggtatgtgccaccacgcctggctaattttgtatttttagtagagatggggtttctccacgttggtcaggctggtctcgaattcctgacctcaggtgatccgcctgcctcagcctcccaaagtgttgggattacaggcgtgagccactgcacccagacttcttctttttttttttgagacggagtctcgctttgttgccagcctggagtacagcggcatgatcttggctcactgcaacctccgcctcctgggttcaggcgattctgctgcctcagcctccttagtagctggggttacaggcgagcaccaccatgcctggctaatctttgtattttcaatagagacggggtttcactgtgttggtctggctggtgttgaactcttgacctcatgatccgtctgccttggcctcccaaagtgcagggattacaggtgtgagccaccgcacccggccccttccaactttttaagtaatctttcttgttgctgacttgttgtctccctgttccctaccgtcaggcagttttgaagcattttctgagcctcgccacttgacttcctttacgctttgtcattgtttcagttttttaatgtggtgattgagtgaaagccaaggggaagaagaaaaagagaaaaaagggtcacatttgaattacaaaatgcctttacactccctgtgtcctctgtatatagataccttcctctctttctttgcctgacaaattccttttcatccttcaaaaagcaattctgggttttttttgcctaattactctcatctaaacaggagctccgggtccccctttccagtgcgttccactgggccctgtcagcagcttaactcatttcagagtagttgttatttgtgagctccaaactgagacttaactcttttaggcacttaataaatatttgaatgaatgaataaattaggagtattagtaacaaaatgcttgggctgggcgtggtggctcatgcctgtaatcccagcactttgggaggccgagctgggaggatcacaaggtcaggagttcaagaccagcctgcccaatatggtgaaaccttgtccgtactaaaaatacaaaaattagctgggcgtgatggcacgcgcctgtagtcccagctactcgggaggctgaggcagaagaatcgcttgaacccgggaggaggagattgtagtgagctgagattgtgccactgcactctagcctgggtgacagagcaagattccatctcaaaaaagaaagaaagaaacaaaatgcttattccttggtgctgcaatgaaatagcactcagcataaatttaactttctcagcaaggcagttttacttgctgcataaagggtgctcctcgcagatggaacaatggtgagagcacacctgaacaagggaggggaaggggttcttattcctgacacaggtagcccctattgttgtgtcattcccctgttggctagggttggactgcactgtctaagctaattccgattggctattttaaagagaccagggggtatgagccagagtggcaggctgagtagtttagtgggaaggacggttaggaacaggtaactcaaggtgacttaggtcagagcaggtgaccaggggtgactcaggtcaaagcaggtgactgggatgagtcaggacagagcaggtgactgggggaacagatgtgaactactgatgaaaactggtggaaaaggttgtttagtgaaactacgctgaagttaaactttaaaatggagggcaatactggttctttgaagagaaatctagaactcactgtatccaacaggagagatttacaaagagtttctgttattttttccatccacgtcatttccctgcttagtaacttctagtgtgaaaatatcaaaagcaggtatctctgagaagtggacttaggcttattcttcttttcttttagaccttattctggtttgaggtttttgtgatcatcatgtactacttttattatataagaataaaaaaaaattaaccccaaacccctcaaatttccaggcgcttcctgttgcccagaccctgcaccattctggccccactcagcctagttttatttcccactgcttgccagctgtgccctgtgatctccttgctgtctcatgagctacgtggtacttatgttcctgttgcctggaatcccgtcttctggtcaggaagatgatctgcgataaataccgagaatactcgcgttagatactgaatagtgagagtttagactcacgacctggggtgtcatcttgaacatacggtgcttaagggatgaggtttctgggtcagttttattggttgtgatgaacaagataaatggagcatttgtcttagcttctagaatagtgaccttaaaagagatagaacagtgaatgtatcttcaaacttgcctgggtctccactagcctaaagaagaaaaaaccctttaattctgatgctgtcacagatgaaatcctttcattcactgatttattcattcaagaaataatgactcatcacctactctgggctaaacacagtgtccagtgtgatggtgatgtaatggtcaacaagatagatactcactgggtccttgcctgtggagtttatacgtagttagagaagacagacattaaaagaagaaatccagtgtgatgaatgttgagataaaaggaaataaaccaatacttgtggcagtgaagaggtatcagaggtttcctgagagaatgacatttaagctagtacttgaagtaggtgtttgccaggtggaggtggtgggcagaaagtagagtcatcagttcattctggtttgtccacggctttcctggttttagcacgacacgtcccgtgtccggggaggtcatgtgcgaaagcttcagatggcaattaaagaaacagtaagaatagaaaaaacttaaagcctgaagagggaaagactaaagtgagatgagtctagaaagttagacaggagcctgatgatgcacgcactgttgggctttacctaagaaccatgagaaggttttaagtgggaggatgaagtgatagtatttttattttattttattttagtttattttattttgagaaagtgtctcgctctactgcccagggtggagtgtaccctggcatgatctcagctcacagcagcctccacttcctggttcgggcgattctcatgcctcagcctcctgagtagctgggacagcaggcactcatgatcacgcctggctaaattttatatttttttagtagagacacagtttcaccatgttgcccaggctggtcttgaactcctgacctcaagtgatctgcccacctcagtgtgccaaagtgctggcattacaggcatgagccaccacacccgtccaaggatgttaatttcttaaaaagggaaaaacttacacatttttattctcgtatttttctgtcactggatagaaacattactagcagagtaaataatccagatgcctgtcttcagcctttttgtcagacatgaagagtaagcatagaaggtaggaggcatggctgtgaggtcgttgaagtgatcttttcctgaacacagcaaatactataaatggtttttgtcaccattgaagtagtcccattgagagactgcctgattatcccagtgatgcttccactcttcagattatttctagaactcttctttttgcattgccctgggagcctctggcatattcttcagagtttcttcttcaccagaggcaaacttttcatccttgcctgtgcctctgtttcaggtcagtttctcttgctctctgcatctatgtttggcccaattggtttctttcttttccttaaaaattccttaaattttaaaaaaacagatattcatatacagtaaaattcaccctttaaggtatacagttaagtggttttttttgtttttttttttttttttttttttttttttttttttttttgagatagagtcttgctctgtcacccaggctggaggctggagtacagtggcgtgatctcggcccactgcaacctctgcctcccaggttcaagcaattcttctgcctcagcctccagagtagttgggactacaggcacgcaccaccacgcccagctaatttttgtatttttagtagagatggggtttcaccatactggccaggctggtcttgaactcctgagctcgtgatctgcccgcctcagcctcccaaagtgccgggattacaggcgtgagtcactgtgcccagccagttaagtgggttttttaagtgtgctcacaaagttatacagccgtccccactatctaattacagaatatttgcaccacctcagagagaaatactgcactgaatagcagtgactccttatttcatctccccgccggccccaaataccactaatctattttttgtctcatgaatggaatgatacaatatgtggtcttttgtgactggtttctttcatttaacacagtgttttcaaggtccatccatgctgtggcatctctcagcacttcattccttttacagtcaaatggtattccattgtatgggtgaaagagacagggtcttctatattgtccaggctagtcttgaactcctgggctcaagtgatcctcctgcctcagcctcttaagtagctgggatggtgcacacctgggttattttcagttttttgtttgtttgtttgttttgagacagcgtcttgcactgtcgcccaggctggagcacactggcgcgatctcagctcactacaacctccgtctcccgggttcaagcaattctcctgcctcagcctcctgagtagctgggattgtaggtgcccaccaccacacccagctaatttctgtatttttagtagagacagtatttctccatgttggccaggctggtctcgaactcctgagctcaggtgaaccgccggcctcagcctcccaaagtgctgggattacaggtgtgagccaccaagcctggactctgagtatgatttcttacctcattgttcatatttctacagtgataagtaggcatcatccatgtgcagccgcattatgggcctgtaaccatgaccggtctgtgagtttgagcagtttgaatgcataaggatgcattcttatgctatccaaattatttgtgctttgctggtgaagattctgaaacaaggtgtgtcattagaaagtgtttacttgtttataacggccttaaactactgaaggtgtataggatatttatgagtcgtgattcaaagtgtgagtttaaacgtttgttggtgcctccgtgttaaaagcattatgttagatagtgtcagataggtacagagatgtatggaaagtgttacctgccagccagtttataatcttgtagaaaaaagaaaagttagggctgagcacagtggctcaagcctgtaatcccagcactttgggaggctgaggcggatggagatcaggagttcaagaccagcctgaccaacatggagaaaccctgtctctactaaaaatacaaaattagccgggtgtggttgtgcatacctgtaatcccggctactcggtaaggctgaggcaggagaaccgctttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcggggggctgacccccacctccctcccggatggggcggctggccgggcggggggctgacccccccccacctccctcccggacggggtggctgccggacggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtcttggccgggcagaggcgctcctcacatcccagatggggcggcggggcagaggcgtcccccacatctcagacgatgggcgcccgggcagagacgctcctcacttcctagatgggatggtggccgggcgcagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggctggcggatcactcgcggttaggggctggagaccggcccggccaacacagcgaaacctcgtctccaccaaaaccagtcaggcgtggcggcgcatgcctgcaatcgcaggcactcggcaggctgaggcaggagaatcagacagggaggttgcagtgagctgagatggcagcagtacagtccagcttcggctccgcatgagagggagaccgtggggagagggagagggagagggagagaggagaaccgctttaaccggggaggcggaggttgcagtgagccgagatcgtgccattgcactccagcctgggcaacgagagtgaaactccgtctcaaaaaaaaaaaaaagaagaaaagttagaagccaggtgactgaatttcaaggaagtgtgcaagtaccatatggatggatgggactgtatcattctgggtccaatcaggagagagaagccatacagtaatttgaacatgaaaaaacataattgactgactataacagggtaattgagtaatgagggattagccagtaaaaaaatagagctctaaagaacattggaatagcaaaagtaagaagcagctacttcccctagggctgagatagaccccccaccccctgcctgggaaagagctattccttttcccagagctgagatccagaccttattggagagagcgtggttgtaaatcactgaatggcagagatgtttctgccatttaatggttctttgttggccatagttgttggacatctgccctttagggtgccaaggagaattattaactctgatacaaaactgctcaaaaagagtatgtggggtggctccctgttgcagtagactcagtgctgctggccaccttcccctattggagtctgatgctggaggagctgcctgcccatcaggagtcttgtgacaactggaaccaggaagcaaaactccttttcttctgtgatgtctctccagcgccctatatcgacaaagcttagcatcgtgtcccggcaaaggaaaaatgcttgaaggcctcagatccgttttcggaatggacagaaatgatgaatttggaatggagaggcactagatcagtaactggcaggagaatggtattaactgctgcgggagctcagagacggagcagaggtcacatgacagtaaaagaagtatttgagaaagagcttagaagatgagtagatttttaaattgaagattgcttacgttttcatggcaaaatagtatctgcattttagaaaaaatagaatatagacaagtattattgtctattttctatagaaagaaaggaaaggcactcagatcactgtctacaaagagatccagtgttaattgcttgataaaaggtgtctggccaggctctgtcacccaggctggagtgcagtggtgtggcacgatcacggctcactgcaagctctgcctcctgggttcatgccattctcctgcctcagcctccagagtagctgggaccacaggcgcccaccaccacgcccggctatttttttttttttttgtatttttagtagagatggggtttcaccgtgttagccaggatggtcttgatctcctgacctcaggtgatccacctgcctccgaaagtgctgggattacaggcgtgagccaccgcgcccggcctgctgctgcttttgtatctttgcagaaaacaattggcttttaggtgtaataatgctaaactttataaacagacactgggaaaaacttcctacttttggtatttcaactgtgaagtttatttgcataacttctttatgataagtttgtcaaataaacattttagcgctcttcaagtgacctttaggaagagattttctgatggaacatcgtatcttagaagtccattttttcttgccaggcgcagtggctcacacctataatcccagcactttgggagaccaagacgggcagatcacttgaggtcaggagttcaagaccagcctggccaacatggtgtgaagccgcatctctactaaaaatacaaaaaattagccaggcatggtggcgggtgtctgtaatcccagctactcgggaggctgaggcaggagaatcacttgaacctgggaggcggaggttgcagtgagccgagattgtgccactgcactccagcctgggtgacagagcgagactctgtctcaaaaaaaaataaataaataaatacagatagaagtcaactttaaagctaatacccaatttctaatttaatttaatttaattttttaaaatagcgtcttgccacgttgcccaggctggtctctaactagtgggctcaggcagtcctcccgcctcaccctcccaaaatgttgggattacagctgtgagtcactgcaccgaccccaaattttcttttcttttctttctttttttttttttttttttgagacggagtcttgctctattgcccaggctggagtgcagtggtgcgatctcggctcactgcaaattccgcctcccgggttcacgccattctcctgcctcagcctcctgagtagctgggacactacaggcacccgccaccacgcccagctaattttttgtatttttagtagagacgaggtttcaccgtgttagccaggatggtctcgatcttctgacctcgtgatccacctgcctcggcctcccaaagtgctgggattacaggcatgagccaccgtgcccggccttttttttttttttttttttttgagacagggtctcgctctgtcacccagactggagtgcagtggcgtgatctcagctcactgcaacctttgcctcccgagttcaagcgattctcttgcctcagcctcctgagtagctgggattacaggcacacaccaccatgctcatctaatttttttgcatttttagtagagacggggttttgccatgttggccaggctgggctcgaactcctggcctcaagcaatcccccacctccgcctcctgagtaactgggattacaggtgcgagccaccgcatccagcctgccaaattttctaaagtagttttgccagtttatactcctgccagctgtatataagaattctctttgtgccatattcctgataacacttgatttgaatcagccttcttgttttttgccaatgtagaaggtgtaaaatggtatctgctagaggccttaatttacatttcattaatgtctgaggttggacatattcttatgtatgtgttcattatttgtcatcacttgtgagaatagataatacaggtattactccattatattggtggttaaataaagggactaaaaggaagagtgatttggctttcagtatgcaacttgataagtggcagtagtttatttgcctagactggctaacattgtttatttgaaaaacacattttgagtttctgtgatgtatataacactttgctaggtgctccttgagaataaaaagagctataaaattagtatcttctttttttttttttttagacggagtcttgctctgttgcccaggctggagtgcagtggcatgatctcggctcactgcaagctccacctcccggggtcaagcgattctacctcagtctcctgagtagctgggattacaagtgagcaccaccatgcccacctagtttttgtacttttagtagagatgaggtttcaccatgctggccaggttggtctcgaactcctgatctcatgatccgcccgcctcgacctcccaaagtgctgggattacagacatgagccaccatgcctggcctcttttttaaatttttatttttatattttcttctcaaaacttagtaccttctcacaaagagtagagttcagtagaggaaatatgatacatcatggtagctgacaatagaggcataacctataaataatagagctaataacccggtcataatctggttaatgagtgtttgctaactgtgtaatacatataatacaaaaagttaccattatagataccataatctctaaagatgtaagaacagaaccagtgccaatttacattcaattctgttccgtattttggtcttcatttaattgtaaatgcaaataaggtgcatatgtcgtctacaaagcaaaaaagtacaaggattttcttaagtgatcagtggatggctatcttactacaagcagtattgttcattcttcataagctggtgattttatataatttacggagttccaaaagcgaatataccaaaaatatatattcagagaaatctaggttttaacttggtcccatctctcccaaagtaactattttttaaaattttggttcctccgccaaccccacccccgacccatgcggtaactatggatggtgatggatgtcttaatttgattgtgataattattgcacaggatatatgtatatcagatcatcatgttgaatatatgcaattttgtcaattatacctcagtaaagctgggaaaaaattatggttcttccatttaaaaaaaaaatagaaacaagtacaccccgtgtgtgtgtgtgtgtgtgtgtgtgtgtgtgtgtgtgtgtgtgtattgatacaccttccccccatctcttttggtaaatgatagcatcccatatatatttttttcttccaactggttttcacttcatatattatggagattactccatggcagtatatggagctattttctcatttgtttttatagcttcaaaattatttagtgtagaatgttctgtagttagttgagccattcccctatttatggctgtttgagttacttccagtcttttgctgttactgataatgctacagtgacagcctagtgcatatatctttttgtatttttgtgagtatatcctttggatagatttttagaaacgggatatatgggtcaaaaggtatatatgtagtcggtactcctaaacactgtgttatattgctttcctatgacttgaaaattgtagattattaaacctatcctcacagaattttaggaggaaaaaatcaattaatgccctgactataatagaaaaaaagaaaaggcgagcaatttataatgaaatacatgttttttgtttgtttgtttgtttgtttgagacggagtcttgctctgtcacccaggctggagtgcagtggcatgatcttggctcactgcaacctccgcctcccgggttcacgccattctcctacctcagcctcccgagtagctgggactacaggtgaccgccaccacgcccagctaattttttctgtgtgtgcttttagtagagacggggtttcatcatgttagccaggatggtctcgatctcctgacctcgtgatccgcccgcttcggcctcccagagtgctgggattacaggcgtgagccaccgtgcccggctgaaatacatgtttttatttgtaaatacttgatcacaactatactaaaagccattatgcagtgaccagagacttgtgtctatacataggggtgaccacagtgcggtctcatcatatggactctgctgttggtgactcaaccagcatgagcacagtattgctagtgacatgatttccaaaattgtgaataaacttcttggtgaagtctgagccaaagtacaagctcctcttggttcacatagtggttgcatatctggaaaattcagtgtatgctaaaactggaaaaatattttcatatgtgaaatagaattttgtcctcagttcagatcattataagttttaaaatgataaatcaacacgtggtgggacactgaggagttgtgagcacattgcaaaacatcggatacctgtggtccctgctcattgaatgccagcagaactgcttttcattcctaatcatgtttattttttactctctttgttttgattaattttgccgagatattttactagttttgcccaagacactatttttggctttattgatagtcctttttgtatattagttttctgttcagtaatttctgatttatcttgattatttccttcctacattctttggatttattttactgttttttatacttcttaggttggatgcttaactcgttaatttttagttctcctttattttatttatatatgtatgtatgtatttatttatttatttatttgaaacaaggtctcactctgttgccaaggctggagtgcagtggcaaccccaacctcctgggctcaagtgatcttcctgcctcagcctcccaagtagctgagattacaagtgcaagccaccatggccagctaattctttatttttatttatttttatttttgagatggagtcttgctctgtccctcaggctggaatacggggtgaaatctcggctcactgcaacctcctcctcatgagttcaagcgattctcctgcctcagcctcttgagtaactgggattacagacgcgtctcatcatgcccagctaatttttgtatttttagtggagacagggtttcaccatgttgcccaggatggcctcgaactcccagacctcaagtgatccaccgcgcccagccccccagagtgctgggattacaggtgtgagccaccgtgcccggcctacttttatttttttacagggtcttgctctgttacccaggctggaagttctccttttttgatgtaaacattcagagctagctgggcactgtagtgcacacctataatcccagcaatttgggaggccaaggaggatggatcagttgagcccaggagttcaagaccagcctgggcaacatagggaggccctttctctacagaaaatacaaaaattagctgggcgtgatggtgcacgcctgtggtgccaaccactcggaggctgaggtgggaggattacttgagcccaggaggttgctgcagtgagccgttattgcaccactgcactcctgcttgggtgacagtgagtctcaaaaaaataatataaataaaaattcagagctgtaagggcttcgtatcctagttttttgttgtgctgctggtgaaatatacataacataaaatgtattatttaagcatttttaggtgtataatttggtggcattaagtatattcaatgttgtacaaccatcaccaccatccttttccagagcattttcatcatcccaagcagcaattccgcatcccggccaggcgtggtggctcacgcctgtaatcccagcgctttgggaggccaaggcgggcggatcacgaggtcaggagatcgagactgtcctggctaacacggtgaaaccccgtctctcctaaaaaaaaaaatacaaaaaattagctgggcgtggtggtaggcgcctgcagttccagctactggggaagctgaggcaggagaattgcttgaacctgggaggcagggcttgcagtgagctgagatcatgccactgcactccagcctgggcgacagagcgagactctgtctcaaaaaagaaaaagaaaaagaaaaagaaattccgcatccattaagccgtaactctgcatgttgcactttgccccgtctctaatgacctttattctactttctgtctatgaatttgactaaggtatctcacttgagtgaaattaatacagtgtttgttaggccggacatggcagctcacacctgtcatcccagcactttgagagtccacagtgggaggatagcttgagctaaggagttcaagaccagcctgagcaacatagtgagaccttgtctctgctaaaaagtttaaaagttagctggggatggtagtatgcacctgtagttccagctacttaggaggctgaggtgggaggatcactggagcccaggaggtttagaccgcagtgaggtctgatcatgccattgtaatccagcctgagtgacagagtgagaccctatctccattaaaagtatatatatacagtatttgtccttttgtgtttggcttattttacttagcatattattttcagagttcatttttattaataatatatatcagaatttcattcctgagccagtatggtggcatgtacctgtagtctcagcacagctacttgggaggatcaggtgggaggattgcttgagttcaggagctgaagggctgcagtgctgccctctgatcatgcctgtgagtagccactgtgctccagcctgggcaacacggcaagaccccatctcttaaaaaaagaattgtttgtgtgtatatatgccacattttgtttattcaatcctgcaagttttttatatatagtattttattttattgtattgtattgtattttaaagacagagtccagctctgtctcctacgctggagtgcagtggcaccatctcggctcactgtaatctccgcctcccgggttcaagcaattctcctgcctcagcttcccgagtagctgggattgcaggcgcatgccaccacgcccgactaatttttgcatttttaatagaatcagggcttcactatgttgaccaggctggtctcaaactcctgacctcaagtgatctgcccaccttggcctcccaaagtgctgggattacaggcatgagccaccatgcctggcctgagttttttatatatagtctttaaatctccattcagttctaaatatttttcaattttcattatgtctttttttaactggggtttgttggaggtgttttcaaatttctaaacatgtatttctttcctagttatctttttgttattttaaacttaattgactttaagagtgtgtagtgattctggtcttttaaaaaaaacaattgtctcaatgtttctgtttacctcattcttaaaaaatagttttgttgagtttgcagtttatgttggcagcttcttgtctcaacacactgatgatactccactgtcttcttgctttcattgttgatatcaagaagtaagctgaccattcaattactgcttctgtgaaatttgtctttttttctcctttggccaattttaggaattctttgtctttgatattattaatatcactacgatgtgtctacttgtagataattttctatcctgcttttgattcattagacttctacttacagatttgtgttctttatcagttctggaaatttctcagctattaatttgttcagtggaccagtccttcattctaccaccttctggaactccaagtagttgtatgttagaccatctaatctactcatctcctctttcatattttctttttctgttttttttgagacagagtcttgctctgttgcccaggctggagtacaatggtgcagtctcagctcactgtacctctgcctcccaggttcaagcaattcttccgcctcagcctcctgagtagctgggattacaggtgcttgccaccacgcctggctaattttgtatttttagtagagatggggtttctccatgttggtcaggctggtctcgaactcccgacctcagatgatccacccgcctaagcctcccaaagtgctgggattacaggcgtgagctaccatgcccggcctcctctttcatattttctatctcattgtctgcaatgagttcattagttcattgttcattaattctgtctaacactatgtctatgctgctttttacttcaaatgttgagttttagctttcatttattttttcttattgaaagttctgtatggtgttttcatattcgctctattctgcttttattttcaagctgcttctatgtgtcctttgacacagcattccatatctgtgtttttcagagatttttcctcctcttgccatcaccattttcaaaatgctaaaggttctcttgttcctttctgtccagagggatttattcctgattggttgttatgtgcattatagcctttttcaggcctagccttatgtgggagggacgcctgttaatttttcaacattaggcagactgggttttactacctgtcccctgtggcagccatcaaagtggaagcatgaggtctctggggtttagtcagaatccctcgagaataagtagattagtaaattgcttactctttttgagttcctggttttgctttggtttgggctctatggaatcatccctcttattttactagcccatccatgcatttaaaaagacttgatacgttatccagacctttatcttagagtttgaagcgaagttttagtttccttcttttttaccagcctccagattgtgttttctgcatctcttttctcgctttccctcttttctttctggatttgctactagtgggactgatgttatggccattgtcaccgtcaccacatgagaacactcttgcttcagagttgtgaaccttctgtttagagtgtgtgttgtcatcttcaggtgatttggaaatgttttcattcatgcttctgctctcaaagacatctgaggctcttttgtgtttttgacggggcaggtggggagggaagggccactggtgttgggctcttgcagcttattgagagattgttgaaagtctgggtgattaattagtgttactgcattcataatgtactgaaaaattaaggctcacttgttatttatataaaaagtaaataaaaatgctttttaaatcattgtgtttttcagtaatagatggtttacacttggagtactgtagttgatcccagcagataatagtaagtttagtaatctccactatttgggctgaccggttccagataccactccgctgttcgtttctgctgtatatttagccacccctagtctccttcagcagacaattgaggaattgtttgtgtttgagtcgtgtcacagttaaacagtgggcctcttagaagagtacagtgtgttttgggcacactttttgtttcgcctacttgtttttcactgaaaagtagcaaaaagtgtttgaacagatttagagagaggcactacttaccgtttgctcttttttttgtaaaacatttgttactaatggttaagcaaaacataaggtaaatcagtattttaccatgaattatttttatacctaatattgtttttggctaacatataagatgaacataaggaaccttatcacagtctcatttggtacttttcaggcatttgacactgtcagaagtagcaattcacacacaaaaaatactgttttatggaaaagagaactgaaggtcatgaatcagctgtgaggggaaaagtataaatctttctaaatatatttttgttaatatggggtagttgatgttgtctagtgctgtttgattaagaaaacaagttcaggccgggcacagtggctcatgcttgtaatcccagcactttgggaggccgaggtgggtggatcacctgaggttaggagtttgagaccagcctgaccaatatagtgaaaccccatctctactcaaaaatacaaaaattagccagacgtggtggtatccgcctcccagctacttgggaggctgagacaggagaattgcttgaatccaggaggcagaggttgcagtgagccaagatcacgccactgcactccagcctgggcgacagaatctcaaaaaaaagcaaaacaaaacaacaaattcaattagccgggcgtggtggcgcactcctgtaatcccagctactcgggaggctgaggcaggagaatccaggaggtagaggttacagtgagccgagatcacgccactgcactccagcctggggacagaacgagactccgtctcaaaaaaaaacaacaacaaaaaaaatctgtggacacagtatggtaccataaatcagtaaacattgcctaatacatgcacagtacctgcctttgaattgcttgaggtcttaggtaggaaaagcagataaaataactaagggtttatagttgtaattcattgccgaagaatggcccagtatattagcataagtaagaaaaaagagcctgagattcagagttgttaggaaacttgagttctagtcttagttctgttagtaattagatttatgtgcctttaggctaaccacttacttttgggtaagttggttttttttcacatataaaacaaggcagatggactagatgacttaatcctttacaatcttaataccgtgtgaatttgttttcctgtgtaactcgagtttagaggatgtgagggatctttttgggcaaggactgacctcaggaaggaaatcattttcactaagccttgaaagatttggttgggtagataaaaggaaaaagaaaagctaagaatgcagaaatagatacataaaaattatttaggccaggaaagtctttggtgtatttgaggaatatgaggcataggattgacatggtgcagtcacgtgagatgaaattgactcagcagttcagagttcagtggccctaatgccagagtttagtcctcagtctgtaggttatgggcagctagtcaggacgatgtgtagccagggagagtcatagcacttgttacctttagtcaacttctgcatgataattaaggtatatttaaccaattctgacttctttctcccaacaaaaaaactgaacacagagaaaccctctagggagctagttattaggtggtgcaaaagtaattgcagtttttgtcattacttgtaatagaaactacttttgcaccaacctaatagaatttcttccactcaacaacaactgaaaacatagagactgagagaaatccagagatgatgtggtaaatccccagctaagcagctggtagaggcatcagtattgtatccaaggccatgcttatatttattgagatctagtcactcgtggtatattagaattgtggcggcatggttgtcatcttgaataatttcattagggacatctctgactcaagtttactattaaattagggttttgttcaggcaagtattgcttaaagggtacgtcatgttaattggaatttccttgagacagctcattcagcatgatagtgtgtagtcactaaaaagttccgaaaaacacaacgctgtggttcctctttagttctattagactgagtatgtacagaacataagttactgcatagtatactaacattgaacagtagaaaaaatatttatttatttattttttttgagacggaatctcactctgtggcccaggctggagtgcagtggtacgatctcggctcactgcaagctccgcctcccgggttcaagcaattctcctgcctcagcctcccgagtagctgggactacaggcgcccaccaccacaaccggctaatttttgtatttttagtagagacggggtttcaccatgttggccaggatggtctcgatctcttgaccttgtgatctgcccgcctcagcttcccaaagtgctgagattacaggcgtgagccaccgaaggataaccaaaatgtaaggaaaggctgtgttctgaaagttgctgtgtaatgtcatttgcttagaatttagcattgcttctcatgaatgaaaatgtctctctggctcagccgtgaaaaagccttctgacctttctgatactgtaatgaaaagcagtatggtaaataccattgcatgcatttgggttttcaacatgttaaggattgaagaggtttctgtaccctagcttggaaatctagctgttgcttatttgttctgttaaaatgtgttctgtcgagtataagatgaaataaatatgagtcttctgccacctccgtaaaacatcaaagcatttggggtatgtaggtgaagggtaaagatggagtacgctttaaagcagcagttctcaaagtgtggtctgcaataccgtgggggagtctgatgtcaaaacctttttccgaatattcttaacacattatttgctttcacactgtgttgacgtacggattgatggggcaaaagcagaagtgggtcaaattgctcgttactttaacccataccaaggccatggccaagtgcttgcagtaaagtgccagtttcacgtaataatatacttaatggaacaataaagttattgatcaagtattctatatagcaaaatgggaagtactcataaggtacttctgcgtaccaaagtatgaaccgttgtcttggagataaccacttctgcaagagagctaaactagccctctgtttcatgcaacacctttttttatttggaagaacaactgacccacaaattccggttgttcagacttcgtattttgcggacatttcctcaaaaatagtgacagaatttgttgctactgacacaatttaggctttcaatcaaaaatcagagttttagaaaacttgtatccactatgttgattttagcagtttctcagcgcttgacttactctgatgacatagatggtgatattaatgaatgtggttttatttttactgcataacgagatgtgtcaacattgggagtatcttcaaaacccagggaaccaatattttccaaaaaccaattcatgacattgtaaaacttctgcatgggtaacagattcattcaaaattcaagagagtcaattggtttaatgtaatagggtacaagaagattcattgctgtgatttcagattccacaatgaaccttttaggaaggtcaggtttagtgtaataccaaagaagaaaatccacaattatgtgaaagctgttaaaatgctcctccgttttcaggtgggtatctgcgtaagacaagatttttttcgtaaatttcagctaaaacaactcagcacaacagattgaatgcagaagcagatctgatcatctggctgtcttctaccacaccagacatgaaaaagacttgcagaaatgtcaaagaatatcagtcttctcactcaacttattttgttttggaaaatagtcatttttcataaaaatgtatgacatgtaatgggtttgttgttatttttaaatgaattatttaaacaacttggttttttttgttttgttttgtatttttgaggcagattctcactctgtcacccaggctggagtgcagtggcatgatcttggctcactgcaacttccgcctcccaggttcaagctattctcctgcctcagccgcccgagtagctgggactacagacacgcgccaccacgcccagctaatttttaaatttttagtatagacggggtttcagcatgttggccaggctggtctcgaactcctgacctcaagtaatcccccgaccttggcctcccaaagtgctgagattacaggcgcgagccaacatgcccagccaaaaacttgttttaatttctcatacagtaagtatatataaacataaccctcatcaacaaaaactctttggactcttcattaatgttgacaagtgtaaagggtcttgtggccaaaatgttttgagaacggctactttgaaggagctgagtagctttaatatgcctgtgttgagagcagataccaataaagggaatgcctgacctaacttaaaacaagtacgtgttggtctttctccaggttatgaactcttacagaggactcaggtcgtcttttattttctctaatgtctagcacagagtcttataaatagtaatgatgataacaattgcagcagcttttaatctttgttagctcatttaatctttattctgtgagtagatagtgagatataatttgcataaccaaaaattcaccattttaaagtgtacaattgagtggttttagtgtattcacagggctgtgcagccatctccactgtcttcataccggaacatttgcgtcccccagagaaacttgatacccattaggagccccatctcatttccctcactccttagcaaccactcactaatcagccgtgtttatgaactaaattcctctctgtctctgtggatgcccctgttccggacatttcatatgaaacggaatcctacaatatgtggccttttatggcttttttcacttagtgttcgagggtcatccatgttgcagcgtgtatcggtacttctttttgcggccaaacaatattccatcttatggatacaccacgttttgtgtatccgttcatcagttgatggatatttgggttgtgtctatcttttggctgttatgaatgcttctgtgaacattcatacaaagtttttgcgtgaacatgtttttcagttctcttggctatatacctgggagtggaattgcggggtcgcatagtagctctatatttaatttttgaggaacttactaactccctttttaatagagtttttattaggggataattttagatttacagatgaattgcacagatagtagatttcctgtatacctatcacccggcttcctctaatgttaacatcttacataaccgtgatacgtatgtcaaaacaaagcagccaacattggtacctcactgttaaccaaattctaggatttatttggattctactagttgtttcaccagtgccccttttctgttccaggatccaatccagggtgtcacgttgcgtttatggttgtgtctcctctgatctgttacagtttctcagtcttgtttttcgtgtccttgacagtttggaggaatgtagtggtcaggagttttgtagcatatccctcaactggggtttgtctggtgtttttctcgtgattaggctggggctgtgggtttgggggaagaataccacagaggtgaagtgtgcgtcccatcacattagattaggggataagtaatattgtcatgacttgtcgctggtgatgttaactgtggtcacttggttaataaggcatgtttgccaggttttttcactgcaaagttatttttcccttgccatacactgttctttggaagtgagtcactaagtcctgccttcactcaagaggagacaaggattaagctgaaactcctagagggagacatatttacctattttatttgcaattcttctgtaagaaagatttgttccttttctcccatttatttacttattcatttatttatgtcagtatggaataacatacttatttgatactttgggtcgtaatctaatagtatactaatttgctcaaatcatcccagcattggcctatggaaaatctttcctgtgtccctttggcatttcctcatccttttaaagtgctcccttgccttctgacactacagcgtgctctgggctcatcttccattttccctttcccatgcctagagtcagccattccttcaaggagtcatgagacgtggtgaagtgtaagtcggtggtggaaacaggattccatgcaaagcagtctgattctggaacatatgctgttaaccaaaaaactggataacatgcagctgatttattattattattgaaggtgcattggcagtttctactcacattccatctatgtgggagccttgaggaaagaatttatagcactttacactaattattgtgccctgtttttgttgttgttgttttttgttttgtttttgagatgatgtctcactctgttacccacgctggagtacaatggcatgatctcagctctgcaacctctgcctcccgggctcaagtgattcctctgcctcagcctcccgagtagctgggactacaggcgtgcgccaccacacctgactaatttttgtatttttcgtagagacagggttttaccatgttgcccaagttggtctcgaactcatgaccccaagcaatccgcccaccttggcctcctaaagtgtggcgtgagccaccgcgcccagccgcaatgttgttactaagctttgtctttcttctgtctgtagcaagacagggcccctcttgtaatgcacactggtagtagcccatacttaggaatagccagctgcatgctgcttgcatcctaccccaaaacaaaacaaatcccgcatgatgtcatgagctggttaggaagaatcattttagggcatgttgtcagcactgccttagatcctgccctcatttcttccttagaccagacagccttttgcacacaaagatagagatctttttcactcccttttcccagcccttctctagctagttaccccctctcttagtctgttttcatgctgctgataaagacaaacctgagaccgggccatttacagaagaaagaggtttaattggacttacatttccatgtggctggggaagcctcacaatcatggcggaaggcgaggaggagcaagtcacgtcttacgtggatggtggcaggcaaagagagagcttgtgcagggaaacacttctttttaaaaccatcagatcacgtgagatgtactccctatcaggagaacagcacaggaaagacttgccctcataattcatttacctcccaccaggtcccttccataacatgtgggaattcaagatgagatttgggtggggatgcagccaaaccatatcactcccagaaatgtttttgctcctttacctttttttattctttctcttttgtagaatgaaaaaataatcattttgagagcgaaaatataccatagtgctagtgacacactcccatcaaggaaaataaaagctgtaagatttggtataagcttctcaaatttttttattttattttattttatttttttgagacagagtcttgctttgtcgccaggctggcatgcagtggcgcaatctcggctcactgcaggctctgcctcccgggttcacgccattctcctgcctcagcctcccaggtagctgggactacaggcgcctgccaccacacctggctaactttttgtgtgtttagtagagacggggtttcaccatgttagccaggatggtctcgatctcctgacctcgtgatccacccgcctcggcctcccaaagtgctgagattacaggcatgagccatcgtgcccagctaatcttctcaacttatacctacttttcttcaggtataagcattcaaatgaaataaaaaatttgtttttaagttctgaacagttagcattcttttcattgtatatatgcaaggttttgtttgcttaaatgcattaaataatcttagaatcaaattaagatccagttaccaatgaaaaccatgtttagtgggaaaatatgttgttttctaacatatggttttgtatcagaactcatatgtataagttacggatcctctcccttttactgctgatttcaagtatgtgtcatctacttttttaaagacttaaacctagaagtatgggtagcagggttgaagttttcactgaattagccatgtagctaagacagattacccaactgcctggacagggcatttacaggtgtcacagaacctgagggatgtggccacactcagcctttcagccatgctctgtgtttaattttgtcagtatatccagattcgtcaagctcctttgtgattatctgcaaaactcaaaagactaatgtgtgtaaattaggatgtcaaattttcagagaccaaatactgtatcagcagtgcattgtttcaagattccttggccaggcgtgggggctcacgcctataatctcagcaatttgggtggataaggcgggtggataatttgagatcaggaattcgagaccagcctgggcaacgtagtgaaacctcatctctacgaaaaatacaaagattaggctggatgccgtggctcacacctataatcccagcactgtgggaggccaaggtgggcggatcacctgagttcaggagttcgagaccagcctggccaacatggtgaaaccccgtctctactaaaaatacaaaaaaattagccgaaagtggtggcatgcggctgtaattccacctactcaggaggctgaggcaggaggattgcttgaacctgggaggtagaggttgcagtgagctgagatcacgccactgcactccagcctgggtgacagagcgagactccatcttgaaaataaataagaattttttaggaaagttactgtgaaggctaagttgtaactacaaggttggagtgaaatcagattggaggggtgctgtttgatacccttaatagccaagcatctgtctctgctctagaggtgcacctccccaagatatcctataatttgctggtcagaacatatttttcctctttggaattaaaaaaaaaaaaaaagatttcatgttgtctgtctttctattgagaaggtctcttagaatccattgattagaccagtagcttttggtagtaccatgatgtttccatttgacttttcaaacatttttcagctgaccattaccagctttgttgggggtaaactcaagagagttacatcttttacacattgatttttccagattttgcaaatgtcactataaatggataatattttctaattgggagttgtggcaggggtagttattactgttttttgcttgttcgtgctattttttactttgttactaattgtattttttccaattccaggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggtaaatagcgcttctggctttcagagtctcagcattggtttattattgtatgttacccatgttgataacttttatggtgagaacattaaaacagatcatgaaaacaatcggtgctaatatacaggcactattaaaaagactagtttattttaaattgtgatttttaaaagaataaaatgtaaatttgtttctcaccctgcttgttatggccaatgaatttctatattcatctcctttgttttctgagaccttggccatattttaatgagatttgtgacacttgagggagacctgctattataagaatggtgagatagggcccacagtcccctgtctgaaatccctggagccaactgtgttttggaattaagagtttttgtgattcttgagtagtaaatactgtcttttaccaggtgttctataatgccctcagaagtgtcggaggcagcctcagtactcacagactgatgtgtcctcagcaaaatatatgtctagttcagggtttctcaacctcaacactattgacatcttggagccaaataatttgttgttgcagggacctatcccctgggggcaaaattactccaattaagaatcactgggccagacacagtggctcgtgcctgtaatcccagctacttgggaggctgaggcaggagaatcacttgaatacgggaggtggaggttacagtgagccaagatcgtggcaccgcactccagcctggggaacagggtgagactctctcaaaaaaaaaaaaaaaaagtgtacgtatatatatgtgtatataaaacatccttgtacctaccacccagcctagaattttatcagtacctctgaagtccccatctgctataccccatcctaaccttctcttcgtccccaatatccaccattctgcatttttattgtaattttataacatatctagtcaccctcaaatatgtatggtttaggcatgcctgtttgggaaccttttatgaatggaattatgctgtctgcattttttccacatacttttcactcagctttatgcttttgagacttgttgatgtatgtggtgtagtttgttcactttcactgctgtgtattgctacactgtaaatatactgcagtttatttggccagtctcctatctgtagacatttgggttgttttcatgaatagtgttgctatggataatgttgaatgtacatcttactgggtgtagggcaaagcttctcaaacttcaggtgatctgttagtttagttcttgaattgctaattagaatcacctgggaagcttaataaatctgtgttcaaactccatttcattccagttgaatcagcaatcagcatctttaggggcttaccctggcattgtttttggttttgtttttaattttttttttcttttttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttaggttggttccaagtctttgctattgtgaataatgccgcaataaacatacgtgtgcatgtgtctttatagcagcatgatttatagtcatttgggtatatacccagtaatgggatggctgggtcaaatggtattgctagttctagatccctgaggaatcgccacactgacttccacaatggttgaactagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgaaaaatatggaacgcttcacgaatttgcgtgtcatccttgcgcaggggccatgctaatcttctctgtatcgttcgtattttagtatatgtgctgctgaagcgagcactgtttttaattttttaaataccccagatgataatgatgtgcagctcatattaaaaaccaatgcattggtgggttatgaactctgtatagtggacgacactaaatgcgctagaataatataatcagagtgttgtgcacacagtgaaaacgttgtcttatgaaacagtttgttttagttatgtgtatactgagtcaggatataaaatgtatttcttggtgtgggtcctgaccaaagatttaaaggtcattcagagatgtatatttaggattagaattgctgggttacaggctgttcccgtgtgtgacttgactaggtttgtcagattgttttctaaaagtttttagtgtacattctcacccacagaagatgagcgttcccattgctgagcaccctcagcaactctgggaggggtgaaatactagctcattgtgttttaaattggcctttccctgattactcaaaaaactgagcatcttttcgggttaattgaccattcttgtgtgctttctgtgaaatatctgttcaagagaaagaaatatctgttcactatctatattagtctgttttcacactgctgataaagacatacctgagactgggtaatttatacaagaaaaagggtttattggacttacagtttcacatggctggggaggcctcacaattatggcggaaggcaaggaggagcaagtcgcgtcctacgtggatgacagcaggcaacgagagagagcttgtgcagggaaactcccccttttaaaaccaggagatcttgtgaagacctgcccatgattcagttacctcctactgggtctctcccacaacacatgagaattcaagatgagatttgggtggggacacagccaaaccatatcaaggtctttaatccatttttctacttggtggttagctttttcgttttctattaataaacattccttgtagtctatacactaatcctttgccagttatatgatgttaaagatagtattccaggatgtgatttgccttctcaccctttcagtagtatattttaatgaatagaagttattaatttgatatggtggatttgatcaatttctcttttttttttttttgagatggagtctcattctgtcacccaggctggagtctagtggctcaatctcagctctctgcaacctccgccccccgggttcaatcaattctcctgcctcagcctcccgagtagctgggattacaggcgcctgccaccgcgcccggctaatttttgtatttttagtagagacagggtttcatcatgttggccaggctggtcttgaacttctgaccttgtgatccacctgcctcagcctcccaaagtgctgagattacaggcgtgagccaccgtgcctgtcttcaatttctcttttttgtggttcgagctttttgttttttaagaaatttttgtcttacttgaggtcataaagacattttcctgtattttttctatagcttgccttttacactttaaatctttgagctagctggattttatttttgtatatttgtgaaaagattcactttcacttttttctttaaacttggatagtatcccagacccatttattgagtcttctatttccccactgacctagaccaccattatttgtcaggtttccatgtgagagtctgtttctgtgttctctgctttattccattaggttatttgtctgtacctgagctaatagtagcaccctgtcttgattactatatcttacaatctttttttttttttctttgaggcagggtctcactctgtgacccaggctggagtgcagtgatatgtcttggatcattgcaacctccacctcccagattcaagtgatcctcctgcctcagccttccaagtagttgggactacaggtgcacaacaccatgcccaactaatttttgtattttttgtagagacaggctctcatatgttgcccaggctggtctcaaactcctgagctcaaacgatctgccagccttggcctcccaaagtgctgggattacaggcgcgagccaccacacctggctcttatattgattgttaatgcctgatggaacaaatctcttaaccagattcttcttcagaatcctgttaattgctttggctttttgcatctttctataaattttagaatctgtttatcatgtactttaacagaaaaaaaaacctgtggctactttgattagaattgtatagactttgggccgggcaccgtggcttatgcctgtaatctcagcactttgggaggccgaggccggcagatcacgaggtcaggagagcgagaccatcctggctaacaaggtgaaacgccatctctactaaaaatacaaaaattagccaggcatggtggcaggtgcctgtagtcccagctactctggaggctgaggcaggagaatggtgtggacccgggaggcagagcttgcagtgagccttgattgcgccactgcactccagcctgggcgacagagcgagactccgtctcagaaaaaaaaaaaaaaaaagaattgtatagactttgtagggcaaataggggagaattgcatccacctttgtagctgagggtggggaatctgcagagcctttgtgtagcctgtttacagggaagtttagttgcatgtcgttttcagtctcagagagacagagatgtgtggaatgtttggagggtaggatgcttcttgattcctcctgtttcctggagctctacctccctttcctcttacacttattgctcctacctggaagctgaaacacagcccagtcactggggcccagctttcggcattaggaatgagggagaaccttgtgtgtgtttacacatccgtgcttttgtaaacatagaaataacctgctctgttgctctcactggattatcccgttcatcaccctagtggttgcctctgggtccgctcatttccacccaccttgcttctagtttcagccacctgcagcagtttgcagaagcattttcccactgacatcctaactgctgcttctctcgctagtcttatgctaattgcttttcattctggagcattcctcgtggattttattctgtgaaacactcggttttggtgtagaagggagagaacttcagtatgtgctcagtacatcatcttgaaacagaagagtctaaaaggcaaacaattgtatttccattttttaaaaatcataatgaccttaagacttttgccatctctaatgtaaggcctgatctagagataattcattttattccactaaaaaatttacatcccttactgctttccttactaaaaaaacagctaatatttttataaaaagaaaataaagactctaggatgttttcacttattaattactggttttaattggtatcaccaaaaaactcgaaaattatccttttggatcgtgccgttttaaggcaacttgacagaacagatcttttttccatgcttgctaatgtgtgtactatgtgaataatcagagatgagtgataaagcagatagtgtccctgctcccacgacagcaatctcaaaccatggtatagaattacaagccatgaaaagtggtacagaggcagtgcacaacatgtgtccaatctgcagtgtctgggaaggcttcctaaggaggtcataatagagctgaagactgcaggatgggtaagggaaacgatagttacaaagtgtgttccatgcccgggaagagcctgtttcagtggcccacctacaggagggatcagagcacatccatggagctgagtgccgcccggtgttactggaaagcagagagggaaggacagagaattacagcagggtgtatgtaggcactacagacagcagaagaggctgaagaggtaggcagtgaccaggtcataaagggccttgtattctatgctacagagctcacattttatcctgtttcctggggaaccattacagatttttaatcaggggaaagacctggccatctctctgttttagttaggagagaatggtaggtatatagaaaaaaggttttgttcgaagtgtgagagtgaagttggaaactagttaggaggcttttgctgtagcccaagtgagaaatggcctaactagtctactagtttaaataatgaaaatgtcagtgagccatttgactttttaaaataagctttattcatacagctagagttggatggtattgtctttattaactaaagcaattttcacatctagctattcaacctataagcaccttcacttctggttggttatgacttagatctgtaaacaacctttctgattaaaaaaatgaattctgagattaataatagtaacccatacttctctgcctatttcctagaggagtggtccccaacctttttgacactggggtaatggtttcatggaaaacaatttttcttttttcttttttgtttcatcttgttgcccaggctggaatgcaatggcgtggtctcagctcactgcaacctccgcctcctgggtacaagcaattcccctgcctcagcctcccgagtagctgggactagaggtgcacgccaccacgcccagctaatttttttgtatttttagtagagacagggtttcaccatgttgaccaggctggtctcgaactcctgacctcaggtgatctgctcacctcagcctcccaaagtgccgggattacaggcgtgagccaccgtgcctggccggaaaacaatttttctgtggggctgacgggggggtggtttcggtatgaaactcttccacctcagatcatcagacattagttagattctcataaggagtgtgcagcctagatccctctcatgcgcagttcacaatagggtttgcgctcctatggggatctaatgctgccactgatctgacaggaggtggcgctcaggcggtggtgctcactccccactgctcacctcctgctgtgccacccagttcctaaccggccatggacctgtactggtccacggccctggggctggggacacctttcctagagaattctctgctgtgtcatggaatttgaagctattacacatcaaaagaacaaaggaggaattacttatggttagactagaaacagaagagtcttccttttaaacagataaagggtttcttttatttgtttgtttagccttagatgtagcttgaaagcagtctaaaaggtagtgccctagagaatgtgacagtagcctacttaggattcttttcagtaccttttgtcaacatgtgactcagggtctctgcctcttggctgaaggttgctgcctgcctgctgctgctgttttgttgtctaatgaagttggaaaatgattctaagaatctttttttctcctaggacactagttaaattgtttattttattaaaataagttttttgccctggtctattacttcccatcaagtgatctggttgcctggtgaacctcccgtagatggttgtgtttgataagcagaagtgggaagttgacctcctttcattttatgaaacatgaacagatttcagatttctccaaagctaaggtgtaacatgtaggggtccgtcccgcagaccctgacccaatgacggatgaataacttacactgacacagatgttatgcttgtcagtccagctgagagtccgggccacttacagactcccaggagagtgctgtaaagcgttgcaaccatcggcctcaactagccaaggaagcttgcatttatttagtatagattaattgacaaaggcttgagtcaacacacctgtgggtaattcacctggtcgcccccaccctggagagggccatcttgcccaccaatgatcaaaggttagtcttaggaccacatgagtaaacaagctctttagataaactactttatattcctttgtatctgtaccttaagctctctggctcctgaaaagagaatctggctaccttcagccaaactttgaagctatgcaaaactccccggccttccaagcaggtttgcttttttctattcctataatttcttctgccatcctgactgaacccccacatctacataaatttattgtgattggccctctatttctgggcttctagagtcgttatataagagtattaaagacattctgttggtatagcaatatctttccagcacattgttcaattccagacatgctttagtatctttttgttttagacactgtttctaatatcctttccttttcccattgagactattaaaatacagagagtacctgtatgtgtgttatgtaaaaacaaatggcattgaacagatttttaggattttatgtttattttgaatgatctaatgtggctctatctcaagttctgcttaatcgtttttgtgtttttcctttaactttttactctatactcctatcatatatgaaactttaatatatttctctaaactcttaacgtttccaagttgaagaatatgactaggccttagacacaacaggaaccaggaatactcttgctagatatgttatctctcacccttctttttatatttttttcttattttatatttcttatttcagaatgttttttctttatgtgttaagaaatataattcctgggccgggcgtggtggctcacgcctgtaatcccagcactttgggaggccgaggcaggtggatcacgaggtcaggagatcaagaccatcctggctaacaaggtgaaaccccgtctctactaaaaatacaaaaagttagccaggcgtggtggcgggcccctgtagtcccagctactcgggaggctgaggcaggagaatggcgggaacccaggaggcggagcttgcagtggagctgtgatcgcgccaccgcactccaacctgggcgacagagcgagactccgtcaaaaaaaaaaaaaaagaaatagaattcctgggctcagtttcttacaacttcagacactagtgatagactgattctcagggagccgagtctggcttagctgctcaggtggctgcccctgcaccagttgctggagggtgtgtgggaagctgtgctgacctggcttgagttaggtgcccacctcggaccagtcatctgtgaccatagtcgtgtaagaaaatggcatctttcccaactatctgcatagaggaaaggtgagggaagtttccaaaagtaggatgctgagcagatttttttaaaagaaagaacacatataatcatagtacattaaattgtaaactactagtttatcgttaactaataaataatttctcctgtatgtagggtattccgttagaagccaagggacataaagaaatgttgagtgcacgacctcaaattactcaaagtctagtgaaaattgagagagaggtaatttatgatagacgtattaataattgtgtttcagtaaagagaatccaggcttaacagtttcctttccctctgctcctgtccataaccagcattcccttccctctcactgtgaccagatctcttttaagttacatgcctagagaggagatggacatttgagcataaatccctcattactagttaaataagtattattgtgtttcctaccaatactaaactagtagtatctttgtaaacaaagaagagcatacggtaacatttccagtcttatatgtatagacttatcaaacagcatgatttttaactctttgatattagaagaatcttctggttaaacacagcatgttgaccacatacagaagcattctatttactctccctcccaagacccaactaaaatgacagaaaaaaatatatatatatacacacacacacacacggtcaaagagaaaaagagaggagacagtattgtgaaagaggcttcagtacacatttggaaggcagaagtggtggaaaattggcacctgactcagcaggacagagaaacacataacctaagcgtttgcagaggggaatctgtgagaagggaaacaagtttcccttgtagaaattctggaagctcaagatttagaggcacacgacactgtgtcggagtgggggtaggatgcactacacatgctgaggagaagggggattagttgaaaatcaacatcgaaagtgtcaaaggccccccaggactcctcctttacaccccacacatccatgtaagtgttatccccatcctccggaaggaaaaaagaataaactgggatttacatttatttccagagaatttaaaccacagaagcctctgttcttatcaggggagtcaggaaaagttgaagcaccagaataaagcaggtgacttcatgcaagtcagcattttcaactcctttccccatcctgctttcagaatacctgcagcctgactcacagcctcagacaggagattggaagatttttctctggataaacaatggcctggggaaaaaaatactttaggtaccttgcatgcatgctgtccttatctttagtgttaaggttggcttaactcccagttagctttttaatactttctatatgagtagacagtacaggatcacccgacatttatgaaaaaccctttataaatgagagggagagtccaaaacaatagggataaaaacaggaacttaaaagaaatagacagtgtaaggagaaaaaaaaccccaaactgcagcctgtgcatacacacatactgtataatcgtcaaagagaggagatagaggaatccatgaaacaagaaaagagttcgcagagaaagaatgatcagagaacaatggaaaacagttcttggaatatcaacatttaaaattaccaaaacaaacaaaagatagcaatagaaagaagagtggaagataatcaagaaaattctccctgctggagcggtggctcacacctgtaatcccagcactttgggaagccaaggtgggtggatcacttgagatcagaagttcgaaaccagcctggtcaacatggtgaaatcccatctctactaaaaatacaaaaattagctgggctcggtggcgtacacctgtaatcccagctactcaggaggctgaggcaggagaatcacttgaacctgggaggcggaggttgcagtgagccaagattgcgccattgcactccagcctgggcaacagtgcaagactctgtctcaaataaaaaaagaaaagaaaattctctcaaagaattaaacagaaatacaaagatggaaaatatgagagaaaagataacagttaaaagatctgactaatgacaattaagtggaggacatagtgacttctagctctaaaatggtggtgtagaagcacactggcttcactcactctgccctgccaccacagaaaaccaagaacatacagcactaagatgatcaccagcaacatccaagaactcagatatgagaaggagacagttcccaggggcacagagaaatgaaagaactccaggcatgctgtaagaatcggacttccgtatctgcaacacccgttccccctgtccgcctggcgccaagtgtgggaaaatctcccccaattcacagtgtctacacaggaaaaagtgagattgaagaagacagccaccttctccaccatcttgggttccctggcaggaggcctgtccctgccttagcccacaggtggcatagggagagctaccctgaggacagccagaggcagaggagggaggcgggattactgttcccagccttggaaaccctgctgtataactcagccaaaggggatgccaaatagagcagctgttcagcaacaccatgttgtaggaggtttattccacaggacccttggcaggaaccctgagccacccttcctgtactgctaccagaatatccccttggggactcctctctcccatttaggatgggctgcactctgctagaacccaggcaaacctgggcttatggtgccatttagtgctggaaaggaggcagcaacctaggctcgggggtgaggaaaagaaagaaaatcaacaggtaaattacagagactctctaagcaaacatatccaataaaaaccagactaaatatcctcatacttctttgaaaaatggcttaaaattttccaaatttaatgaaaactgtaaacccacagattcaagaaatttaacaacatttgagcataggaaacatgaaaactacaccaaggcttactgtaatcaaattgtttaaaaccagtgttagggctgggcacagtggctcatgcctccaatcctaggattttgggaggccagtgtgggaggatcacttgagcccaggagttcaagaccagcctgggcaacatggcaaaatcccatctctacaaaaaaaaaaaaagaaaaaaagaaaaattatctgggcagggtggtgtgcacctgtactcccaggacttggtaggctgaggcaggaggattgcttgagcccagaggttgaggccgcagtgagctgagatcgcaccactgcactccggcctgggtgtcagagcgagaccctgtttcaaaccaaaaacaacaacaacaacaaaaacacagtgatagagaaaattttaaaagctaccagaaaaaaaatgaaagactcattatatatataggacgaagatagagtgatcccagactttatttaagtaacagtgcaagccagaagacaagggacaacatctttaaagtatttaaagggaaaaaaatctatcagcctagaattctatactattgaaagtgtctttccaaaacaaaggaggacacagaattttaaatgcgtaaaagctgaacgagtgtatcgtcagcagacagactacaaaaaatgttaaactaagcccttcaggcagaaggaaggtgatgtcagatggaaatgtggactcacaggaaagaatgaaaagcactggatgtggcacctccgtggttctggacctttttggcacccgggattggtttcgcggaaggtagtttttccacagacccagtggtgcgggggaatggtttcgagatgaaactgttccatctgaggtcatcagacattagattctcataagaagcgcacaacctggatccctcgcgtgtgcagtccacagtagggctcacgctatgcggtccaacgcggctgctgatctgacaggaggcggagctcgggcggtgatgctcactcacctgccactcagttcctgccgtgcagccggttcctaacaagcctcggactctggtaccagtttgtggcctgggggctggggacccttgtggtatgcgttctttcttatctaaatttctttgaaagataattgttttgagtttttaagaaaacaaagcactgatacaccttgtaacatggatgaatcccaaaaacattaagtaacaaaagtcattcgcaaaagactgcatattgtttggtcccatttatattaatgagcagaacaggcaaaagctatggagacaaagtagattggtggttgcctgaggtttggggtggggcaagggctgaaatggggagtcattgccattaggtgcaaggtttcttctgggtatgataaaaatgttctaaagttagattgtgattatgattgcacaactctaaatatactaaaacccattgaagtgtacaatttcaacaggtgaacatgatagtatatgaagagttctagcttaagaaacaactgagtagataaaagggaatctcaaaatacttagtccagaagaaggcagaaaagattgataaaaacagacctacctacaagaaatctactttaaaacataaagccacaaaataggccaaaatgaaaggatacaaaaaggtgtgttaacaattaaaagaaacctggactggctgtataaacagcagacaaactagagtttagagctaaaaaatactatcagtgataataaggaaggttgttatttcgtgataataggaccagttcattaagatgatataatagaactaaatatttatgtacctaataacagcttcaaaattcacaaagcaaaaactgagaggatttcaagaagaaacagacaaattcaattataatcggagattccaaaacttctctcagtaattggtagaaaaagtagacataaaatcgctaaggatataaaaaatttgaacgtaactatcagccaacttgacctaatagacgtttatagaacactccacacaataacagtagaatatacattctctttaaagacacatgaggtctacttttaaaaattctcaaaaatgttggccaggcacggtggctcatacctgcaatctcagcactttgtgaggctgaggcgggcagatcacttgaggtcaggagttcgagaccggcctggccaacatggtgaaaccgtctttactaattatacaaaaattagctgggcgtggtggcaggcgcatataatcccagctacttgggagactgaggcaggagaatcgtttgaacctgggaggcagaggctgcagtgagctgaggttgcgccactgcacaccagcctgggcgacagagcgagactccctctcaaaataataggctgggcgcagtggctcatgcctgtaatcccagcactttgcgaggccgaagtgggtggatcatgaggtcaggagatcaagaccaacctgaccaacatggtgaaaccctgtctctactaaaaatacaaaaattagccaggcgtggtcgtgggcacctgtaatcccagctacttgggaggctgaggcatagaattgcttgaacccaggaggcggaggttgcagtgaaccaagattgtgccactgcactccagcctgggcaacaaagcaagactctgtctcaaaaaaaaataaaataaataaaggatttaaattatataaagtgtgttcttgtgatcataatataattcaattagaaatcagtcacaagaaggtctctggaaatatttggaaagtaaagaaagcacttcacaaataaaaagatatttagaaaatatattaagccgaatgaaaattcaaaacatcaatatttgtaggatactgctaaagcagtacttagtggaaaacttatagtattaaacaccatattagaagaaaagattttaaatcaatgactttagctaagccatcttaataaactagaagggaagagcagatgaaatccaaagtaagtagaagaaaggaaataataaaaagcaaaatgggaataaatgaaatagggggaaaaagcagcagagaaaatcactgcaaccaaaagtagattcatttagaatgtcaataaaatggataaacctatagccagactgacagggggcagtggatggggaggagagacacattaccaatattgagaatgagagaggtggtggcacccctacagattttacagatattaaaaagatggtatgaacaaatatgtaccaacttttttttcttttctctttttttttttggagaaggagtcttgctttgttgcccaggctggagtacagtggtgcgatcttggctcactgcaactgccacctcccaggttcaagtgattctcctgcctcagcctccctagtaggtgggattataggcatgcatcaccacgcccggctaattattgtatttttagtagagacgagacttcaccatgttggccaagctggtcttgaactccttagctcaagtgatccctctgcctcagcctcccaaagtgctaggattataggcatgagccactgtgcctggccaatgttaaattcttagcaagattttagcagttggaatccagcagtgtataaaaagggtaatacatcatgaccaagtggatttcgttggtttaagtttgaaaatcgatggatgttatttactgtattaacacaatagaaaggatgagccatgggtttgtctcaatacatggagaaaaggcatttgacggaacccagtatccattgctgatagaagtgttcagcaaacttggaatagaagagaatgccctttagcctcataaaggacatcttttaaaaacctaccattggcattaaacttaagggtaaaaagaatgacagtttttcctcttagatcaggaaaaataaaatttctcttcatccacttttattcaacaatgtactgaagggtctagctaatgtagtaaggcaaaaaaaaattttttttaagaaaacgaataaaaggaatccagattggaaagaagtaaacttgattttattcaccgacaacatgattgaatttttgtagcaaaattgtatatttacaaaaatactagtggaagtaagtgtaataaggtttcaggatataagattagtattcaagaaacaactgtgtttctttatggctgcaatgaatgattaaaaagggaattttaaaactgccatttgcaatagtatcaaaaccaggaaataccgaggcagaaatctgatgaaacagtgtgcgctctgcactgataactactgctctgtttctaagtgtcccccagagttcatgtgttagaaactgaagccccagtaagagagtgttgagacatgggaccttcaagaggcgacgcgagtgctcacggatggactcatgtctttattgtggatgcgagttgcttataaaagccagtttggccctctcctgctctctttcttgcaatgtgatgccttcggctacgttatgacacaacaagaaggaccctcaccaggtgtggcttcttggtccttgacctggaggactttccagcctccaggagaactgtgagccaaatgaacttttatttttttgaggcagtctcacgctgtgactcaggctggggagtgcagtgacacaatctcggctcactgcagcctccacctcctgggttcaagcaattcttgtgccgctatactcggctgaagtttgcattttagatacagtgttttgccatgttggccagatgggtcttgaactcctggccttatgtgatctgcccacctcagtctcccaaagtgccaggattacaggcatgagctactgctcgcagccagcttctaatgtttatattaatcaattgcataggcagtggtattctgataaagcgtaccgaacggatgaagacaactgcaaacactgctgagagaaatttttaaagacctaaataaatgaaaagatttgctgttttcatggatcagaaaactcggtgttgttaagaaatcaagaaataaattctcagccaggtgcagtggctcatgtctgtaatcccagcactttggcaagccaaagcagatggatcgcttgaggccaggagtttgagaccagcctggccaacatggtgaaaccccatctctaccagaaattataaaaatcagcctggtatgatggtgcatgcctgtaatcccagctcctcaggaggctgaggtaggagaattgcttgaacccgggaggcagaggttgcagtgagctgagatcacgccactgcactccagcctgggcgacagaatgagactccctgttaaaaaagaaaaagaaagaaagaaagaaattctccttaaaattcatctgtatgtacattcattccaattctagtcagaattccaacaggctttctgtagaaattaataagcttattctaaaattaatagggaaatgcagaggacctcgattacccaaacagctttgacaaaagaaaaagaagacttatgtgacatagtttcaatgcgtattacaaaatggcaataaaataatcaaggcagtctgatagtggcataaaggcagacaaacagataattgcaacagagcagagccttcagagatagactcacacgtgtacagacaattgactttcaacagtggctccaaacaggaaccaaaatggcgctggccttctaaatggcaacactggaaatgctgagggttccaacttatatatatataaaattagtgaagaactatcactaaagggataaatcaagaggaaaacgtaagatccagaaaatagattccagcacatacagggcaggagtgaagggatgtcatggacggtaactgcaggaagcgtaggcatgagctactgcagattagagcaggaggagctgagagggagggggtagggggaaggaactgatgtgttggagttcacagagaacattattgataggtgtgtggcagaaatgttgcagaaataatttacaatcggaccatagaaaaactgcatagttttaaaatgtggcaattagtaactccactaaaaaaggattatgcttgcacaaaaaaggagaggtggttttgtcaactacttgtcttgacagtgtgtattatctgcggagtcacagtaatgcaaatctgacttcctgatgaatgtagctgagtggaaatggggtttgctgtgtttgctgtccacattgctcagcatctgagatgtagccctttgtgagagagctggtgcccgaagggggtgtctcttctgcctgtgctctgttactcaggcctgccgttggtcactccatgtgcctcctcagtgtttggttgtgtccagccctactctatggcaggacagtctgctttacttcatttactagtttcctatcagccagtttttaggggaaatcttttctagaataactttgattctagtgtgttttctagaataactttgatcctaatatgttttaggaaaaatataaacataatatgccgggcatgcggtggctcacatctgtaatctcagcactttgggaggccaaggcaggtggatcaggagtttgagaccagcctgatcaacatgatgaaaccctgtctctactaaaaatacaaaaattagccgggcatggtggtgggcacctgtaatcccagctacttgggagactgaggcaggaggatggcttgaacccgggaagcagaggttgcagtcagctgagattgcaccactgcactccagcctgggcaacaagagcgaaactccatttaaaaaaacaaaagacaaaaaataaaattataagtgcctttactagtcttgtttaaataggctgattctttctctttttttctaatgccccctaggaagtaaaaagaaagaaaaggaacggccagaaatttctcctccatctgattttgagcacaccatccatgttggctttgatgctgttactggagaattcactgtaagttaacctagttcgggcccatttataacgtttaaaatagcactcaaacattttccttcattattaaatttgaaattaacatttcaggccaggtgcggtggcacacgcctgtaatcccagcactttgggaggccaaggctggcagatcatttgaggtcaggagttcgagaccagtgtggccaacatggtgaaaccccatccctactaaaaatacaagaaaattagccaagcgtgggggtgtatgcctgtaattccaactactcaggaggctgaggcaggggaatcatttgaacctcggagatggaggttgcagtgaacagagactgtgccattgcactccagcctgggcaagaagagtgaaactccgtctcaaaaaaagggaaattaacatttctatctatacgttaactatgaattcttactgctttttgctttttataaaagtgttagtggttggatatatcgttttcctagagagcagagcctattaattatagttatgcaaaacagacttagaaaaaatagacctaggccgggcgcggtggctcacgcctgtgtaatcccagcactttgggaggccgaggcgggtggatcacgaggtcaggagattgaaactatcctggctaacatggtgaaaccccgtctctactaaaaatacaaaaaattagccaggcgtggtggcgggcacctgtagtcccagccactctggaggctgaggcaggagaatggcctgaacccgggaggtggagcttgcagtgagccgagatctcgcacgactgcactccagcctgggtgacagagtgagactctgtctcaaaaaaagaaaaaagaaaaaatagacctttagaaaatgagatcttttaaaatttactcaaacctacactcaaaagattggtttgttttgtgtattttgtcatttatctctggaaattaattttattgcatcaatttaaaccataactaatttctgaatatcttcttgttagggcatgccagaacagtgggctcgattactacagacctccaatatcaccaaactagagcaaaagaagaatcctcaggctgtgctggatgtcctaaagttctacgactccaacacagtgaagcagaaatatctgagctttactcctcctggtaagagagtggcataaggctggatcagatggagatttgtgaagcacttctagataaaaagattactcctggaaaaatgaaaagctaaactatggttcttgttgataacggtttttccctggatagattctaccttttgtagactgatccagggcagttctgaagcataatttggatctgtgaattatagtaatctcataggtttgccagaaacgggagttgatggatattttggctttttgtttatttggttttttctcctcattgctgtgtttttgttttcatttttcactcttcactgcttttaaatgacttccagcaatcaaaggaaaagacgctggttgatagacatgttcatactagaaacacatttattgttagcgggacaagaggaggttgaactaaaaaatgtttaggtccactcaaaaaattgaaactcgcaagtgtgcagataatagaatatatgtattttaatatataaaacagataaatcatatacgaaagaagcgttagaactaaaaggatttatacctcagaaatggaatatctggaatatcatctacatagtcacagtaatgcaaattttactttctggatgaatatagctggatggaaatggggtttgatgtactttgttttccaagttgctcagtatctgagatataccgttaacctatgagagaaccagtgaattggtatatagtgtaagagttggtgtagtggatttttaaaaatagtttttgttcaaataaagatcagaataaagttcatacaacgcagttggttgatacatctcttgaatctcttttgatctttaggcttcccctcccacacactggttcatgctgtcttttcttgacgtttatttattacagaaacaagatcatttgtcctgtttccctcagtttagattttgctcactacatcctcaggatgtcatttttcaatatgtttgtctgtctctgaagtcatacatgtggttttcaaaagcaatatgatggagctaaaatcgtacatgtggttttaattgattttacttactgtttgcatcctcacagaaacaaaggccatgtgcaagggagaaatagaaatctttttcaagtgatcttgacctttttttgttgagtctagtacaccgttaggaaaaggtcacacttgctcctagaacttttctatcaaccagtaagtctgtgtgtaaattagtaatttttttgaaaaaccaatgtttgaccacaaaatggtagcttattttcacctagtacacatacatacatatatgtgtgtgcgcacgcgcgtgcgtgtgtgtgttttgttttgtttttgagctggagtttactctgttgcccaggctggagtgcagtggcacaatctcggcttgccagaacccccgcctcccgggttcaagcaattctcctgcctcagcctcctgagtagctgagattacaagcatgcgccgccacacctggctaattttgtatttttagtagagactgggtttctccatgttggtcaggctggtcttgaactcccaacctcaggtgatctgcctgtctctcggcctcccaaagtgctaggattacaggcatgagccaccgcgcccggcctgtgcgtatgtaatatgtgatatgtgtgtgtgtgtgtgatatatatatatatatatacacatatatatatatatatacacacacacatatacacacacacacacatatatgtatgtctctgggcatttttaaaagaaaaacaaaacaatgtcagaattttactttgcacaattgtcattgtcttaattgttgcattaagttcctcagtcagcagttttctggagaaagtatctttatcaataaatttgttttgttttaataaatacagattgataggtatactttcaaactaaattttgatagctttattgaggtataatttacatgcaatacaattcacccattttaaatatataattcactgatttttactaaatttatagtttcatgtagatttcagatttcttaccttggtcttatataaattcttatttgactacttgcgtgttcatttttctcaagagttaattcaacttgaaatcagtttaagaacatttcactttctctgctttttttttttccttttatcatataaaagtgctgtttcttgaattgctaatgttatgttttgtttcatattcagagaaagatggctttccttctggaacaccagcagtaagttaattatattatttcttgtatctcttgttctaatttaggttacccaagacaaatctcagtttttattttgctttctaaaataaattacagccatcagaggtaaataactactcaataggtgtttttagctagccacctgattagttgaagaagccgtattaaatagaaattccttgatgtgatacttaatgtaactaaaatttataatgaccttcagaacagtttagttagttttggtaatgttaacatatacaaacgtgaacacaaagaacttgctagcatatattttcctctccatccctcagttttccttctggtactattttactgaatatagactgtggaaaggtgctgaacagttgaaccttgtcagtcttcagagtcatctgaaacttaagttatcgcataaacacagtcagtttttggaaacagtcgttttatttgcagtttctcaattgggaggaaacagtctcctggagttttatttttttatattttattttattttatttatttatttattttatttttattttttttgagttagagtctcgctctgtcgcccaggctggagtgcagtggcgcaatcttggctcactgcacgcaccgtcttctgggttcactccattctcctgcctcagcctcccgagtagctgggactacaggcgcctgccaccacgaccagctaattttttgtgtttttagtagagacggggttttaccgtgttagccaggatggtcttgatctcctgaccttgtgatccacccacctcggcctcccaaagtgctgggattacagacgtgagccaccatgcccggccccaaatctgactgttttaaatgtcaccagatgtctctgacataacaaagcccagaggatctttgattttggtcttaacaagtaacattgtttactttcaggacattgtatatgtatgcttagggtaactttattaaaatatttggtactcaccatatatatatatttcataaactttttcatgattcatagaatcgccttattatgttagattataattctattgagttatctaagagctaatgagatttagtggttttgaaatgagctatcaaagaagcaaactttttgaagtacgttcataaagggcgatagtcgcatttaagcctattggacttgttttccttactttgctcatcatcaatgcagctgaatgccaagggaacagaagcacccgcagtagtgacagaggaggaggatgatgatgaagagactgctcctcccgttattgccccgcgaccggatcatacgaaatcagtgagtctccatcggtgatctaggctgtgtgtgtgcacgtgtgttttaaaaaatagcagagtttgtatttgactttcagtgattgcttttaaaaagccctcaagtttaaaatcgtttagtatggggaaatttaaccaagaaatctgtacccaaagaccactcacctaaaactagttttctgaagattaaaatgtgatgtctttaaaagttaacgcactcacctcactgggcttttttctttgtatagtacaccttttccagagggttcgtctatttcccaagctttctctgtttatctcaatgtagatgacgactaaatctaaaacttagagctttcctcttacccagattatgcattttaatctcccattttacactactctcagcgccttgctgtcattcaaaaggcagttgagaatgaaattcctaaccaggtaagggagaattttaaaaatgatgaccttaaatggagccaggaagagaggaatgactgcggttaccattctgctcccttcagtactgcaggtagagtgtgcggaaggtgctgtgccgtggaatgggctgtgctcctggcacagcgggcaggcagagctcaggagacagcctctggatgccaagctgatggcagaggactccgttttctttagcctttcaatctggctgtttgaaatgggtggtaggcattataattgtgtaaaaactttcatgggaattaataatagttatttcaacatcaaggtttctgttcttttgcattttacttaccatttgtagtaaaaacatgatttttaaaccgtgctttttgatacattgttataccattttagacctggtcacacttaaatttcattcatggacctgctgttttactagacagcttttcaaatatattcatgctatgccaaagaaaaatgtttcacatttattcttcttagttacacatcttttatatctgaaaatagtgttctcattatttagaacaatggaaaagactacttagttcaggttaaaaatcaaagaactgaattagtttgccaggaagaatatctgaaaacattattcctcaaaccttggtaatgaactgtgtctccacagatttacacacggtctgtaattgaccctgttcctgcaccagttggtgattcacatgttgatggtgctgccaagtctttagacaaacagaaaaagaagactaagatgacagatgaagagattatggagaaattaagtatgttatctacattttacatcattgttaaattgttcacggctcttaaaacatttggcccagatggattttaacttacactttacattgtgacttaaagtataaagaataaattgtttccttatagcaacagtagcttcaattacaatctggtgatgtcaccaggttcacccctaaatcccagcactaggtcaggagatcaagaccagcctggccaacatggtgaaaccccgtctctactaaaaatacaaaaattagctggatgtgctggcatgtgcctgtaatcccagctacttggaggctgaggcaagagaatcacttgaacccaggaggtggaggttgcagtgagccaagattgcgtcgttgggctgggcgcggtggctcacgcctgtaatcccagcactttgggaggccgaggtgggcggatcacaaggtcaggagatcgagaccatcctggccagtatggtgaaacccctcctctactaaaaatacaaaaatcagctgggcatggtggcatgtgcctgtagtaccagctgcttgggaggctgaggcaagagaatcacttgaacccgggaggcggaggttatagtgagccgagatcgcgccactgcactccagcctggcaacagtgagactccatctcaaaaaaaaaaaaaaaaaagcgaaccggccgggcactgtggctcatgcctataatcccagcactttgggagaccaaggtgggtggatcacttgaggtcaggagcaagactagcctggccaatgtggcaaaaccccatctctactaaaaacaaaaattagcaaggtgtcatggcaggtgcctgtaatcccagctacttggggagctaaggcaggagaatcacttgaacctgggaggcggagattgcagtgagccgagatcgtgccactgcactccagcctgggcgaaagagcgagactcagtctcaaaaaataataataaataaaattaacaattaaagaatgctaatctagagggttcaaggaaaaatactgtatggaaggattgttttaaacataaagcctgggcatagtggctcaaacctataatctcggtacgttggctggccaagataggaggatagctggagtccaggagttcaaggccgaactatacaacttagaccccgactccaccccctcaaaaaaaaaagaaaaaaagaaaattaacgagacctggtggtgcatgtctgtagtcccagctgactgggagcctgaggcaggaggattgcttgagcccgtgagttcaaggctgtagtgagctgtgattgcgccactgcactccagcctgggtgacagagtgagaccctgtctctaaaaaataaacaaatgtttatatgccccatgtttatttggttttgatttctcagtgctttcaagtataaacctggctcttactctgttattattattatctttttttttttttttttttgagacagagtctcgctctgtcacccaggctggagtgcagtggcgtggctcactgcaatctctgcctctccagttcaagcgtttcttctgcctcagcctcccgagtagctggggctacaggtgtgcgccaccacaccccgctaatttttgtagttttagtagagatggggtttcaccatgttggctgggctggtctcaaactcctgacctcaggcatgagtcaccacacctggcctgctctgttactctatgagcatataagaattattttaggagagctgctacttaaaaaaaaaaaaaaaattaactagaatcctaattgtcatcatttagttgtgacctttagctgtcacatccccagtctttttggtatctttttgttcttagcctcttattattgatcctgtttctttgcttgttgacttgaggttgggtacctacataaaactatttatgtcagtttccttgatatggtcctgtccttttttaccttgagcaagtgaaagtttaatgtggtttttcttactagtaataagaatataagttaggattttatgtccaacttcctaattttaaaacctctttcttgtgactttgaactttcctaaaacaaacatatgattagtttatgtcagagcatagtaatttttatggtaataagtggttttctaaatatattgaaagatgaaatgtatactggaagagtcagaaagaccatttagggtttagatagcctttattatttataatactaagtagtctcaaacttacctattaatagatatattcaaatatatctatttctatattcaaatatatctattttatattcaaatatgtctattttcttgagattacctgattctaaagctgaacatctgagaacctaattaatctctgacaaactggtacagtcttttcaaaatgtgaccattattgagcaaatgattagttaggaggtctaacctaatggaaataatgtgtcttcttgtttctgttacttttaaacttttaatgtgtcttgtttctgatacttttaaacttttattatgtatttaagtttctttagtgttttgtgtttgaaacctgttatttttggaacttagtattatgtttgaaaatcacttataaaaacagtggagttcattaaaaggaataataatatcacaatcaatttacacttaaaatgcttgactgagcttccagctttttgtttattctaggaactatcgtgagcataggtgaccctaagaaaaaatatacaagatatgaaaaaattggacaagggtaagtatttgtgactgtattacgataatattcagtattcagtatttcctggctttatagcatgatgtttattttgcctgccgacatcaagtacttatatagtattctgtgagtggtacccttgggggatttgtgtaaataaataatgcagttatttgtagatgctgttaaaaaactgtactagttgttagcaatgactgtgtatcattattttttcttaagtgtcatttcccatctgtgataattagagggaagaattgcccataaaatatatttaaaagacaataagaatatttactgcatgactataagcaataaaaaatgcatttaaatcatgtcattgtgtattgacttttgagtctactgatcttctgattttgttgtgtaatttgtatttttaaagtatactaactaaactccttttttctgttgcttggaagcaaataaacacctaaatttttaatgttattaaactctggaaagcattctgtgaatttagagtgagggcttaagccatttttgaaaacttccatatgaattccttcctcccttccttcccttccctccctcccttcccttcccttccttccctccctcccctccctcccttccttcccttccctcccttccctcccttccctccctcccttccttcccttcctttccttccttcccttccctcccttccctcccttccttccctcccttcccttccttctcttccttccttccctttttttttttttttttttttggcggagtctgtcactcaggctggagtgcagtgacataatctcagctcactgcaacctctgcctcccgggttcaaacgattcttctgcctcagcctcccaaagtgttgggattacaggtgtgagccactgcaccaggcctgaatttcttcctaacagctaaattcaattgcagcactggttttatgaaagagaattgaagattatcttactatttttgagcatgaatgaacaagcaatacctatccatatggatgaccatcacaaatccagtgttgagtcacaaaagcaagttgcagaataatatgtgaaatgaaactatatgacgtttaaaaattagacaaagtatattttatagggatacatatctgcgtcctttgtagttaaaagtatggagaaatgcatgaaaatgatgaacaccaaatacaggataaacaccaaatacagatcacctttgggaggaaggagactgctgtcggaaagggcttatgggaatcttcaaattatttacagttatttgtatcttaatcagggaagtgtatccttaagtatatgttatataatttttttcctgctcttttttccctacatttttgtaggtctgaaatatttcacacataagttttgccgtaaggattgtctctttcttcccccaccccctttcctcaggtttttgcttttactccttttaagcacgttaggtcatcctgttctttaattctttttcaattgcttgaagtgtaaagtctttggatattgcaaatgctagtgatttatcaaccttaaatctggttgtgtgttttctccctctagggcttctggtacagttttcactgctactgacgttgcactgggacaggaggtagttactttgttgtaatcctgggtgttaccattattttgtcatataggtggaaactagatgaagctgggaagaagcaataggaacctcttttaagttgagcccgttgtaagaatcgctctacgtatgtttatagcacttctgtcagtaaggcggggaaggacttatgagttcaatgtcataaataagcaaatacttaaaaattgtttcctcagcttgaagtgaaaagaggattaattcttagtattggactgactgtgggtgtattaatcaacttcaagataaatctaaaactaggttctaaacattacaaagcattgtgcacaggcagtgtgcaaggcaaggtgccacctgggagtaatagcatggtgtaatacagtacacgtaccgtgagttatcaactgcttggggtttgtaattttctaagagaattcctaaacctggtttttttcaatcctgttttcattataggttgctatcaaacaaattaatttacagaaacagccaaagaaggaactgatcattaacgagattctggtgatgaaagaattgaaaaatcccaacatcgttaactttttggacaggtaagtatgactattccttaaacaccgggagaaaatgtagaaattttaagtctcatggtttcgggggtggggctggccactttggaataaactgtcagtgccgagaaataagatggaagaaagaagaggagaggtaaaaatagcacagtgcagttttagaaggtccttctctgcaaggacatcacttggcaggtgagagaaggcagttaattgaaggccatagctggtggtgtttatactcatcgcaaacgacctgaagcgaacacatgaatggttggctgtgattcgtgtcttgactgacagaggggactggttacatggtttttaaacttgtggatcaatttttatttcaaatgctatccttcatggacaaatttatatgtctatcaaaacctcatttagttgaggaattaatgttaaataacagaccaaaaagcagaatagaaaatgatgcatattggctgggtgcagtggctcacacctgtaatcccagctactcaggaggctgaggcaggagaattgcttgaacccaggaggtggaggttgcagtgagccgagatcgcaccactgcactccagcctgggcaatggaatgagactccatctcaaaaaaaaaaaaaaagaaaagaaaatgatgtatattactacaactgcatgagagaagattcgttgaaaatgataacagtggttttattgaagatagaggtgattataggtgattttcttccatatttaaatttgtttagaatgaggaaaaaataatgtttagagactttatccctagttatggagaacatgttcatagaaataaacttttcaggctaggcacggtagctcacgcctgtaatcccagcactttgggaggccgaggcaggtggatcaccaggtcatgagatcgagaccatcctggccaacgtggtgaaaccctgtctctactaaaaatacaaaaattagctgggcatggtgccgcacacctgtagtcccagctcctcaggaggctgaggcaggagaattgcttgaacccaagaggtggaggctgcagtgagccgagatcgcgccactgcactccagcctggcaacagagcaagactctgtctcaaaaaaataaataaaaaataaacttttcaggtacagttccctgctttttaaaataacatttcaagtcagcatagtgtggtggttaagataagccaggggcttcggaatcgttgatccttggcttcatattctggttctgtcacttcctattaatagctgtgtgcccttggatgagtcacttcacctctccaagcctttgtctgtttatctctaaaacaggactagtaatttctatattgtagggttattttaatcagaatgagctatgtgcatactcaaactacagttgtgggcaaactgtaactttaaaatgattcaggatcataacttcagttatttttctgtgctgttacgtagcagctttccagttttcttcctaactctcaagctaccagctctagttttattgttagggtgtttaatatttgaattcttcaacatagaataccatgtgtttaggaaaaataaaagtgtgactgtatttggtatgttgtatttttagttacctggtaggagatgaattgtttgtggtcatggaataccttgctggggggtcactcactgatgtggtaacagaaacgtgcatggatgaagcacagattgctgctgtatgcagagaggtaggtttgcctccttcttgatatgttatggtgatatgtggttagcaagaagtgaacaaaaggaaatttttctgcacaggtaattgttattgtgggaggtgctttctctgtatacattctctgcaaattactccatctccgtgccatttcatcctacacaggagtttcagccctttccttcaggtataagataatttgggaatgaattgtggacctttgaagatccagattcacaaggaaattctggtagagtgatgatgatcatttaccatccaaacaggacacttttgagagtaaaagggtatatatcattagaaatacaccactcaggctgggcgcggtggctcacgcctgtaatcccagcactttgggaggccgaggcgggtggatcacaaggtcaggagatcgagaccatcctggctaacacggtgaaaccctgtctctactaaaaatacaaaaaaattagccgggcgtgttggcaggtacctgtagtcccagctactcaggaggctgaagcaggagaatggcgtgaacctgggaggtggagcttgcagtgagccgagatcacaccactgcactccagcctgggcaacagagcgagagtccgtctcaaaaaaaaagaaaaagaaatacaccacttagctggaagtggtggctcatgcctgtaatcctagcactttgggaggccaaggcaggcagattccctgaggtcaggagttttgagaccagcctgggaaacatggcaaaaccccatctctactaaaaatacaaaaattagccaggcatggtggtgcacgcctgtaatcccagctactcgcgaggctgaggcgggagaatcgcttgagctgaggaggcagacattgcagtgagccaaaattgcgccaccgcactccatcctgggcaacagagcaagattgtctcaaaaaaaaaaaaaaagaggctgggtacagtgtctctcgcctgtaataccagcactttgggaggccgaggcgggcagatcatgaggtcaagagattgagaccatcctgaccaacacggtgaaaccccgtctctactaaaaatacaaaaattagctgggtgtggtggtacgcgcctgtagtctcagctactcgggaggctgagacgggagattagcttgaacccaagaggcggaggtcacagtgagccgagatcgtgccactgcattccagcctggcgacagagcaagactccgtctcaaaaaaaaaaaagagaaagaaatacgccactcaaccgtggaaactagaactatctcaggtcaagcaggacacttatttgccttcagtatcaataagtctgtgcctggcttcattgagttcactaatggtgaagaaaccggttatttctttatattcattaatgaatttctagacatattattagcttaaaccagtagaattctgccaaattgccaatttaagccaaaaataagccttcttttttccacctatatctgagctttttctacagataagatttgggctaatggtttgcttattgtcattgaaacttctaatgtcataggaatcactgtcacaaagggcaaaactttaagtttataagactatattgtgttttctatgatttggctttcagcagttcttcagtgacatgtgaattacaaactttgttcatgtaaggatgatacatatatatttcccttttccatctgtcattaaggtgttaaaaatattaaaattttaattctgatttgtgttctacctgaggaatagtacctctttggtagaagggaggaaataagaactcttgaatagaatattaatagaatatgatagtccttaacaatgcatgcttggtcactgaaaagctgataaaaacaagaatttacctatttatacttaattttgttttttctaatacatttctttgtaattgatataaaaattaattttggaagttcctctaatttgggttttcttttgtgtgccagaacttttaaactgtgacgagtttgtttctatttatttgtacaagtattttctggagctttgaatctgatgattgcctggtaaatgtattgcggtaacacccaatttatctgtttttccttgaatgaatagtagaagattttggatgagatttttagttgtacagactttgttctcctctgatgggagtaagaaataaaagcacagctaacttacacccgtagttcaaaaacacaagagtgagcagatttttaaaacgtcatctcgttctcgtttgtaaggaaaggagtagtttacccccactttgtgactcagtgctctctgaaatatggcataagaggaaagttattcttgcatcattcatgtccaagttgtagatacagcttaatataaaatcgggcactgaagaacatcttctttctgatgaacagctaagtggaaccaggccacccagaatcttacccgcttctcagtggctcacattgattagccttctgagtatctcatgttcaaatgggaatgatcaaggttttttcattactgttgaaaagatttctgaggagcctgtgcatgtttaccaagtgttgtatacctttaggcatttaaacctgaaagaggcaattttttttttttttttttttttttttgagactgagtcttgctctgtcgcccaggctggagtgcagtggcacaatctcagcttactgcaatctctgcctcctggattcaagggattctcctgcctcagccacccaagtagctgggattacaggcctgaggcaccacacctggctaatttttctttctttctgtccgtctttttttgttttttcgagatggagtcttgctctgtcacccaggctggagtgcagtggtgcgatcttggctcagtgcaagttccgcctcccaggttcaagcgattctgctatctcagcctcctgagcagctggggttacaggtgcacaccaccacacccagctgttttctttgtatttttagcagacacagggtttcaccatgttggccaggctggtctcgaactgctgacctcaggtgatccacccgcctcggtctcccaaagtgctgggattacagaagtgagccaccatgcctggcctcccctggctaatttttgtattttttagtagagatggggttttgccatgttggccaggctggtcttgaattcctgccctcaagtgatctgcctgtctcacccggccaggaggcaagacattatacagacccagctaaacaatgtctctgagtaagatcagagggtaggagcggatctactgactttttaaaaaattttattttcttatataaaactttaaggaggagatctaattacttttcataactttgtatataagagaggatgttttttctttataaataaaagtattggagggtcttctgctgggcactggaagcaatgctcaggccatagctactgcatgtgcctccctgtgtcttttcagggactatttcattaataggtgtttttcttctgttcagtgtttacaggcattggagtttttacatgctaatcaagtgatccacagagacatcaaaagtgacaatgtacttttgggaatggaaggatctgttaagctcagtgagtaacaaatggacaattcacaatcatttattataattttctgccttttgtttaattaaaaacttttcttgaccaatgcaaggattaataatgatttaatataggaagaggtgagacctttgaaaactgagtgatcctctgagggttttaactaatcagtgccagagaaaggactcgctggataagacattacctaataattaccactagataagacattattaggtaatgtcttgtcttgtctttttgagatggaggtttgctcttgttgcccaggctggagtgcaacctccgcctcctgggttcaagcgattctcctgcctcagcctcctgagtagctgggattacaggtgtgcaccaccacacccagctaatttttgtgtttttagtaaagacggggtttctccacattggtcaggctggtctctagctactgaactcaggtatcttcccgcctcagcctcccaaagtgctgggattacaggcgtgagccaccgcggctggccatgattgcttatttttaagtaatcttaatggggaagctctcatacatttttggtgaatacacatgaaaatgaattaaacttttggatgacattttttttttctggctctgccatttactaagtgaataaccttggataagttgtctttatgcctcagtattcctatttgtaaaatgggaataattgtaataataaatgtacctttctcatagggttaccatgcggattaaatattttaattcttataaggtacttaaacagtatctggattgttttaagtactcattttagctataaatattgtttgacctaactgttactcttgtagaattctctcctgtagaatttctgaacttacataccgcagtaagtacaaggatgttctctgcaatattgtaaagaaaaaccaaaactatcttaagtgttgagcagtaagggaataattacatggattattatatttttatattctgtatagtttttaagatgagggaggccgggtgcagtggctcacgcctgtaatcccagcactttgggaggtcgaggcaggtggattgcttgagcccaggagtttgagaccagactgagcaacatggcaagactccatctctactaaaaatacaacaattagccgggcgtggtggcaggcgcctctagtcccagctactcaggaggctgaggcaggaggatggcttgagcacaggaggcagaggttgccgtgagccgaaattgctctactgcacacagcgtgggcaacagagtgaaaccctgtgacaaaaaattttaaaataaaaaattttttaaataggcagatgtactaatatggaaagatctcaagaaatggttttaccaaagtttacagagtatcctgattggtaatacaaaccaaaccgttcatagatattattcatgcatatgtacatgcataaccaacagtctaaagcttacaaacctaaattttaacagtagtcacatatgaaatggaatgggtttaacagtataagaaagaattctaaatactaatcctgacttttccactaaatgaacattgagtactacactaggcatcctgcacctccattacaggtgagattgagaagataatgctggtggcgaccttaggctctctgctgagatgatggatgtttagtgattctggcttctgtttgttttattcaaaaatagtttacagctgggtgtgatggcgcacacttgtaatcccaacactttgggaggccaaggtgggaagatccctcccatgttgcccaggagttcaagaccagcctaggcaacacagggggactctgtctctacaaaaaattttaaaaattaaacaaaattaaaagacaaagtagtttccatgacctgacctttacctgattcactgcatttagttttggtgtctacttttgctttactttttcgtagacctctttcagttttattaaattttttaggatagaatgaattattcagaataaaaggcctcctgataatttggactctgtggcaagtaaaagtaaaatgtgagagtgtgttacatcatgaaaatatttttaaactcattctggtttactttattaatgaaatctttaaaaacaagaggcctaatagtcaaaatataattaattacataatctgaagtgaactcttctgctaaaaccatccatggaagccattaactctgttttgttttgttttgtagctgactttggtttctgtgcccagatcacccctgagcagagcaaacgcagtaccatggtcggaacgccatactggatggcaccagaggtggttacacggaaagcttatggccctaaagtcgacatatggtctctgggtatcatggctattgagatggtagaaggagagcctccatacctcaatgaaaatcccttgagggtaagatgagttaaacaccagccttgttcaatgtttttctttgaaactcttatttagaacttgcacgtgcctggcactgtccaagaatttaaagtagaaggttgataaaacctaatctctgcccctaactctgcatctagaaatcatttgctctctgagttacaaattaatgtgttaggtgaagactttgtaggtttttagtagtaagctgtattgttttgtattttacgtaggaagtttggagcacctgtctctaaagcttctccttcttttattttttaagatgttttgagacagggtcccactctcttgcctattctagaatgcagtggcgcaatctcagctcactgcaaccgccacctcccaggttcaagcgatcctcctacttcagcctcctgagtagctgggactatgggtgcgtgccaccacacccagctgatttttgtacttttcatagagacggggtctctccatgttgggtcaggctggtctcaaattcttgacctcagttgatccactcgcctcggcttcccaaagtgctggcattacaggtgtgaacaactgcacctggccacttctcttttttttaaattaccatatgtggctcaacattatcagttattaaggaaatgtaaatcaaaacctcaacaatcagaggctgaggcaagagaattgcttgaacccaggaggtggcagttgcggtgagccaagatagcactactgcactccagcctgggcgacagggtgagactctgtctcagcaaaaaacaacaaaaaaccccaccacaacaggataacacttcacaactactagaatggctgtactcaaaaagacaattaataaatattggtgaccgggtgcggtggcttacacctgtagtcccagcactttgggaggctggggttggaagttcaagatcagcctgaccaacatggagaaaccccatctttactgaaaatacaagattagctgagcatggtggtgggtgcctgtaatcccagctacgtgggaggctgaggcaggaggatcacttgaacccaggaggcggaggttgcagtgagccgagatcatgccatcgcactccagcctggtcgacaaagcgaaactccgtctccataaataaataaataaatgttggtgagaagataaggaaactagaaatctcgttcattgcaaaatataaaatggtacatctgctttggaaaacaacttgacaattctgtgtgaagttaatacggaattaccagatgacctagcggttcctctgctgggtacagagccaagagaattaaaatcatacatccatacagaaaccttcatgcagccacagaagtggaaataattcaaacctggtgaacagtggaatattatttggtcatagaaaggaaggaagtgccaatccgtgttacagcattgaaccttgagagtactgtgctaagtgaaagaagccgaacaacagatggcagcagattctgaccgtctgtttcctgaatgcttttcatccagttgccaaagattccagtttatgtgggccgttaaagtacttctatagaggtgattagtttagaccacttttcagaatgacattaaagccctctaatgttattcattcatttagccagtattggtttgggtacctgccatgcgctgagcactattcacaatgctgtctaaaagaacccacaaaaattcctgctcttacagaacttgtcttctagtgggaaaagagaaaaacaaaataaatcagaataatgtgtcatacattgaataatggactcttgagtactgagactggcaggaaggaggttagggtgtttactttcaaaaggtgcttagagagctgggcacagtggctcacgcctgtcatcccagcattttgggaggccaaggtgggaggattgcttgagcctaggagttcaaggccagcctaggcaacatagtgagtccccatctctacaaaaaaatttaaaaattagccaagcatgttagtgtgtgcctgtagtcacagctaattggaaccatcatcctgccccagtgcgtgggtcacttgggcccaaggaagatgaggctgcagtgagctgttatcacatcactgcactccagcttgggtgacggctaggacctgtctcaaaaaaaatacaataaaaataaaatgtaaaattaaatcaaaagcgtgcatagggagggcttccctgaggtgacatttggacacaggaagtaagagcgtgatacttacctgagggaaaagcattctaagcagaaggcacagcaagtgcaaaagctctaaagcaggagcgttccttgtgtattgagagatgattctggacctcagcacagctggcgtacgctgagcaaacagcgagaggtgcggtcgatcggcgaagaaaccaggccagaccgtagtgccttatgagagctctggaaggattctggcttttactggaggccaaatggggaaactgttagagagatctgagcagagaagcaaagtggtctccttcagttttaataggatttccctggctgcgttgttgagagatccctgaggaaggcaaaggcagagcagaagaccagtcaagaggctgatgtcataattcaggcaagcagtgatgatggcctagaccagggcagtatcagtggaggtgggaaaaagtggtgtgagtctggatgtattttgaaagaagagtctacatgagagagaaaagactaacgggatctgttcccaagtaactcaactgcattcctgtacaaagctgaagagtcttacagggctgcgtctatagccaggagtacgctcaggcttcagaagaggctcgcctccagtggccttcactgtggcaaaaaggtctacttgaacctcagtgagatcggtaaaatcaccagcgccaagctcctatcagcagatccagaagctgatcaaagatgggctgatcatctgcaagcctgtgactatccattcccaggctggatccccgcaaacaaacaaacaaacaaacaaacaaaaaaaacaccttgggccgggcacggtggctcatgcttgtaatctcagcactttgggaggccgaggtgggcagatcacttgaggtcaggagttcatgaccagcctaacatgatgaaacctcgtctctactaaaaatacaaaaatgagccaggcatggtggcgtgcacctgtattcccagctactcgagaggctgaggtgggagaattgcttgaaactgggcgacagggagagattctgtcgcaaaaaaaaaaaaaaagaaaaaaacaccttggcccacaggcatatgggcataactgctaatgcacacattaccaaaaaggcagcctggatgaggaagatgagaattccaccccagctgctcagaagacactatgaatctaccgagattgaccttcacgtgtatcagagcctgtacatgaagtgaagggggacgtgttcagaaacaagcaggttcttcggaactcattccaagctgaagatagacaaggcctcaagaagcttctcattgaccaggccagggcacatggctctaagaccaggaaagcactgtagttccacggagagtgcctctgggccaagagaaaatcattaagactgtcccaggaggaagaaactaagaaataaaggtctccctctctcgtctgtacatagtggatcttggtgattacatagatccagtcattcaaatacaacaagattttatctgcctgatggggggaaaaagcatattggtaggaatacagaaatagccaggacccagcaatcacccagacatcagtcaaagtttaccagacaggcaaaggagcaggcagatgcagcccataatgagaaaaacttccaggcaactggaacggacagaagttcattaaaacaatctcacgactgcatttcagttgtaagaactttaaatgcatattgcttagtgaaagaatccagtctaaaaaggctacatattatttcaactgtagagagtaaaaatgattagtggttatggggtttggcaggggatcgggggtagagaggatgagtaggtgaagcacagggaatttttttgggcagtgaaattactttgtatgatattataatggcggacactggagagcattcatttgtcaaagcccatggaacaactaggcacggtggtgcacacctgtagtccctgctgcttgaaaggctgaagcaggaggatctcttgaccccaggagttcaaggccagcctgggcaacatatcgagaatgcattaaaaaaaaaaacaagaccataggactgtgtaatgtaatacagagtgaaccctaatgtaaactgagggctttaatttaatagaagtgtatcaatattggttcatttgtaacaaatgtcccatagtataataatgtagacaataataaaactccacattggggaggttgcgtgtgggaactctgtactatctgttcaattttctgtaaacctaaaacttctaaaaaattagtcagttaaaaataataatttaggaccagacgcagcggctcatgcctgtaataccagcactttgggaggccaaggtgggcagatcgcttgaggttaggagtttgagaccagcctggccaatgtggtgaaaccccacctctactaaaaatacaaaaattagtcaggcgtaatggtgcatgcctgtactcccagctactcgggaggctgagctgcaagaattgctggaacccgggaggcagaggttgccatgtgttgagatcatgccactgcattccagcctgggcaacagagcgagactgtgtctgaaaagaaaaataaataggccagatgcagtggctcacacctgtaatcccagcactttgggaggccaaggcgggcagatcacaaagttgggagtttaagaccagcctggccaacacagtgaaaccccgtctctactgaaaatacaaaaaattagccgggcattttggcgggcgcctataatcccagctactcggaaggctgaggcaggagaatcgcttgaactcaggaggtgaaggttgcatcgagctgagatcgtgccattgcattccagcctgggccacagagccagactccgtctcaaaaataaataataaataaataaataaataaaattcaatttatagaaatgtaaaggaaataattagaactatgtaaggattttctaaagggagttgattaaattaggaaacattcatataaggcaatatttacttaagccattacagtaattttatagatctaggtagttattagtaatgatgacctgggataatttgtttttttggtttttatttttgagacagagtcttgctgtcttgtccaggctggagttacagtggtgcaatcttggctcactgcaacctccacctcccatattcaagcagttctcctgcctcagcctcccgagtagctggaactacaggcatgtgccaccacacccagctaattgttttttttttgtatttttagtagcgatggggttttgccatgttgcccagcctggtctcgagctcctgagcccaggcaatccacttgtctcagcatcccagagtgctaggattacaggcatcagccaccatgcccagcctaatttgtttttgtttgtttgtttgtttgtttatttttgggacggagtctcgctctgtcgcccaggctggagtgcagtggcgcaatctcggctcactgcaagctctgcctcccgggttcacgtcattgtcctgcctcagcctcccgagtagctgggactacaggcgcccaccaccacgcccggctaattttttgtattttttagtagagacagggtttcaccatgttagtcaggatgctctcaatctcctgacctcgtgaccggcccgccttagcctcccaaagtactgggattacaggcgtgagccaccatgcccggccttggtttttttttgttttgttttttgttttttaagttttaacaaatctcattttttttaatgatatgtatgacttgaaaaaaatttgagaaacctaaacaggatggtcaatggtgaggttgtggttatttttaattattaacattgttttattttttaaagcaatatgggctgggcacagtggctcacacctgcaatccagcactttgggaggccgaggcaggtggatcatttgaggtcaggagttcaagaccagcctgaccaatatgatgaaaccccacctctactaaaaatacaaagattagcaggtcatggtggtatgcatctgtaatcccagctactcgggaggctgaggcaggaaagtcacttgaacccaggaggcagaggttgcagtgagccaagattgcaccactgcactccagcctgggtgacagagcaagattccgtctcaacaaaaaaaaacaaaacaaaagcaatatgtattgcatttataaccgaagaaaaaccaaaggtgaatctgatttcagaaaagtaacttaaggaaatgtaacatctaaaaataagaggaaagtatcaaatctaaatttaaatgggataatgataaccccagtttagtatttatggtgattttctttaaagaagaaagaatcccttagactttatggagtgctctgtgaccgtgttgagctatcttaagtggatcaaagatgttcttctatttttaggccttgtacctaatagcaactaatggaaccccagaacttcagaatccagagaaactttccccaatatttcgggatttcttaaatcgatgtttggaaatggatgtggaaaaaaggggttcagccaaagaattattacaggtaaatttaaaaatgatttcatttgggggaatagttgacttttttggtaaccgacagaaagctttcctagggctaataagtagatttcactactcattgatcaccagcggtatggcagctgctgcaatttagggtttcatcctaccatgctgagcaaactaccgcaaggacagaaaaccaaacactgcatgttcccactcataggtgggaattgaacaatgagaacacctggacacaggaaggggaacatcacacaccggggcctgttgtggggtggggggagtggggagggatagcattaggagatatacctaatgtaaatgatgagttaacaggtgcagcacagcaacatggcacatgtgtacatatgtaacaaacctgcacgttgtgcgcatgtaccctagaacttaaagtattaaaaaaaaaagtgagggtttcatctgctgtgaataaaattctgacaaaaccgtaatgtgcagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcaatcctcagacctgtttacagtttgtgcatcgtatcactcctcagacctgtttattgctgttgtgtgtatatttgtcaaactaaaatgattctgctttcattcaactctgaaagtaatgcgttgattatgttagtcttatgaaggtattaatatgtgtttagtttattaaattatgatcgacaagtagtctttggggcttaattgaacaaaattattttgtttctaacctgatgaatggcacttatacatttatttttccccttctttctggcagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaaccttttaa

SEQ ID NO: 2137 - DNA, 23633 bp, Homo sapiens
aggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggtaaggggggcggggcttggggggccagagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatgtaggactccgtggcaaactgctagttgttcgtgcaagtagtagttggcaaactgcttgtactactgagacgggcaagtgcgggaataattacaataaagggtaaggtttgatgggaggaaagcacaaaccctacaagtttctccatctgtaaaatgaggatgtttctgtcatccttggtatcatttagatccgtttagtatctgtcaatcagtgcagttctgcttgtgtgtttacatattgggttttcaagtttatctaaacaaaggattatgaggccaagaagattttttttttgagatggagtctcactctgttgccaggctggagtgcaatggcgcgatctcggctcactgcaacctccgcctttcccaagttcaagcaattcttctgcttcagcctcccaagtagctgggattattacaggtgcccgccaccatgcccagctaattttttgtatttttagtagagacggggtttcgccgtattggtcaagctggtcttgaactcctgacctcaggtggtccaccctcctcagcctcccaaagtgccaggattacaggtgtgaactaccatgctcggccagaagaatttttaaacagttggatttggtaatctgtagaggcttccaacgttagcattttataattgaaaaggggtcaaaattagcggggcgtgatggcgtgcccctgtagtcccagctactcagggggctaaggcaggagaatcgcttgaactagggaggcggaggttgcagtgagccgagatcgcgccattgcactccagcctgggtgacagagggagactctgtctcaaaaaaaaaaaaaaaaaggaaaaagaagtcaatttccagagccagttcaccactaccaaagtaatagttaagaggaaaaatgttgaaggtaaattcacattcaacaaattcgttttaaaaatggtacttttgcctttaaaatcatgacattctagtatttgctgtactatttgtaaattagcctttctccggtcccaatgatcaactgctgtctggtgtacataccagtagaatttaagcctgttcataatttttcttctaatttaatttatagttggatagcagtcctcacttcccaccctacccccattaaaattaaacaggatgaagaaagatctggatttgtgctgggcacagtggctcacacctgaaattctaacacattgggaggctgaggtggaaggattgcttgaggccaagagttcaagaccagcctggaaaacatagcaagaccctgtctctgcaaaaaaatttaaaagtagccaggtgtggtggcgtgggcctataatcctagctacttgggaggccgatgtgggaggattgcttgagctcagaagttcaaggctgcagtgagctgtgatcatgccactgcattccagcttgtgtgacagagtaaggccctgtctctttttttttttttttttttgagacggagtcttgctctcttgccaggctagtgcagtggcgcaatctcggcttattgcaaccttcacctcccaggttcaagcgattctcctgcctcagcctcccaagtagcgggaactacaggtgcacaccacgacgcccggctaattttttgtattttagtaaagacggggtttcaccatgttggccaggttggtcttaaactgttgaccttgtgatctgcctgcctccccctcccaaagtgctgggattacaggcatgagtcactgcacccaggctatttgttcttttttttaagaggcagagccttgctcggctgggcgctgtggcccatgcctgtaatcccagcattttggaaggccagggtgggcagatcaccaggtcaggagatcgagaccagcctggccaacgtggtgaaactccatctctactaaaaatacaagaattagccgggcgtagtggcgcgtgcctgtagtcccagctactctggaggctgaggcaggagaattgcttgaacctgggaggcagaggttgcagtgagccaagatcgtgcaactgcagtgcagcctggcaacagagtgagactccgtctcaaaaaataaataaataaataaataaaaataaaaaaagaacaaataaaaatctggattggtacaagatacatatggaatttggggatttgtttattcaggaaaagatcatatgcttctccaaagcaaatacaatttcttttttgagggctggagatttttcagtgaaatgtaactagacaaattctcgaagagctgtaacactaaaatttcattcaattttagtgttgaaagtggaagtatcttaggctttaaaaatcaggcaaacctttcttctaatcggtcacgtagttagttgtatgacccagggccatttactaatgctttagaagttcaagtttcctcctgcaaacaaatggcagtgattttgcttattttgctatagatcgtgaaagttaaaacacatatgaaagcaccaagtagaggatctagcatgttagatattatttaaccagttatttttttctattcttttttcattccttcaaatagtttcaccttcacatcatttttcttaatgcatcttttcagaaatacatctaatggattcagcaatattcaatgataataacaggattatgtaaataatatatagttttctgtatgtgtttggggtttgtttgtttgttttgagacaaggtctggctttgtcacccaggctggagtgcagtggtgcagtctctgctcactgcagcctccctctgcctcctggcctcaagccatgctcccacctcagcctcctaagtagctaatttttgtatttttcttaatggagatggagtcttgctatgttgtccaggcttgtgtgtgttttttaaatgttcttcccacagatttacagcttttgaaatgggacaaagttccatagcaaatgcctggcagagttgctggtcaatagtaactgaattttcagttttaagatgcttacattgagtaatagttttctttttttgtgtttagagacaaggtctctctctgtcacccaggcttgagtgcagtggtataatcatagctcactgaagcccccatcccctgggttcaagcaatcctcccacctcaagtgcgagctggcacacctggctcagagtaacagcttgagtgtctggaatctggatgaagtcagtatactgagatttgtgcttattctaagtttacagtggaacccgttgaacctttacgtgcctccagctttgctttttgttttttttttaaaccttccagcatctccacaaggcataaatgtaccattttcctggttttgtaggcatggatgttagaatatagaagttgccagtatgtatctatctgatacacagtttcagtgaacaaggattaaaatggagatttcctggctctttagccatcctgttcctttttggtatcttgggatcacctgaataaagtaatattaataaaaaacacttacatagaacacttaatatgtattcttactactgttctaagtgcttctacttacattaaattcttacgacagctagtagagagataaactatcttgcccaaagttaacacagctgttaagttacagactgggatttgaaatcaggcaatctaactccagagtcactgttcttaaccacagtgctatattggaagtagatttatatatatatttcaaattgcttaaattttaaaaggttttgtttttaggttggttagattttctaggcaagtaaagcctactaaaataactcttttataattatttaaatattattttattcagtgcttttgtttttaaaaaaaaatcgtttggttcttataggcataagggccatgtgttctgaaattattttgaggcaagaagttttgaaagatggtttccacaggtaagttgcctgttgatttctatttctattaaaataatgtgtcatataattgagagcaaaaaattgatggttgaaatttgtataaattgaaaaatcaggccagatgcggtggctctcatctgtaatcccaacactttgggaggccgaggcaggcggatcacaaggtcaggagtttgataccagcctggccaacatagtgaaacgctgtctctactaaaaatacaaaaattagttgggcatgatggtacacacacctatagtcccagctacttcagaggctgaggcaggagaatcacttgaacccgggaggtggagattgtggtgagccgagatcatgccactgcactccagcctgggcaacagagtgagactctgtctcaaaaaaagaaaaaagaaaaatcacttgcttcctcaaagttactcagtgatggcatatgtggttcacactttgaaataatgattaactgagtggagcaaagaagaaaacaagtatgtattgtttaccacgtacagttgtcccttggtatctgaggggattggttcctcctggacctcccctgaggacaccaaagtcctcagatgctcaagttccctatatcaaatggcatagtacttgtatagaacctacacacaccctctcatatacagaggttgttatatatatacaactagtgcctatatatacaatattccatttaatcttcacagtggcatgagatagatgattttttcttatttttcagatgagggaggtagagctcaaacaatttaaataatttggtagaaattagggtgatagagctctgactctagcttagtactattatacttcaaagccatctcaagtactatgatacactgctctaaatcactatgtcttactacagttgattctaaatgaccaagctgtttccaaaaaagaaattatcttcaaaagatgaatatttgcccatattgaagatctttaaaagtctggtaaaaaggtgtggaaactgttccttaagaaaacttgcccaaactgaagcttcgcaaggtgattattttgaaatgattctcagatacttaatatgtaaattctgattcatttatttttttttaatttttttatgctgggcacggtggctcatgcctgtaatcccagcactttgggaggtcgaggaccccggatcacgaggtcacgagttcgagaccagcgtggcaaacacggtgaaaccccatctctactaaaaatacaaaacattagccaggcgtggtggtgggcgcctgtaatcccagctactcaggaagctgaggcagtagaatcgcttgaacccgggaggcagaggttgcagtgagccgagattatgccaccgcacttcagcctggcaacagagcgaggcaaaactccgtctgaagaaaaaaaaaagggggggaagggtatagttatttcaccatgaagtatatttgtgttaggttttttgtagatagctttttatgagttgaggacttaatcttaagtttctagtttcctgagagttttctttcatgattgggtgttaaattttgtcagataccttttcttcctctgttttgagaggatcatacaatttttatattttattctcttaatatgatgaagtacattgatgtttccagtagtgaacgtactccttggtcatgcgatattatcttcttgaaatatatctggatatgttttgctaataacttgcttagtatttttacttgtatgttcatgaaggctactggcccatgactctgttgtgatgccttattctggtttcactgtctgggtattcttggccttataaaatagtttgggaaacattttcttctctagtttctgcttgtgtagcattggtattatttattcctttaatgtttaatagaatttaacaatgaagctctgtttttgtgtgtgtgtgctacatttaggattgttcttgatgctcttgataatttcttgatgaattggatgaattgacccttttatctttgtgtaatgtctttctttatgactgacaatattccttgtcccgaagtcaccttattctaatattaatatagccatcccatatttattattaatatttgcatatcttttttatccttttacttttatcgtctttatcttcagtgtgtttcctgtagatagcatatagttcagggtggccaatttttttctttccaaatcccaagaccttgtgaaaggagttgctgttttatccatctgtcagtctctgcattctaattggagtgattagaccgtttatttttaatgtaaatattaatatggttggtctggtttaaatctgtctagctacttttttatctatttgtttttctctttgttgcatctagtcttctccttcttttcttgccttattttgggtaaattgagtatttattttttatttttttattattatactttaagttctagggtacatgtgcacaatgtgcaggtttgttacatatgtatatgtgtgccatgttggtgtgctgcacccattaactcgtcatttagcattaggttaaattgagtacttattaagcattctattttatctcaatttttggatgattagctatacctctctgtttttaatttgttgctttagggtttacaacctgcaatcgttacctatcacagtctaccttcaaataattttattccatgtcacagatactgttttatcaggatagcttcatctccttctcttttctatgctgttgttatcacatattttactttattttttacttgtgttatgaaccccacaatatattgttactggtttttctttaagcagtcacttttcacattatttattttaattgtgataaaatacccataacataaaatttacaattttaacttttttttttttggtatggggtctcgctctgttgccaggctggagtgcatggcgcgatctcggcgcactgcaacttccgattccctggttcaagtgattcttctgcctcagcctcccgattacaggcgcctgccaccacacccagctaattttcgtattttcagtagagatgggatttcaccatgttggccaggctagtttccatctcctgacctcgtgatccgcctgcttcggcctcccgaagtgtggggattacaggcgtgagccaccgcgcccggcctaattttaacgatttgtaagtgtgcaattcagtggcatcaagtacattcacgttattgtgctaccatcaccaccatccatttatggaactcttcgttttgtacaactgaaactccttgcctattgagcaataactactcattcctcctcctcccagctcctggcaaccagcatgcttgtctctgtgaatttgactcctctgggtacctcatataagtggaatcatataatgtttgtgaagcttatttcacatagcatgatgttctcacagttccttcatgttttagggtatgtgagaatttcccttctttttaaagctgagtaatattccattgtatgtttgtaccacattttgcttatttgttcattgttgatgggcactttggttgctcctgccttttggctgttgcaaataatgccgttgtgaacaggatttacggttgtctcttaaatgcctgcttcatattcccagaagtggaattgctggatcatgtgataattctattgtaattttttgagaaattgtcatagagttttctgtagtggccacatcattttacattcccaccagtgatgctcaagggctccaatttgtctagcaatcatatttgaaagcaattaaaacatgagaaagaagtcttttatattcccccacatacttatcatttctgatctcttctttcttatagatttatgtttctatctagtatcatttactttctgtcatttcttgcagtgacaaattctcttagtttgtgtttgtctgaatctttattttgcctttatttttgaaggattttcctcctggatataaaattctagatcgacagcctcttttcttttagtaatttaaataagttgctccattatcttctagcttattcttatctttgttaatctctccatcattattgatagcttttaagattgttttccattgactggataataatgtgccttgatgtgattttctttgtatttatcctgcttagggttggttggcttcttggatttgtagacttataattttatgaaattcagaaagtgttcagccattatatcttcattttttttctgttacattctcttctcttttttaggaactccaaatatatgtatactagactacttgatattgtttaaaggccatggaggcggttccttttttctccctggtcttttttcctctctgtgcttcagtgtgggtagtttctgttgctgtgtctccaagtcactgatcttttcttcttcagcatctaatggcttttaattacatctgggtaagtttttatttcggaaattatattcttcatctcttaaagttgcatttagttttttaaaaaatatcttctctctctctctcttttttttttcttgagacagggtcttgtctctgtcctccaagctggaatataatggcgctatcagagctcactgcagcctcgacctcctgggctcaaaagattctcctaccacaccctcccttgtagttgggactataggcacacatcaccatgtctggctaatttttttatttttttagagacaggggtctctccatattgcttaggctggtctcaaactcctggcttcaaatgatcctcctgcatcatttgaatcccagcctcccaatgtgctgggattacaggcatgagccaccatccccggcctattttttcttttttctttttttttagatggggatttgctctgtcacccaggctggagtacaggggcatgatcttggttcattgcaccctccacctcccaggctcaaaagattctcctgcctcagcctcctgagtagctagaccacaggcatgtgccaccatgcccggctaaattttgtatttttggtagagactaggtctcactgtgttacccaggctggtctcgaattcctgagctcaggcagtccacctgcctcagccttccaaagtgctaggattataggcatgaggcaccatgcctgccctctggcctgtttttttctgtgtaaatatccagttgtttcagtgccatttgttgaaaagactatcctttccccattaaattacgttggtacctttattgaaaattgtgtgaatgttattggattccattccttttcattgatctttgtctatttttacaataatgctatagtggcttatgacatgaattatgaaagatctaatggatgattctgacatgttataaatatttcatttgaccttataatctacttttggaaaatgaattttgaaatacagtgttttcactaataggaatacagtgttatgttatctcatttaacagttgaatgaagagatttactttcaatgtacttgtcttacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggtacagttattaggggattttttgggagagaaattaatttaggggtgctgtagtttggattaaggaaaaatagtaggttttcttttcattttgttaaagtgtataaagtgacatttttagagatagactgggcatagtctttgacaagtgagtgactcttgtcaggaataagccaactaaactgagctagttaaatgctttttaaggtggttcatagttcagtgactaagaaaattatctgggtgtatgtgtatgtcttgagaaaattaatgattaataaatagtgcctcaacagtaactttgttaatgagaatgacatataccccaacatctgggtaagtttgatatgtgaggagaagaaactaatatttaatagatgtctatatgccagatatcttcattttcttttaaaaagaaagatcgtgtcctgcaccctttacataaattaatctttataacaaccctggaggtggaatctccattttatatatagggaaactgagggctgggtgcagcgtcttacgcttgtaatcccagcactttgggaggccaaggcaggcagattgcctgagcttgggaattcgaaaccagcctgggcaacatggcgaaaccctgtttctacaaaaatacaaaaattagccaggtgtggtggtgggcgcctgtaatcccagctacttgggaggctgaggccggagaatcacttgaacctgggaggcggaggttgcagtgagccgagatcgcatcattgcactccagcctgggtgacagaatgagactttgtctcaaagaaaaaagaaactgaggcgcaaagaggccaagtaacttatccaaaatcacatagataattggaagagccaaaaaatggatccaagattgtctagttgtaatgttgttgcccttgttggacctgaatcttaccccgtagttagaaaagtttccccaactttggtaagaattccctgggggcacttttgtacagagtattgccttccagggaaatcctgattcagtaggcctagattgggccccaaaatctggtttgaagaacccagatgatttctttttttttttttttttaattattgtgggtacgcagtaggtatatgtaacctaggtgatttctgttaagaaattttgggagacactgtcttagttgataagattataatctacttacgaatttttaaaactgtaaaatagatgcatctatagttattcatgatggcagtttatttctaatcgtggtttaggccagtttctttatccatttattttattttaattgtttttgaataagtaattacattctcatgggttcattgagtagatataaaaaggtatgcaatgataacattctgcctgtgtcaaccactaatcagcaagtgtgttctcagttttttgtgtatgtatgacagtttacatacacatacaattatggaaggacctcatttttttttaatttaatgtttttttttttttttttgagacagagtctctgttgcctaggctggagtgcggtggcacaatcttggctcactgaaacctctgcctcccaggttcaagttctcctgcctcagcctcccgagtagctaggattacaggtgcatgccaccatgcctggctaatttttgtatttttagtagaggtggggtttcacaatgttggcctggctgatctcgaactcctgacctcaggttatctgcccaccttggcctcccaaagtgctgggattacaggcatgagccaccggccagaaggatctcatttcttttcttcaatgaattatgaattctaaatgaggctattcaaatttaaaataatagatttcaaatttcaacacagtttttggcttgtaaggatatgggttggaatcatatttaaatctacttaataaaatcacttaccgtgttctaagaaaatcaaagttttttggatgggggttacccaaaaattcatatctttggatggggatgagatttggatgtttgaaggttgactgttagaagaaaagggtacaggtagagagtgccattatagattgattaacaagtttatcttgatcttgattttctgctttctaatcttctaatccataattataagccttgtaagtgtatttacttctttattttggaaacttctagaaaaatagatgttacatttgtgacgtttaaatatatggaatttgatgcctgacatattccttctgcctagttgagattatggcccaattcctcgtacagagaaactttgttatgctaagtgttattatataataagtgtaactgggtagaaggaatttatatgtagggactgattgatgcttgtatacctggattaatgtcttgactctgctccaggaaataaaatttttggctgcaacaaatggaactgtgggcccagattaaatgagtggtgtgccagcaaaatgctttgtaaggagtttgtgatggtttgtgaataatttgaaaataaatgcaagccttaagtaggttcaccaaggataaggcagatcaaataaacctcatttcacttttttaggtagggttattaaacatattttttcatcagaagtctcttagattctttgaaagcagtataatattagattgaaacgtataaaattgctgttttgtgggtcaaaatggaaacagtttttgaaaccataagttttactcaaagtatgtagtattaaggcttctgcttctggtcaagtggagaacaggtaacaaatttagtctcttacttgaaacaagcaagaaatagacaaaatatatgaaataatgaaaaaagtcattgaatatcaggcaatgaagggcagagatatccgagagaagggaagtaagtaaggtgagccctactgtcatccagcttatttccttgagaatattttcaggcttaatgcagggaggagaaactcaagcagagcctagtggactttttgagttgaggagataaagttgagatgctgggcaggccaaggtaactagaattcacgggacagtgtaccagaggggagagaacgtcatagaggcagaactgcagaaataacagaaggttcctttcaagtatgtagctgagtatttatcagtgtgtatatgttaggaaactacctgatgccagggaaagagccatctgacaaaatgagcggtaacagtgtctggtactcacacagggacaggagtagtacctcgtcccagcaaccagactgagaaaagccttataatttcttgaacaatggaaaaacagagaacttttactcagtagcagggaatacttagccacaaactgaacattgctttagtcctgcataacaaatcttaaaaacaaaaccttaaaaaaatatcaaactttttctaagtaacttatctgcatcccaaacaaagctcaagaatatgtatagggatatagacatatccagcaagatcaaattagcaatttcttgactgtaataataaattagcagctaggcaaggatggggggaaaaatgacctataatgaggaggtgaatcaatcagttaaaaccaatccagaattgacccagatgttagaattaacatcatctctactaaaaatacaaaaaattagccaggcatggtggcgtgtgtctatagtctcagctacttgggaggctgaggtggaaggattgcttgagcctagatggttgagacttcagtgagccatgatcatgccactgcactccagccagggtgacagagtgagaccttgtcttaaaaagagaaaataagaggctaggtaaaaaaaagaataggcagctcatgcctattatcccagctctttgggaggatgaggcaggagaatcacttgagcccaggagtttgaggctgcagtgcaccctgattgtgccactgcactccagcctgggtgacagagtgagagtccgtctcaaaaaataaaatagtagtacatataaagcatagtgagataaggctgccaaaaaactaatgcaagttttgcctaaagaaggtaatattgctcctgtactctatgagtacttcaaatgcagctaatatgatgaatgatttggaaaccatgtcatgagaacccaggagaactgtgaacatttcccttgtcaggagaagacttcatggcggcggctatggttgccttctgataattgaaggatccctagtggaataaggaacgaatttattgcagacattgtaagcaagaacaactggtaaatgttataggttagtacatacagtttctactcatgaaaaagaaataaccttataacagtagatagatcgagatgacttatagtaatgagcttccttccagtcactgaaggtattcaagcagtggcggtatacctgaaaaatacctttgttgggacagtggtttaattttattacttccaaagtccctcatgactcatgagatgatataattccttgacttttgccaatgagttctgttcctgctgtgactaactgaaaaggaacaacatgtaaagaaaacatagcacttggtgtcactgtcagaggaaagttaggatgcttgatgtgatgggaaggagttaatgcataccagggttttgcatggacaatctaaagagaagttgtgcgtgtgtgtacatccatacatatacacataggtcgcgtatataatgcctgtgtgtgtatgtggatatatgtgagtgtgtgtacataaatatgtatgtatatgtggatatatgtgtaataaataaatatacatgttataacttaggtctaatttctgccacatgtacattttcacttttggtgtagaatactatacttttctataaaatagtttttaccatattattttaagcaatcatttactattttttccattaactgtttataccgtctctagaaagagtgctgacctttgctttgacttcctgaccgcagtgctcttactcactgccatctcacttgcttctctgaagaacaggaaattgtcagaatgataccaatcattttaactcaatacaggtttaaccttttgtcacagtttgtgtacttattgaataatgctatattcacaaaatttctctgtcttaggtacctattttgtcacctaagcaaagactaataagaaaatattacaggaataatttttattatggggaaatttggtaccctagaatataatttccccagtttttttttagtaagcagacttttattaagcataaattggtcttgtgtttttctccttaaaattgaggatggaaggggaatggaaattgcttataaaaggggcaaatttgacactgctgtgtatctgtatatagtcttctggttttaactttttaaaaatcttcctcattcatttcttcttgattaatatttattttctttttgaacaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaaggtgagggctgcaagtgttttctaagggttgaaacatcagaataaaggtatggtggcaagtcctccttctgctaggctggctggcaaggccctatgtcttgacctaggtggtagttacaagggtatttatttgccttataataattcactaaactatgtatttgagtagatttttatgtgtgtgctttaatttacaataaaaaagttaaaaagaaacatgcatctgccatccctgtccttgactgcgctgccccaactgtcatctccttccctctaagacgaacccaccatcctgactgttaaatacttccttatgtttctttatatgtttatcatccagatgggcattccaagacactataccaagactaaggtcttgtccatttataaaaatctattatttccattaagtctcttaatgtacaggtttctctctatccctttcctttcttcaacactgatctgttgaaagaacctgggccatttgacctgtagttggtcatagctggggttttgctaattggactcatgttcctcatacttctttatttactggaaattggcagctggctccagaagaatgatcagattccggtttgattcctttgacaaaactataggtcagtgctgtgttctcttctcagtagccatttaatattagtaggcatgtactatgtgtttctttttgcagccattggtccacattacccctctgttgctttttgtttcttgttatcagtattgcaggactctggcttttgatgttttgtttctacttgcatgtattttgatgtttgggaagatattttatcacctagttttgttgcagattttgtctgtgagtttttaattttgctgcataattgtcgtttctgtttttatgtgggaatgggtaaactgaaaaatcagcttttgctgccgggcgaggtggctcacgcctgtaaccccagcactttgggaggccgaggcgggtggatcatgagttcaggagttcgagaccagcctgaccaacatggtgaaaccccgtctctactaaaaatacaaaaaattagctgggagaggtggcgggcgtctgtaatcccagctacttgggaggcggaggcaggagaatcatttgaacccaggaggcggaggttgcagtgagccaagattacaccactgcactctagcctgggtgacagagcgagactgcgtctcaaaaaaaaaataaaataaaaaaaataaaaagcttttgcagtttgcagtcttctcaagatgttttctttctttctttcttattttttttttttgaggcggagtctcgctctgttgcccaggctggagtgcagtggcgcaatctcggcttaccgcaatctccgcctctcctgcctcagcctcctgagtagctgggactacaggctgcgccaccatgcctggctaatttttgtatttttagtagagacggagtttcactatgttggccagactagtctcgaactcctgacctcgtgatccacccgcctcggcctcccaaagtgctgggattacaggcgtgagccacagcacctggccaagacattttctttagtttacgaagcccctttcagtttttggttctttgtgtcttcaaatttgggttgatttagaatgtttataaaagttagtagcactggggccaggtgcagtgtatcacacctgtaatcccagcactttgggaggccgaggcaggcggatcagttgaggtcaggagttcgaaaccagcctagacaacatggtgaaaccctgtctctactaaaaatataaaaattagccaggtgtggtggtatgcacctgcaatcccagctacttgggaggctgaggcacgggaatcacttgaacctgggaggcggaggtttcagtgagctgagatcgcgccactgcagtccagcctgggagacagagcaagactgtctcaaaaaaaaaaaaaaaagttagtagcactgttactaaaaaccgacagatgggaagtttttaatactacatttgttaccgtcatacctttcatgacgagaaaattaaaaatgttcaattatattacctttgttcatccaaccttgttttctgtttctattaaaggtacctcttagcataaataaagtttgaaaaagttcctctcctgagagaactggattctgatattctgtctttttatctgaatgctcttttatgggtgtgtttcatatggaaatttatcgagttttgcacttacgatatgttcacttttctgagtgatgcttcaaaaataagtttacattaaatttttaagagcagccccaaatttgagtacaatgagattcattaagaagtcatgtttggccaggcgtagtggctcacgcctgtaatcccaacactttgggaaactgaggtgggtggatcacgaggtcaggagttcaagaccatcctggccaagatggtgaaacccgatctctactaaaaatacaaaaattagctgggtgcaatggcaggcacctgtaatcccagctactctggaggctgaggcaggagaatcgcttgaacccaggaggtggaggttgcagtgagccgagattgcaccacagcactccagcctgggtgacagagtgagactctgtctcaaaaaaaaaaaaaaaaaaaaaaaagaagtcatgttcaacttttgcaatacttttgtgattttctaatttcttaggcattcacataaaaaaggatgctaaaataacagaatgtgatagatgggtccagatcatatacataatgtattaaaatgtttgacaacttctgtctattgaggtttaatacaagcctagctttcagtccaaatacaggttttctgacatcattttctaccacttttctcagagttcccgattttgaaatgctgggctcactcagaagtggcagccccttgtgctttggagaatgaggatatctgccaatggaacaagatgaagtataaatcagtaagctaatgttttatgttgttttttagatcatgtgcctcatttaaagctctttctgtaatgttcctgccacatttaagagattagcatttttttttttttttaggcggagtctcgctctgtcacccaggctggagtgcagtggcacaatctcggctcactgcagcctccgcctaccaggttcaagtgattctcctgcctcagcctcccaagtagctgggattctaggtgcccgccaccacacccagctaatttttgtagttttggtagaggcagggtttcaccctgttggccaggctggtctcaaactcctgactttaggtgatccgcctatcttggcctcccagagtgctgggattacaggcatgagccaccgtgcccagctgggattagcattttctaatatagaaagctgttttttcttacagcaaagggttactacaaagcactgctgttttttgttggggaactttcattgaacatacagttgggaagatggatgactctgcaatcttatgcagtgtagagttgtttttgagtaggttgccattgccatatggtacctgaaaatttttctcaaactctaaaatacatctggagacctgcatttgattgattatgtcaatgaagagtatgcttagtgtttatgatttattgatttagcaaattagtgtgtattgctacaagataagtagtgacccttttaaaacattttgaattcagttgtccttatttatttatttatttattttgagacagagtctcgctctgttgcccaggctggagtgcagtggtgcaatcttggctcactgcaacctccgcctccctgttcaatcagttctcctgtctcagcctcccgagtagctgggactataggcgcctgccaccatgcccggctaatttttgtatttttagtagagacggggtttcaccttgttggtcaggctggtctcaaactcctgacttcaggtgatccacccccgtcagcctcccaaagtgctgggattacaggcgtgagccaccacacctgacttcagttgcctttaaaattctgtaacttgccataagaggtcataataatttaacactttaaatatagcttttaactatatgtatatattatttatatatatatatatatatatatatatatatatatatatattttattttattttatttttttttttattttatttttttttttgagacggagtctcgctctgttgcccaggctggagtgcagtggcacgatctcggctcaccacaacctccgcctcccgggttcaagtcattctcctgcctcagcctcctgagtagctgggactataggcacgtgccaccatgcctggataatttttgtatttttagtagagacagggtttcactgtgttggccaggctggtctcaaactcctgacctcatgatccgcctgcctcagcctcccaaagtgctgggattacaggcatgagccactgcacccggccaactttatatatatttcatcttcatatataccagaaaaataggtggccattactaaggtggtattccatcccaaggattgttgaagatgtcatttttttgaatgacggttttcagatagcactttgttgcagattgggttggttacttgtattttttggggtgtgaaatcataattcaggtatttacaaaaagaaaaagtattcccaagttacgtacattttaatgttttttaaaacttatttttaaagtataaactttcccagtgtttttcattgaactttatcttcaaaaccaaatagaaaatagaaactgagttgaatgtaggagcttttccattgctagtcatagtaaaggccacatccagctgtacaatatgggaataacaaggctttaaaagctatctggggagagaaaggcaaatgggaatgaaagaataatttagttttttgttgttttaatgtttttcctctaagtcttcaatttagagagaattctgtattctaatttgaaacatggtaagaggaagtaaatgtttatattgattacagaggtgacactgggatatagcttttcttaaaataatatactttatgtaaaaagcagaaaaatcagaactaatgagatttaacaaattattgtgggaattgagtctgattctgtaacattaaatgaaatgttagattcaaaagtcattcaaaccaataatattacatgtagtgtagcactggctgaaatatatttaaaagaaaaaggaaataaaaatatccaattaaaaatcaaagaaatagtggtctcaccttatgacatttattttattttactatttttatttatttatttatttatttgagacagagtcttcctctgtctcccaggctggagtacagtggcacgatctcagctcactgcaaacctccgcctcccgggttcaagtgattgttctgtcttagcctccctagtagctgggactacaggcacctgccaccacacctggctaatttttgtatttttagtagagatggtttagtagagatgttggccaggctggttttgaactcctgacctcaagcgatctgcccgccttggcctcccgaagtgctgggattacaggcatgagctaccacaccgggcccatgacatgcattttcaatgtctaacttctctctctctctccataggtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactacagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatgaagaa

SEQ ID NO: 2138 - DNA, 23633 bp, Homo sapiens; identical to SEQ ID NO: 2137

SEQ ID NO: 2139 - DNA, 9276 bp, Homo sapiens
cagtttctcctttgttttacgtttgggaggaggtggcattggaaatagcagagtgcttcgcggtaacaggggtgagtcttgtttcatggaacttttttcaaatggggagaagggggttgtgttgctcactacttggaatgtgtcggtcaaaggggttagatagtcagggaggggaagcgtgttctcatcctgggaccaggccggagccggcctcgccgggagacttgtagccctcgccctgcggtgacccgtggctggccactggcctcaaatgttgaaaacgggcagatgggcaagtaatacactctcaagaaagcaagtgtctggcggtgatttcctaaattgcattttttattttatttcaaaacttcatgtaaatatgtttccttacaatatctggctaagtcttttctatattaacatgcttacattgtgatcaagacaccagtctcttccctttcttttcctctcctcttatctctggagatggcaatacccccaactcaaattactctagcaaaaaacctaggagactctttcttttcttttttctttttttttggagacagtctcgctctgttgccaggctggagtgcaatggcgcgatctcggctcactgcaacctccgtctcccgggttcaagggattctcctgcctcagcctcccaagtagctgagattacaggcgcccttcactgcgcccggctaatttttgtattttagtagagacggggtttcaccatgttggtcaggctggtctcgaactcgtgacctcagatgatccgcccgcctcagcctcccaaagtgctgagattacaggcgtgagccaccgcgccgggcgagactcattcttgattcctgtttcccttccgctcttcatccaatccaccggcgagctgcagggcgagggggtggttctttctcctgttttcccgctctccctgcatttcatctcctctgccgccatctgctccaaacccctggcagcccttcgcgggattcccaaatctaatagatttttctgttctccccaaatccattctccatgcagctgtccggcccatcttctaacctaaaaaaacttgctgtttgcttgttggaagccctgtaatggtttccttgggacctgggatgaaatgcaaatggtcccggggctcaccgtcagccccgcgcctgggcctcgccccagcccccaccttcctgcccgccatagctgtagggagcatggagcatggagcgtggagcgtggagcatggagcatggagcgtggagcatggagcatggcctgcagcccccggggagcgccggcagcctggaaccagcaggcttcgctcgtctcttcccacccccgtgcacttttcctcctgcccacatctggctccgatggccccctccttgggggccttttccagacattcatgatgaaggtggcgtcctcggttacttcccctctcatattcttttttttttttttttttttttgagacagagttttgctcttgtcgcttgggctggagtgcagtggcacgatctcggctcactgcaacctccgcctcctaggttcaagcgattctcctgcctcggcctcccgagtagctgggactacaggcgcccgccaccacgcccgactaattttttttatttttaatagggtttcaccatgttggccaggatggtctcgatctcctgacctcgtgatccgcccgcctcggcctcccaaagtggtgggattacaagcgtgagccaccgctcccggtcccaccccgccccgaccttttttttaatagcatttttctcaatctgacattttttgtttatttgccctttactgtctgtcccacaccaaactttgtgttaacgaggaactttgcatctttttccctaagttcagcacctagaacgaatactaaatgtatatgaagatttcgtccacatccgcttttaccagtatgttttccatgtacagtcaagttccatataaggccgtttcagtcagtgagcaaccccacgtactatggtggtcccataagattataaaagagctgaaaaatccccatggcctagtgacatcttcatgatcctgaatttgtgtaggcctaggctcatgtgtgtgtttgtctcttcgtttttaacgtaaaagtttttaaacagacaaaattttacagaataagaatataaagaaaaaatatttttgtacaggtgaaaaaatgtttgtgttttaagctaagtgttattacaaaagagtcaggaagtttgcacatttttaagtttataaagttaaaaagagtctgggcgcggtggctcacgcctgtaatcccagcattttgagagcctgaggcaggcggatcgcctgaggtcgggagttggagaccagcctgaccaacgtggagaaacctcatttctactaaaaatacgaaattagctgggcgtggtgacacatgcctgtaatcccagctactcaggaggctgacgcgggagaatcggctgaacctgggaggcggaggttgctgtgagcggagatcacgctgttgcactccagcctgggcaacaagagggaaactctgtctcaaaaaaaaaagtaaataaataaatgaatttaaaaagttacagtaagctaaggttaatttattattcaggaaagacaaatttttaaataagttctaaaatttgcctaagtgtacagtgcttataaagcctacagttgtgtacagtggcgtcccaggccttcattcactcaacactcactcactcactcatccagagccactaccagtactgtgagctccattatgggaatgtgcctacacaggtgtaccattttttatcttttgtacagtatttcttctgtttggatatgtttatatgcaaatacttactgttgtgttacagttgcctacagtactcagaactgtaacatgctgtggagatttatagcctaggagccatgggccctactgtgtaacctgggtgagttgcaggctgtgccattcgggtctgcgtagctacactctgtgatgttcacaggatgacacagcaacctaaagatacatttctcagaacatattcctgtcttcgagtgatgcatgactagttatttctgctaacagaaattggcttgccatataaatagttttcttttagtaaattaataaattaccatttcaatgttatatgtcatcctcacaagcttgtatactgctatgagaaatagcataatgctcggagatctgacaaataagaatttagcttagaaaggtaaggaccatacttgaaccttagtaaattcataaagaaaacacctctcttaggagatgcctttcttttttttctgtcacccaggttggagtgcaatggtgtgatctcagctcactgcaacccctgcctcccaggctccagcgatcctcccacctcagcctcctgaatagctgaccaccagcacactaggcaaacccaccccactcacggcctcccttgggaattcagacctaaccatcgctgagctgaagtgtaggtgtggtctgattagactcattttttcttttttgtagagatggggtttcaccgttttgccgaggctggtcaccaactcctgggctcaagggatccacccacctcagcctcccaaagtgctgggattgcaggcatgagccaccatgcctggccttaggaaattcctttctatgtaacaccctgcatcattaatagccagcttttttgaaacttctacattaaattgtctaaactctcaaataaattcctagtaaagtaattatatagggttgttaaatcagagatcaacagcacaatgactaatgcatactcatgatttcatctcactagacaaatgtactgaggctggagcctgtgtgaacagaacagaagaggccttcactctagtagtgctcacagtccagcaggtaagacagacttgaagcaagggacaccagagctctgatcagtgtgaaatagggagctaggagaacgtttagctttgggactcaactgagctgaagaatccagggaagcctgcctgaagaggtgatgtttgcgcatttgaagtatggatgggaagcaagcctctgtgtgtgtgttggaggataggtggtattttagtgagaaaaaagaacatttgtaatggactgatctgatgctttactggagaaagtttattatggctgaatagtgaaatacaagagctatagatggcaggaggtgagcttggagggaaaagcagcagtcaattaaattgcagttacaggttgagtattttttatccaaagtgcttgggaccagaagtattatggacatcagatttttttgaatgtttgagtatttgcaaaatacccaatatgagcatcccgagtccgaaaattcaaaatccaaaatggtccaatgagaatttcctttaagtgtcatgatggcactcaaaaaggtttcatactttaagcatttcaggtcctagattttcagatttgggatgcacaagctgttttttaaatggactaattggggagagcagctctgtgtttaatcctagtaattaccctccaaaggtgctaatattgtgcttcataaatattttgagatctccctggttaatttcacctctatatttttgttttctttttttttcttttttttccgagaaagtcgctctgttgtccaggctggagtgcagtggcacaatcttggctcactgcctccgcctcccaggctcaagtgatctcctgccagtagctgggattgcaggtgtacgccaccacatccagttaatttcttgtatttttagtagacagggttccgccatattggccaggctggtcttaaactcctgatctcaggtgatccgccagccttgtgctcacaaagggctggcattacaggcacgagccactgcacccagccctaatttcacctttttaaaggacacaggcctggcgcagtggctcacgcctgtaatcccagtactttgagaagccgaggagagcagatcacctgaggtcaggagttcgagaccagcctggccaacatgatgaaatcccgtatctactaaaaaataacacaaattagctgggtgtggtggcggggcgggggggcgcctgcctgtaatcccagctacttggggcctgaggcaggagaatcacttgaaccccagaggcggaggttgcagtgagctgagattgcgccattgtactccagcctgggcaacaagagcgaaactccatctcaaaataaaataaaaggacacaaaaaataacattagtagcatataacatatatgtattacatatttttaaatacattttaagaaatcttaaacttttcccctacagttggaacacattttgtttttattatatgtatttgttttttaccaaaagtaaatgacatgcttctgttgaggtgttttttttttaatgtggttattttaattttcatccaacaacttttacctttgcctcttttttaaaggcatataatttttcttcctacagaaagacatcaggacaataaatagggagatcttttctcaggcacacaattgtaacattaagtaagagacttttatagtcaaagcaataacatattcatgctataacttttataacgtcattgctgttaaatgtttaaggaaatgataggaaagtcttcagggccaagctaccccgtgcctttattttggcatggattcctaaaagtgggagcaccattaatttcatgtgtcttattctctggatccccattttttagaacaatgagtgggcacacgatggcccatgggccagtctccctgttttactggaacacagccaccctcattcctttatgtgttatctgactgcttctgtgccgtgctacaacggcaaagttgaatagtttcaacagacaccacaggacccacaaagctaaaatctggccctttgcagaaatagtttaccaccccagtctagaaagaacctggcgtgtagcaggatgcaacatatacttgtagaatgaataaaaaggtaataaaataacacgagctcacatagcggccagcatttgctgtgcaccataatccgtgctaagcactttgcatgcgttatttaatttgaatttcataacagtattacataagaaaacaatagggccaggcatggtggctcacgcctgtaatcccagcactttgggaggccgaggcaggcggatcacgaagtcgggagctccagaccagcctgaccaacatggtgaaaccccatttctactaaaactagaaaaagtagccaggcgtggtggcgtgcgcctgtaatcccagctacttgggaggctgaggcaggagaattgcttgaacccgggaggtggaggttgcaatgagctaagattgcaccactgcactccagcctgggcgacagagtgagactccgtctccaaaaaaaaagaagaaaaagaaaagacagtattttgctccctcaccgccttcaggcttttaaccaactgccacttaccaccctagtgaaggtttgcccgagtgccctatttaatattgcaggcttctgtttcctaccagcccctttgcttactctttcacacttagtcaccttctaacgtggcatacattgcttattttctatgctcatgagtatgtctactccatggaggcatagatgtttgtatgcctgtttactgatggatcacaaactgtgtagcctaaaatagagctagcacatagtcccacccaacacgtgtcaggtgagcaattagatatagagggttccaataacttgtggggacacccagataagatctgtttatgactcatgtcttacacagagctcattcttggtctcttggttagtttatcagagaagacaaatgtattattggaaaatgtgtcttaggtcattttttgacagtggctctaatactggaatctattttaactaaaggttattatcataaagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttc

SEQ ID NO: 2140 - DNA, 13983 bp, Homo sapiens
tcctggaacgctttttattgggttagtttacacaaattctttcaaagtcttgttctccaactttctggtgtctcgtggtcttggattttacacacagaagattaagggctaacagtagcatcacaagaaggaccatgttgtaagatggtgagggagtctggacttgtgtctccatttgggatacagagggaaaacacaggcctgagagctccttggaaggcgcaatgggagaaattgtaaatgagggacatctcggtcacattgtagaatgatatctgcccgtgttcgcagtcaaggaaaacgccaactgtgtccaacttcttttccaggaagagccttttcagaggggggaagacccagagagtccactcggtccccatcaccgaccccgtgagcaagactttctctccggaagctctggccgtgctgcccttcgcgtctgcagagccgtggtatatgcccacttgccacctggttgccttttccacgtccacctcccagtagtgcctccctgaggtgaagctctccgcagccagcaccatggcactgaaatccaatctttctgggttgccagccccatcctgctgcccatgtctcaatctcatagttctcaggtcctcagatagtgccaggcagggatgagctgtttcaggatccaatgttaaatgtcctatcaggagagaaaaccctcgttaacctaggagttcaccaatgccaatgccagagacatgatttctaacacacctgggcttcccactgagtgggcacaagtcccaggcccagatacgggagaggcaatttgggagggtccaggaaaaggaactgctgaacttcaatatggacctcatggaggaaaaagtccataagatatggaaagggacacagtctacctgagcgggaagaataaaacaaagatgaatgagctaaggaaggtttagaaacaccttcatccaacgtggcgcggtggctcacgaggtcaggagttcaagaccagcctggtcaagatggtgaaaccccatctctactaaaaaaatacaaaaagtagccgagtgtggtggcaggcgcctgtaatcccagctactcatgaggctgaggcagaaaattgcttgaacccaggaggcggagattgcagtgagccgagatcacaccactgcactccagcctgggcgacagagcaagactccatctcaaaacaaacaaacaaacaaacaaacaaacaaaaaacagcttcaccccagagacggtcaaactgtcctggtgccaagttccatccagatatcacttggggcccaaccctggtcttctagatctccaagcctggagcggccacaggagtcggccagcagcaactcattcgtggccctcccgatgccgtactctacacatcttaaatatccccacagggtgacatagaggcctggaaattgctgacaacaggccctggacatcaggcattacatcagataatttatcagcggaggatggaacacctgtgtggaccctccagaaactcacgctgagaacacgcaggctcaatgaattcctcacacctgcatgaatacgtcttcttcctatctctgactgttcctctcatctctttctgcccagcctctaactattgtgatctttcagggcttggtcctgggacttcttctttcaagtagtatattctccttcactgcccccaggtaactgtgcatagcttcagttttaaacatcttctctgtgtttgtgactcgctccataaacagctaaataccagttggaaaaaacacaggaatttcaaacataacacacccaaaatggaacttcaacgccagccctctgcagtctctacttctcagttcacagctccctcattgcttcagttgtctaagccataaacctggaaggcctttatttcctactttctgtaatgtggaatccagcttaatttctattatttgactgaagtaaatttaatgaacttaaatctctgaatttgaagcccaattcacattattagggtggtctcaacagctacacgtcttgaatttttaaaaaattgtctgagactctcagtatttccaggagactggcagaaacaaatgcaaattatctctggaaaaacgcacagctgtggctgggcacggtggctcacgcttgtaatcccagcattttaggaggccgaggaggacggatcacttgaggccaggactttgagaccagcctggcgaaaccccatctctactaaaattacaaaaatcagccaggcctggtggcggcctgtaatcccagctactcaggagggtgaggcaggagcatcgcttgcatctgggaggcagaggttgcagtgagccgagatcatgccactgccctccagcctgagcaacagagcgaggctcatctcaaaaacaaaaacaaaaaaggttgaagaaacaacaggagtatctcaagagaaaaagaacttgataaattcaacattgattcataaaaattcttagtaaaccagaaataaagggggacatcctcaatttgatgaaaggcagccattaaaaaaaactatagctagggccaggtgcggtggctcacgcctttaatcccagcactttgggaacctgaggcaggcagatcacgaggttgggagttcgagaccagcctgaccaacagagtgaaaccccgtatctactaaaaatacaaaaattagctgagtgtggtggcactcagctactcgggaggttgaggcaggagaatcgtttgaatctgggaggaggaggttgcggtgagctgaggcttcgccattgcactccagcctgggtgacagagccagacagcatctcaaaaaacaaaaacaaaaacaaaaacaaaaacaaaaacaaaaaacacaaaacaacaacaaaaagcgctatagctgtatcagaatttagagtgaaaagacttaatgttttctttcttcctaagatcgagaataagcaagtgtccactctcaccacttctgttcaacacactgcaggtctgagccagtataataaggcaagaaaaattcagaaaaggcttacagactggaaaggcagaaataaagctatctatactcatatactgcatgactttgtagaaaatcctgaaggatctatttatagaaatccactgtctaatgagtgagttttgcatagttatagggtacaaatgtcaatatatataaaacaattccatttctatatacttgcaatgaactagaaatgaatgaaatgtcaattagaaattgatattttaaaataccgtttacagtggctgtaaaaaacataaaatacttagggatacatctccaaatacatataacattttatgctgaaagtgacaaaacactgatgagagaaatcgaagacctaaataaatggagatattttgtattcctggactgaaagcaccaaatattgtcaagatgtcaattctccccaaactgatcaacggattcaatgtaatatgaataaaaatcccagcggtccattttgaagaagccaacaagctgatttcaaaatttatgtggaaaagcaaacaacctacagtagccaaaactattctgaaaaagaataaatttggagaatgcacagtacctgctttcaagacttcctacagagttatcaatcaagccagtgtgctattggcaaagggaaagagtcaaccatcaatagacctattagagtcacaaatagacgtgatcgcatataccagttgattttcaacaaaggggccaagtaaattgaatggacaaaggtagtgtttttaacaaatgaaactggaacaaatggatacatgtgagtcaaaaaataaaaatagaaggtggggggaggagagggtttgcaccattctgtgaactgtatacagatattaactctcagtggttcataggccacaatgtaaaaccgaaaaccataaaacttttggaaggaaatctttgttggctttggcaaaatttcttaaataagacacaaaaagcagaagtcataaaagaaaaaacttgataaattgaacttcatcaaaatgcaaaacctctacacttcaaaagacagtattaggaaaatgagaatacaaaccatgctgggaggaaatatttgcaaaatttatctgataaatgaatgctaaacagaacatataaagaaattataaaactcaagagacatacaacccaatttagaaaaggggtttgtacatgtatttcaccaaagttgagatagagggaaaacaaacacatgaaaatatgctcagcatcattagtcattctggaaatgcaaattaaaatgacataccactacccatctatcgggtcggatgtagtaaaacaaactgacaataccaaaccctggtgagaatacagagtaactgaatctttcgcacgttattggtgggaaggcaaaatggcacaggcaatttggaaaacaagtttggcaatcccacccttagacagtcaatcaagaactatgaagctgtgcccacacaaaaatctgctgctaatatttacagcacagagctggaaacaacccatgtccgtagaattgcaaaaggataagtaaattatggtatatttatacaatggaatattatcaacaataaaaaggaacaaactactgatacacgaagcagcctggacgttctatatgtcaactgcagtatgctgtcagcctcgaaaggccacacactgtaggattccatcgataggacattctgggaaaggcaaagctataaggacaggagatataaaccctttgttatacatgctgaatttcttccccagaagttttaaatttttaagcagtggaatctgcctgcaatcatgtttcatggctggggaactggtaaagaatctgcagccaggcgtggtggctcacgcctgtaatcccagcactttgggagcctgaggcgcgtggatcacctgagatcaggagttcaagaccagcctgaccaacatggtaagacctcgtctctaccataaatacaaaaaattagccaggcgtggtggctcacgcctataatcccagcactttgggagcccaaggcgcgtggatcacctgagatcaggagttcaagaccatcctgaccaacatggtaagacctcatctctactatacaaaaaattagccaggtgtggtggtgcatgcctgtaatcccagctacttgggaggccgaggcaggagaatcacttgaacccaggagggggaggttgcagtgagccaagatcgcaccactgcactccagcctgggcaaagtgaaactctgtctcaaaaaaaaaaaaaaaaaaaaaaaaaaaaaagattttgcatgggaagagctttcatatgagatcatacagttatttttttgatccttatctaatatgtataacatattaagctctccagtctcctaaaatttttatttatttattttaagacagagtctcattctgttgcccaggctggggtgcagtggtgtgatctcagctcactgcaatctccacctcctgggttcaagcaattctcccacctcagccactcaagtagcagggactacaggcacacgccaccacaactggctaattttcgtattttttgtagagatgggatttcaccatgttggttaggctggtctcgaactcctggcctcaagcaaaccgcccgccttggcctcccaaagtgctgggattacaggagtgacccactgtgctggcctaaaattgttaaactactggaatttgttttcatttatggcaggatggtcacctgattctcaaatgcagaacagtgccctgtgagtattcacatgtgtcaacttactctggagtactctgaacatgctgctgagtcctcttatgtggcataaactcaggtctgtgatatgagcgggctccagatgctcaagcagcagtgacttgctcctgaagagaaaggacagcctcagtcatctgcacagaccacaggccccttagtctactggatggatcccattacatcctaccagcaaatgcaatctccctatctcaatcaacatcttactggactctgattctcacccaattgtatccaaaatgaaaactcacctttctaaagagtattttgcattctaagggaaagaaaagagaccaggttactactgggtttttgagctgtttttgcaatctgtgcccaggaaaatatcctcttacaatgaactcaatttccatgtcatttcttcaacctcataatgctagttatcagatgaacaaattctaacatggaaacagaaaaagtcagaaaaatgcatgaaatcattttgtcgtagtcccaagggaaaggttttctatccctcaccccaggcatcttactcagagccatcatttctcagtcttcagacgggagcatctatctgctttccatgcagggggtggccagagttcagcaggtgaaggggccactggctgggagggcagtgggagccaggcagagccacacctgcctgcatgctcaagaactgagctgcttcctaaggatttacctacagacgctttccagatgagcgcattcattgcaattataagcccaggagagggatatggacagtcttaaaaagatagtaaggccaggcgcggtggctcatgcctgtaatcccagcactttgggaggccaaggtgggcgtataacctgaggtcgggagtttaagaccagactgaccaacatggtgaaaccccgtttctactaaaaatacaaaaattagctggacatggtggtgggcgcctgtaatcccaactactcaggaggctgaggcaggagaatcgcttgaactggggaggcggaggttacagtgagccgaaattgcgccactgctccagcctgggagatagagcgagactccgtctcggggaaaaaaaaaaaaaaaaaggtaacccactttctgaaaggcaacgtatgttactatacaaaattcaaaatatgcaatacttaccatagactgagtagcttctgcacagcagaaattcatttctcgcagttctggaggccgaatttcaagatcaaggcactggcagattcagtgtccggtgagggctccatccctcctaggtagcctccatctccagcctcacaagctgaaggggtgaggtcttcctcggcctcttttataagagccctaatcccattcacaggggctctgcccccaggccccactcactacccaaaggccccacctcccaataccatcgccttgggggagaggatttcaacatatatattttggagggacacaaacattcagatcatagcagataatctcacccttgtttcaagattatcacagatgactatacatttattaattttttgccagaaagtctgtgaatgttagcaaccacacatgtatatgtgtgtgtatatatacttattatccaaagatcaaacaaaaagcagtctgcatctttctttttcacttaatgagtgcttgaaatactgttagtgcctatagagctgttttattctttatgatcacagaatatttcattgcatggaggtattaaccacattgtgtcacatctcaaccctaacttactgctgataattttaaggtgagaattcatctcatgaagcagctccacactatcccacaaagctatgaccattcctaaagcttttggcagctgaaagaaagtcatgtagccttcttttgtggttgaagatcattggatattgtgttctgacagcaacccctaatgagtactgtccacttctcatttctcaaatactggaatgaattttattttctttttcccagcatcttaccttgagcaatgccaaggtgccttccccacactttttctcaagctccacgatgagctttaggaggctgcggacctgttcagaagccctggcttcactctccttcagtttctccatgttctctctccccacacggcccagtctctgcagaagcatttcttcgttactattcaacaacctcaagttcaggaacaagagttcggtaacttctcctatagattaattcaaccatgtttttaaaaacctgcttttcggttgggcgcagtggctcacgcctgtaatcccagcactttgggtggccaaggccggcggatcatgaggtcagggtttgagaccagcctggccaacatggtgaaacccagtctccactagaagtacaaaaattagccaggcgtggtggcgggtgcctgtaatcccagctactcaggaggctgaggcaggagaatcgcttgaacctgggaggcagacgttgcagtgagccaagatcgtgccactgcactccagcctgaatgacagagcaagactccaaatcaaaaaaaaaaaccaaaaccaaaaccaaaaaaaaaaaaaccctgcttttctgcctgctaccccaggaacagacataattaggcaaggccatgatattcttctgctgaagcaggattcctctcaagagacagttgattctttgccccctgttatgtatgtttaagccaatacagatgtgtgtgcacgcagcccttactcacattaatatgcacctaaaacatttcatgttttttctgtggctgtttgttcagaaggttccctattttttcattaacttgaaatcaattaaaattaaggtatatagattaactaataagaaataaataattacgttactgatatcaattttctttttatccttccaagtatactttacatatactgcgtagtcacatacgcaacttgagtatgttatttagggggaaaaaacataaacataagtgatagtttattatatttgattactaatctgacaacttactttattcttggagaacattccttattcatatacacagagccatgacatcatcttaacatgctgaagagtattcttccatgtatgtatggagcacattttgtgagtcttctattgacaaatacagggtgtttctaacctcttgctatgaatgttataattgtaacatctgctactcatcaactgcttaacatgaacaagacacgatttaataagctttagcagattatctcactcaaatctcacaataattttataaattaggggtcactgttatatccagtttacagctaaaggaaccaagtcaaaggttaagcagcaggtcgtaggccacccaggagccagtaaacagctggctcagataggaactccattcatccggcttcaaaggtgaattctaggccgggcgcggtggctcacgcctgtaatcccagcactttgggaggctgaggcgggtggatcatgaggtcaggagatcgagaccatcctggctaacacggtgaaaccccgtctctactaaatatacaaaaaattagccgggcgtagtggcgggcacctgtaatcccagctacttgggaggctgaggcaggagaatggcgtgaacccgggaggcgaagcttgcagtgagctgagattgcgccactgcactccagcctggagacagagccagactctgtctcaaaaaaaagaaaggtgaattctaaaccatggctctaaactgaaactcagtttcagtgttgccttacccaggtgtctttttctatgtgtgtaagtatgtttgaagcataatacagtaatatgtgtacaaatatatttataggtatattgtgctttatttatgtctttttatatgcatgtcaagataaattcatagaaatggagttgccaggtaggtatataattcatttaatacatgtgtggttgtcactggctatgttattttggaattgacataatgtttagctcttctttttctcatttctcaaatatgaggatgttgttttcaatatctcacctgtagcatttcctggaacatctcctctagctcggtggcaagcttgatcgcttgattcagaagggtttctctcaggttcaagtcagatatgcattcctgctgtctctggagattctgctcacactcttcattcaacaaccggagtctcatactatactcagactcaatcatctttttaaaattttgttcctcttccttcctcatatagacatgatagacttcaggttaaacatgatagattaacaacacacacacacgtcataatagatagatatctatatctatatatagatatatatatcttacactgaccacaatgtattctttccatctctaaccccaatataaagacaaggaaggctgggcgcagtggctcacgcctgcaatcccagcactttgggaggccaaagtgggtggatcacgaggtcaggagatcgagaccatactggccagcatggtgaaaccccatctctactaaaaatacaaaaattagctgggcgtggtggggagcacccataatcccagctactcggaaggctaaggcaggagaatcgcttgaacctgggaggtggaggttgcagtgagcagagattacgccactgcactccagcctggcaacagagctagactctgtctcaaaaaaacaaacaaacaaaaaaagacgaggaaatgtaaagtacagaagaaaaggaataaacccaaaggagaaatagaatttgagtcaacatcagccaagacatcaacacaattttagaacataaaatgcagacgaagaaatgttcatcaatgaattggctgggcgcggtggttcacgcctgtaatcccagcactttgggaggccgaggcaggcggatcacgaggtcaggagatcgagaccatcctggctaacacggtgaaaccccgtctctactaaaaatacaaaaaattagccgggcttggtggcgggcgcctgtagtcccagctactcgggaggctgaggcaggagaatggcgtgaacccgggaggtggagcttgcagtgagccgagatggcgccaccgcactccagcctgggcgacagagggagactccatcttaaaaaaaaaaaaaaaaaaaagaaatgttcatcaataaggaaaaactaaggaagctatagcctctgtcaaacagaggaggagaccaggacattggaaaagggccaatgggatttgctgatgcttgggtaagagttgtggggaaaaaaggagtcatggacgaaagacaccaaaaattttagactaagcaactggaagaatggaattaccaaaatatatagagagaatctatggaaaggctggattccagaagtgaggagtgtgcgttagctcgggatgtgatgaatttgattagtcaattagacatccaagtaaagatagtaagtaggaaattggacatgaagcctactaccatttggaaatctgagctagggatatatatttgaaagtagtcatcttagagatgcttaaatagcatctctattaagctatttaagattcagtgaaattgtccgggctcacgtctgtaatcccagcactttgggaggccaaggcaggtggatcatggggtcagcagttcgagaccagcctgaccaacatggtgaaaccccgtctctactaaaaataaaaaaattagccaggcatgatgacgggcccctgtaatgtcagctacctgggagactaaggcaggagaattgcttgaacccgggaggcggaggttgcagtgagccgagatcgcgtcactgaactctagcctgggtaacaagaacgaaacttcatctcaaaaaaaaaaaaaaaaagattcaatgaaatcaagatttatcaagaacctgactacttctcaccactgctctacctgtcccccagctcaccatcatctctccctaattattgcaagtccctttgcacgtctctccacctctgcttttactctcttggtttttttttttttttttttttttttgagacggagtctcgctctgtcgcccaggctggagtgcagtggcgccatctcggctcactgcaagctccgcctccaaagttcatgccattctcctgcctcagtcacctgagtagctgggactacaggcacctgccaccacacccgattttttagtagagacggggtttcaccgtgttagccaggatggtctcgatctcctgacctcgtgatccgcccgcctcggcctcccaaagtgctgggattacaggcatgagccaccacgaccagcctgcttttactatcttaatgtctattttcatttggcagctagcgtgtttctatgaaaatggaagttaaatcatgtcagccttctgttcgaaaccttccagtggttttgaagcttgtatttcattgaaggctgccaccctaaatgactgaccgccttcttctgatctcatcacctacagcccccgtttccttacacagctccagccacatacacggcagcctccaggcctttcctctgcctagaatattcctccccaagaaaactgcatggcccaatcccccacctccttcagtgccaccttctgaataacaaggttctgatcactttatttacaagctcactccattgcttcctttctcacttaaaaaaaatttttttaaacacttcccaggtaacatactatatattaaacttattttgtttatatccactagaatgcaagttccacgaaagcagagctggttttttttgttttccattggtgagcccctagcaccttgcatagtccctggcaaacagtgggatctcagtatttgctgaacacatggtacttggaactgaaaaagaagggggatcggttgaaaaatccttacctagccaggcaattctcctccactatcttccctaagtaggcatttatttcctttaaaaattgagggagagaaaagacccagaatcggggataccttgcacagaataggattaagtatgaagatacaggctgaaattagaagtgaaatatgcctaacaggtggtgaaccctcaaatctgaatagctattctcaaattgctctttaaagggttttagaatttatgtggcaaccagaagtacaagagatgctcattctcctatgtcattgttataaacggtgtcgttaatctttttgatcattgcaaatagcattgcaaatgccattttactcaccatataatttgtatttctcttaccacgaacaaagttcaaattctttcaatgtatttaaaatatatttactttcttttctgcaaactcttatttgatcgttttttaaaattaaatttctagtcttttccttactgactttttttatttttattttttttgagatggagtcttgctctgtggcctaggctggagtccagtagtgtgatctcggctcactgcaacctctgcctcccagttcaagcgattctcctgcctcagcctcccgagtagctgggattacaggctcgtgcaaccacacccagctaatttttgtatttttagtagagatggggtttcaccatgttggccaggctggtctcaaactcctgacctcaagtgatccgccctcctcagcttcccaaagtgctgggattacaggcgtgagccaccacacccagcttcttactgactttaaagagctttttatacattaagatattagcacttttccttcctatagatttcacatttttcctgctttgtgatttgtcttttgactttgtttatgatacactattttctaacaacattactggtaatttccccccaagaatcaagataagcactcactgacctgaatcatcgccattctttcttgctcatcagtcaatatgcttttagctgcttcaagtttctccctcgatgtgttcaatatttcctggaataacttctatagagaaagcacagaattccaggtgagatcattgatttagaacagttggattcctgaccttaaacagccaacaactctgagtatatattttcttagcctttaggttgaaggttcaacgaacttatctaatattctgtaataaacatcaactaaggtaatggttttggaggaccagaatgtctgtccatttcatccatataggagttggccagagtgttttgggatttgcgtgagtgactcttaccctgtaattctcagcagcctcttgtatcccacacaccatgtgatgtttgtgctcctgggactggaagcatttgct

SEQ ID NO: 2141 - DNA, 595323 bp, Homo sapiens
tttacaacataaatcatttaatgtaacatttgcaaccttagaaaggcagacatgtttaatccaagtccgtttataaattccaatttcacatggattaaaaactgcagataaattaagtcacaataatatcctgtacatgcattaaggctggtgactgctaaagtctcttgggaatctacaaataggaaatcacacgcagattactgggtctgaagagtgtctacattgttaaaaaaatcttgcttttttttttttttggtgatgcagatttcaacagtaactctggaaaactgtgaaaaatgttatttaaaaatatatatgtatatgctactgcacagtttcaaagatgtgattcataaataatgttggctgcactgattaattttataacaattactgcacttccaagttgatgcgaacacgcagtgactcatactcaatattaggcactagtaatatccttcaggcgtactacagttttatgttagctgtattgtacatatatatttttaaatgtatgcatttatacaaactgtgtatattatgtatggggtgtcagaaatgtacacatcactgttatataatacacacatcattgttgtacatatgaggataagttttagtgcagaaagtctcattgcattgcattccatgtgttcaatctagtacacaatttgtcaactcttcagattatttttccagtacattcctcattagattgtgggtttcaagtttccatttgcaatttgaatgtttccagaaatctctgtcttaaccaaacctctctctccaggcacgattctgcacatgagtctgatctgtgtagagtagtatcatcaaaaatgccaaattttgatcaggaatatacctggactactctctttcaaaggcaattgaacatcgtgataaaggatagcatctattcaggtcatggaaggatatggtcagttgaacttgtgttgaactttggaggcaaatgtacgtcttcaaataaaaagacatggtaataaaaattatttgcttaaatttgagagtctctggaaggatatacatcaaactgtgagcagtggttgtctcaggcagaagggacaaccagggacttacactttctactttctacatttctgcactgtttgagtttttacaatgagtagatattacttttctaattagaaaacacaagaaaggtatttcaacttgaaacaaaactaaacaggccaggcatggtggctcatgcactttgggaggccgaggccaaaggatcgcttgagcccaggagtttgagaccagcctgggcaacatagtgagacccccatctctacaaaaaaaataaagaaaaaattagccgggtgtggtggcacgtgcctatcttcccagctgcttgggaggctgaggcaggaggattgcttgagcccaggagtttgaggctgcagggagccatgatcgcgccaccgcattccagcttgggctacagagccagacccggtctcaaaaccaaccaaaccaacaacaacagcagtaacaacaaaactaagtaaaaggaacaagttatgaatgactttcacaagcaacaattggaggatggttactaaccaaaatcacccatgccaaaccccacagaaactgctgtaccaacgtgctccacacgtgctccacagatgaaacaagacagtcataagaactacacgctctgaccactgcccacaacggtaagtttcaagaagttttcctgggaaatgtgggccatcagagtgctgataaaacactgctggcccacctgtcaaatggggcttcacagggaagctcatcacatagatgttacaacaaagtctgcaactttcaaggtgggcaggaccagagaagctctccaggtatgcaggatagacctccagggccatccctttatgtgtttgaatatttcatcaggattcttcaagagtaggtagaacaaagcctcagtcctccaaaaaaatgactcaaaatttcttaagttaggttcaagtttctgacataggatgggattgtgaactctgccaaaaattagtgaaagggctgggtgtggtggctcacgcctgtaatcacaacactttgggaggtggaggcgggtagatcacctgaggtcaggagtttgagacgagcctggccaacatggtgaaacccagtctctactaaaaacacaaaaattagctgggcatggtagtgcacacctgtaatcccagctacttgggaggctgaggcgggacaatcacttgaacccaggaggcagaggatgcagtgagccgagatcgtgccactgcactccagcctgggcaacagagcgaaactcgtctcaaaaaaaaagtgaaagggttgtaagaagcaccccagttggagacatgtaaaatggaaattctcttaatatttccaaatgcttgaaggccaaagccaaatgcaaattccacaagcccttcttattttcaattaatttcaaatcatctaagttgttcagtcatttatacaattttgaatcagtgctcagagctaaggaattatgatgatcttacttcccacctacagatcaggctaacaaaaatgttaacactgcaaaccaacctgtaagaatatcagtgaatgtttatggatcagcatctagtctaagtattttgtgccgtcatcaccttgaaaaaatggattgcaccacatattacaccgcctgcctttctcagaccgtcctggtgcaactttatcaagtaagaggccacaaggacattatttttgtttttaacgtgtggcaagatagaccctctttttcaggagttattttcttttcgtcaagatttcatatccaaatatatttaacaagatgactaaatctagggcataagacactacaaaagaaaaaacatcagacaaaaactgtaaacaagatgtcaaagaaactaaaatgtaaacttaattaaaaaaagaaaacaagagaaaaactcagagcaaggtgtaaacataccagacacacaggacacaggaagaggctctggttgctgctgccccagaaaggaactgtgatcttctgcattgcaagcagcctgctaatcaaagcctgaaaaatcgcccccaaatcaaaacgcatcaaagggctgcaggtgcacattctgcatgaggagtgagagaatcagcattatcatggcaaatagctctcagcctggtaagcgaaggattcaggctcctactgaagggacaatctaggtaatggcctcatttagccaagaaaatctgtaagaaagctattggtggaaagaaaagacttgaaacagattggctgacaaatgccatgtggctctacagccaccgagtcacagtggcaggaagaagaaatgcatgtggctggtgggcttgttatcacaggtgcagaaaacttcaactcctaactgagctccaacacacaggcactgctaccttagtgtctgttaactttcaaagacgccgcgtttttgctaaatctcagtgccatttgcatactacttggaggtggggctgggaagggctgtgagtgtccatctgtttgcctggaatgcatttagttgataatagagtcagatgggggaagggaattagaggaagagcagggtatttggtaacatgcaatctagtaaacttccggcacaaaaatacctggcttattttcattattcaattacccattaatacataccaatcaaaaaataattggggaatagtatattaatactgaaagtaatcaacagtataagagcaggtccatcttcactggcagtcaagcttttggtgtgctgtattgcacctggttaactaacccatgagattttggttgaattttctaagaagtcacggtttagcactggaatggaatagaaagtgtgtgtctgtgattgtgtgtgagtgtacggtgtgtgtgtgtgtgtgtgtgtgtgtgtgtacttcctctagtcagaaacctctgatcactttgtctagcctgggattatggaaactagacaaagaaggtgtgttctgaagagctgtgtatcttacacacatacacaggcggcttcttatatacccacacatacaaacacacatgccctgcaaaagatcattgttcaatgctgaggaaatgttcaccgcagtctgataaatgctgtggctgggagtttcagtagcacagtgtccaaaaacgttgagccatctgtggagaccagagcccactctggccccagggtgaggtccctatgacaggtgggcgctgttccgcagccagtgcaggccctgttgggagtactggaccaggtgctccatgctgctgtgcagggtgaccggccccatgagcagatccaggtcgttgaagaattctagggggacagaaagagttgttaagaatgccacacatgctaggtgtgctatcctgagcaactgatgtaaggaaaaattccattcatggtctctatataaatcaaggattctccgttccatcatgtaactttagcattcctttgaacaaaataaaatccaaggatggggaactcatcctatatccaaataaataaatacatgatatctgccatttctaactcaaatgaatagtatttgcttagccaaatagcaaagaaaatccatatcctccagctgcattctcctagtccagtaatgcttcccactcctgaacgtgaacgtggctctgtcgtccctcaccctgtactcaattctggtatgcgctgagcccctggagtgagtccaaggggtgaggctccaggttcctgggggcaaatcagagatgggtcacgagacatctggactgaagtcaccttctagcttttgaacattccctaggtttgccctttcaccaaatgtttatgatgtggccaagcacggtggctcacacctggaattccggcactttaggaggctgaggcgggtagaacgcttgaggtcaggagatcgcgaccagtcaggacaacatggcaaaaccctgtctctactaaagatacaaacaaacattagccaggtgtggtggcgcacacctgtaatcccagctactccggaggctgaggtgggagaatcgcttgaacccgggaggaggaggttgcagtgagctgagattgtgccactgcactccagcctgggccacagagcaagactccgcctcaaaaacaaacaaatatctatgatgtaccaaggcactctgctaggtgcaggggtgggtaggggatgatagcaggatgaattgtgtgggctctgctgtctcaaaatcacagtttagtggctgatagaggaaaacacattcatatggctactctactgtcatggctggtcactgcatacatttcttgggagtaagcatctgggagaagtgtctcaaaggtcctcacatacatgctgaatgaagacttgctggggcagggatggggaggtggctaggaggttggccagggcagggatccaggggtagaacagaggaggaggagcaggtaggggtaggggaacaatgccaagtctgcactggacacttggcactgagccctctggtaggagacatctagcaggcagctggcagtgccatctggagcttggcctgctcacagtctcccaaactggacacgtgtatttctatacatttgtcctttctgttttgtccactggtgacacccaccccacctatttcagtcactcaactgctaagcgcttttcttttctttattttttccttgagatggagtctcgctctgtcgcccaggctggagtgcaatggtgcgatcttggctgtctgcaaccactgcccgccttccaggttcaagcgattctcctgcctcagccccctgagtagctgggattacaggcgagcaccaccacacccggctaatgtttgtattttcagtagagacggggtttctccatgttggccagcctggtttcaaactcctgacctcaggcgatccactcacctcagcctcccaaaatctaagtgcttttcaaagccctgttccatggttccatgccagctcctctagcaagctcctcctggtggcttctgacccccatggcattctcattggactttctctgggctgcatgttatgtactatgtggttttatttacaatctcatgcactctgccatacattccttatctcatcctgaacatcttgctctttggagctatcatgctcccatgctatcatgggaacatagtttgcatttcatggagtgaactcagatttgcactcttacctgctgctgtagggccaatagtaaattagtataatctttcaggagaagagttaacagcatatgttgatatatataacaatatatatcttaagagaatctgtatctgttgacccccaaattttattccacaactccctcctaagaaaataatcagaaatatggccgggtgtggtggctcacgcctgtaatcccagtactttgggaggctgaggcaggcagatcacgaggtcaagagatcgagatcatcctggccaacatggtgaaaccccgcctctactaaaaatacaaaaaaattagctgggagcggtggcacatgcctgtagtcccagctactcgggaggctgaggcagaagaatcgcttgaacccaggagacggaggttgcagtgagccgagatagtgcccattgcacttcagcctggcaacagagcaagattctgtctcaaaccaaaaaaaaaaaaaaaaaaaaaaagaaaaagaaaaagaaaaagaaaataaccagaaatatgaacaatgacttatgtagggatatttacaccaacattatttgtcacagtggaaaaaaattggaaggaacttaaatgtctaacaacaggggaatggtttgagaaatcaggatactttgtgactgtataatcaatgtactaggatattattatagaaccaccataaagggtgtttttgaactagttagtgacatgagaaaatgcctgatataatgtcaaatgaagaaaggatatacaactgtgtgagtatcccagctactcaggaggccgaggcagaagaatcgcttgaacccgggaggcggaagcccctggttccccgtggggtgtgcgctcacctcggttttccttggccaggttgtcggccatctcccagtagtcgtagctgtgcaggatgctgttggtgatgctgacgtggttggccgccatctggtggatgcgctgtgggatgctgacgatggtcgacggggacagggcgctggcgttggagaggctgccctgagaccccacggagctggcgggagaggggttgggagacatgggggatggggttccagtgctcctggaaggggagaggtagaaaaaccagagtggcgaggtcgggagcaagcgaggcagggcagccccttggggaacagaaagcaaagcgcagtggcccagcaccatgcattgtctggcttacggcattgactttggaaaagcgaacttactttccactggccccccacggagatggggcttgggcggctttagatgagttctgcaagaaaataaaaacactgacagtgagtgccatctgcgtgaggtgaaacaggtgacatgaacgtgttttcaggtgactgcagagagaagcaaaggcagacactgcaggaaaaaggcaccttcagagaaactggacctgggaagtctccatcacagttctctgttccctttctggaagggagtcgggacagctgcctggacttcggaagtttaacagtatttctcttaaagggagttgctcttgaacattcctaagagaatatatttaaatgtatttccctagcagacaggatactcaaaagttctagtttatctgaatattctgatttagaagttattttgcatggacaaggtgcctgcatcagccctcagtgaggtaagtgaagggcttcacccacagcctgggtttttatgtacaaattttaggtaccacattaagtcataatcccaacggtctgttaaatcttgaagcagccttactttttcattgtaaattaatttttcttaaaaggaaaaaagagcaggaacaccctcatatctccccttatatacaatactttatatttaaaagtaggacatgtttgcagaaacagtcgacatacatttacttagtgcctgaaaatacatgacatcagattgtattgttttaacttaggaagtttaaaagtatttcttcttaaagtaagttgctgttgcatattcctaatagaattgattaaaatatatttccagaacagacaggatgttcaaacattctggtttatctgaatattctggtttaggaagttctgttgcacaagccaggtgcttgcatcagatatttaaaagttttgcctctagttagggaagttgctcaatgcacagttagatttcccctctgagaacccaatcatgccttcataggactgttaagggagaaagcggtctttgtgatgctgatgggagttttccccttccagagacaagaaaacagcctcagcctggttctccagagacaacatgtttcttttggttagaaagaactttatggagtggtgactgatttttctggttttagtgcgggtgttattaaaatggcaagaaatggcctgtcagaactctgaggtgctacaatggcaagatgtaaatgtaaggacaacaccgcaaaccatgccacttttacctgtgtcaggaaatacaattattttcatgaggagaattaggaaaccttcctgaacaggggagcttatcctccctttcttgacacaatgttactgacacctttctcaagctggtgctactggactgatcactttgtttccacttcatcctgtggttctgagaacgtgatctatagaatgcatgttctggatataagaacactaatggcagaaggggagaaaggcttgggggttgcagaaacagtccagtaaaggctactgaatggaggaagaaggcagtgactcacgcctgtaatcccagcactatgggaggctgaggtgggtggatcacctgaagtcaggagtctgagaccagcctggatgacatggtgaaaccccatctctactaaagatacaaaaaattggccgggtgtggtggcacacgcctgtaatcccaactacttgggaggctgagacagaatcgcttgaacctgggaggtggaggttagggtgagccaagattgtgccactgcactccagcctgggtgacggagcgagactccgtctcaaaaaaaaacaacaaaaaaagaagtcttgagttctcttcctctaccactaagccccatgcccaagaaataccggtaggaacaaagttctttttttttagagatagctctgtactgataaaacacatatagccaaattgtcttgggtacctaaagatttcatggtttctgaactcaaagtagcatttaaatagcccttgaggctgggtgtatggctcacattggtaatcctagcactttgggaggccaaggcagtaggctcgctggaggacaggagttcgagaagggtctggacaacacaaggagaccctctgtctacaaaaaatgaaaaaatgagctgggtgtggtggtgtgtatctgtggtctcagcgacttgggaggctgaggtgggaggactgcttgagcccaggaattcacagctgcagtgagctccgactgtaccactgcactctagcctgggcaacagaacgggacagaaaaaaaaaaaaagtccttgaaactttgtatccaagtttcagttatcaggaataagttctggagatctattgtatgggatggtgactacaattaataatgatatatagtatacttgaaaatctctaaaagaatcgattttaaatgttcccatcacaaaaacggtaagtatgtgaggtgatggatatgttaattagcttggtttaatcattccacaatgtataaatatatcaaaacatcacattatacataagtacacgcaatttgttgttgattaattaaaaaaattttaaaaatagcttttgatgaagggtaaatgacattaattccttgaggagcaactctgattttctggttgtgttttccttttttttttttttttttgagacaaagtctcactctgtcgcccaggctggagtgcagtggcgccatctctgctcactgcaacctctgcctcccgggttcaaacgattctcgtgcctcagcctccctagtagctaggattacagatgcctgccaccacgcctggcgtgttttctacccattctgtatgtattagtgggctgcagagaatattaagaacttgtatcccttaaaagtttgttgtagcccctggcggcttacagaattcagcttccttctttattcaagcattttccttgactgtaataattctctttagtagtagatcttacgttctggatttttgaacactattgatgttgactttaggcacctgaaggaaagggaaggctcagtgctggttcttgtcctgaagacacaggacggtcaatgggctgagaaagtgatgtccatggcctagcacctggttactctacatgcacaattggaaggcagtgtgctgaacataccccaggaacccccagcacagcctggccattagagatcacctctagaggaggttgggcatgaacagatctcaaatgatggttgtgtatctgacaaagggctgttggagatagagacggcataatttctagtttctatagataaacagagaagaggaccagaaatctcaaattaattattaatgtaaggtcgacctcacaacagtacatcagcgaaggcttttaaaaatttattctcccagtgaaaataatttcattccctgagataagtaaaaggtggcatggtttgcaattttatccctatagctacacactgctatctactgcttctgagttctaacaagccatctcttaccattttaaataacgccattaaaaattaaataagctactagagactggctaagagggaatggctctaaggggttacttctaaggaaaagaagctctaagtgagcatgaggaatttatgttagctataaagatgaatttcctaggacagtggaacgagtaactggatcttctttctcttgaagccataaaaatacctggacaaggctgggcgtggtggctcacacctgtattcctagcactctgggaggtggaggcggggagatcacctgaggtcaggagttcgagaccagcatgaccaacatggtgaaaccccatctctactaaaaatacaaaattagccaggcgtggtggtgtgcgcctgtaatctgagctacttgggaggctgaggcaggagaattgcttgaacccaggaggcggaggttgcagtgagccgagatcgcaccattgcactgcagcctgggcaacaaagagtgaaactctgtctccaaaaatacataaaaaaataaaaataaaaaaataaaaatacttggacaagaaggcagggagatacattagatgggctctcaaaggtccattctgaggcctgaaagccacaagtgtggcataaatggggttaccttggggaccagaggtgacctgcattaaccccaaagcaatggagtctaccaggtgcttcacaaatttgacagggagacaagtgaaattaaggaacaattctgctcattcactagacagtaccttgaaatagtcgattagtgcttttgaatactttacagcgtggtcccttttgagtcgaaacatccgccagtacaggagggccaggcatcggtaactgcaggcgaaaagagaaacaggcccagaagcggctgagtgcgtcgtgcgcaaacaagacttaaacatttttgttgttgttctaaggtactcaataacaataccttgtttctacataggaaatctttctatacgtgcatataatgtctgtgagggaacatcttttgtccaaaaatagaattcaaaattccaagaaggtattccataaatacatttatcactagataattttacagcattaggtgaatcactctgttgggtcacaggggccggccgcttccttcttccaccacgagagggcgctgtctctccacgagaggcgcgaggtagctctagtacgcagccttcactgcttcgcgggcgagccccgctctgcggaaaggacgacgctgccacctgatgttactgaactataagcagctccactaaagtcacaaacatgaatgtactttataaacaacaaaaacactatgctgggaataggtgccatcattataaacaacaaaaacactatgctgggaataggtgccatcattttattatttcctataatattttgtatacttatttatatatcagtattctatcttatataatcatattattgtcatttagtgtattattccaatatgggacttaaagtttgaaaggggcacaaaaggcgtttctgagacttatcctctcttccttggagctcttcactcagttatttgctaactcggatctgatgctgacatccagaataccaacattctgggtgcaatggcaccatctcctcctaccaaccaaatccaggacaggtaacaatttgagaccttttttgtgtctgttgctgttattattattttttaattcaactgtctttatttcactgcttggtagacatgtattctatcaacattctctgccttccacctactgatgagtaagaaagggctgacaggtaaaggaactataggttacccgatcgttcccttttttctgtggcatcattttcaaagtaagcggctgcgccgggtgcgatggctcacgcctgtaatcccagcactctgggaggctgaggcaggcagatcacttgaggtcaggagttcaagaccagcctgaccaacatggtgaaaccccatctctactaaaaatacaaaaattaggccgggcacagtggctcatgcctgtaatcccagcactttggtaggcctgtcgattttcaatcactgtgaattcagatcatgtatagtacggcagcaaaaaatggtctggactttccctggtcattagaactgctctggggctttgtatgttagaagacattgggcaaacactatgcctttcagcacctggtttgccaatgatggcatgcgaggctggggctgctattctaagcggagatgggcactcaccataatgcagccagttgtttgtcttctggtgtggcattggggcctgagtgggtttttagtctcatagcataccttagaaaaagcggggaggaggaatagaataaaaaacataaaaagcaaagaaatagtaaaactagcttttttattaacagaacttctatgatggtagttctccctgcctgatccttagcttttcatagtacttgctgataattctttcttaaaagctagctggtgctgctccattttcccaagtattacattactgtgatgactagaacagctactttctgctctttaacagtacaagttcaaatgctacagattgtcgggagtgataccagttcaagaactattcatgtatatgctaacatgtccatttttccacattttgatttatggctgagtgtctgacagatggaggtgaagttctatccttctgtgcttacctccagaagaatttccatcctgggtatgcagaggaatgcttagatttacccctctttctttgttatgtaacttttactttgacagctacataagtgtcctgagtacatttttaatctctgtttgcttctacagacagatactacgagaaactagtggcttttatggactgcacttaattccatttatttttctgaaccaaggggactgtggccattgctttctcccaacaacataccaaattacatatgcagactctttgagagagctgaggcagtatgtgtaatgatcagattgtcctaggttcaaatctcagctcagcgacttataagttgtaagtgcttagacaaatgtattaacatctttaagcctccatttccttatctataaaataagactaatactgccaatcacataacattgtgttaagaattaactaagatagcgtttgtaaagctcttgggatagttggctggcttgtaaattgctcaagaaacatactgttatcatcgcactatctcctcaacatgcagacttgtagcatttttcagtgttatctctttgcataatttttacagcggttgctctggattttacaatatacatgtaatttattggtatcaacattttatcactttgggatagtatggaagtcttacttcaatttagatacctttaccttccccacttaaaaatagcattgtcttgagtatcagatggtggtataattttttattgttttgttttgtagcagtggggtcttactatgttgtctgggctggtttcaaactcctggcctcaagctatcctcccagcttggcctcctaaagtgctgtaattacagatgtgagccactgtgcctggactgctggtataatttttgtttcaatcctcaaacctggtttataaactcataaggagtagtttattgtatatatatctatgtgtctgttcttccttctttcccaatgctcccatattccttcttttgtcattttatttctgtttgagaaacttcttttagccagtctttaagggtgggtcttttagagacacatacttgtacttttcctaaatctgaggctatctttatttcccttcattcttgaagaatagtttcactgactctagaattcatggcttcacagttccttctttgaacccttggaaactgtcacgccactccctcccagcctgcatggtttcagagaagcctgctgtcattcgaattgattctcccctgcagataattatcgtttctccctggctgctttcaggatatttggcctttagtttttggaaatgtaatcatggtgtgtttttgcatgcatttctttgggtttatcttatttaggtttttctctgcttcttaaatctgtaggtttatgtcttttgacaaatttggcaagtttcagccattatttcttcaaatactctctcagtcctactctctattcctctcctctgagacttccatgacacaaatgttggattttttcttattgtgcttgaggctgtgttcatttaattttttcagtctatttcttctttactgctcagattgggtaaattatattttttgtcctcaagttcattgactctctcctgtcatctccactctactactgagtccatttttggggtttatattatcaaattctacagtttcacaatttccatttagttctttttaaaataacttccatttctttgaaaagattttctggttttgtttgttgagtgataactgtgattattgaagcatttttacgatggctgctttaaaaatccttgtcagataattgcagcaactgattcatctttgcattgaggtcttctgatcatcttttttcatgccagtggtgactgtcctagttcttggtatgatgagtgagttcctatggtatcctggacattttgaccattaggttaggagactcttgagtcctattttaaacccagccaccctgtttaggtctagcaggaaggccctagcctactttgggggctgtggttccaatgataatttaattttcagagcctttctgatactattttagtctgtgtggttgatctggtgccaccggggcttcagctcatccctgatggtactgcctgcggagagtggaagggtgggaggagagggtcaccaggctgagctcgtgtggtggcagtgctccactgacccacgcctgcttggccatctggagttccctggtgaagggaattctgcccgtagggacaaagtgtacatcctgggctaggtcatcttggtggtgagaaccccttgccagcgctccaggcccttcagtgtctcagtaggggagaggagggtcaggcagggtgggcaatgtgcggatgtaattaatgctgttttcttttttttttttctttcttgagacagagtctcgctctgtcgcccaggctggagtgcagtggcgcgatcttggctcactgcgagctccgccttccaggttcacgccattctcctgcctcagcctcctgagtagctaggactacaggtgccggccaccacgcccggctaattttttgtatttttagtagagacggggtttcatcgtattagccaggatggtctcaatctcctgacctcatgctctgcctgcctcagcctcccaaagtgctgggattacaggcgtgagccaccgcgcccagaaaattaatgctattttctaatgtaggttgaaaaaagagctagccaggtgcggtggctcacgcttgtaatctcagcactttgggaggccgaagcaggcagagcacctgaggtcaggagttcaagaccatcctgaccaacatggagaaaccccatctctactaaaaatacaaaattagctggatgtggtggtgcatgcctgtaatccgagctactggggaggctgaggcaggagaatcacttgaactcgggaggcagaggttgtggtgagctgagattgtgccattgcactccagcctgggcagtaagagtgaaatttagtctcaaaaaaaaaaaaaaaaaaaaaaagaaagaaagaaaaagagccaaatttgtctttttgtctttgttttctctgtattttgcgtgattctatcgattctgaagtatctagaaggtggacagtgttctctacctgtgaaagattacttccatcagtgggcacagtgggtgtggtaccccagcaccctctctttgatggtatatctggctggcatggttttttgtttgtttgggcttgcttgtttgattttcaagtgtgaatgcctttaagcaggtcatgatactccagttcacagcaggccctatggcttgcttattcattgattccttaattgtttattaagcacatactatgtgccagaaaatattcgaagggctgaggattccccagttagcaaatcagacaaaacccaaaaaactccctgtgctcaaggtactcacactctagggcatcttccagctttgtccctgtccagtttctcccactttcctccctgcctgcctatgaacatctcaggctgggccttgttctgaggaaggaatgtatggatctaggatccgttagagtaacttttaccagtctttttactttgctgctttcatttcatcactactgaaagtaatgtgccatataaaaagacagtataaaggattcaccaatatattgatttagtagaaatactttattaagaaaaatgggcagtgttgactttaaaacattcttgaaaaatgctttatggaggtgatgtgttctctgatgtcggcatgacagtttcaaaggctggaaactatttactgagggaaagtggtgtgtaaaacaccaagtagcatctttgggccaatgtagaccaaaaagatcacatcctaagatgattagaaatcttccatgcagaatgtttggacatggtggaaaatgtctaagctttgattgcacagaaccccagaatcagaaaaacttttaaaagttagttttaggaagaattatttctcattatggatattagacattatgtcaagcagttaaactggctaaaaacataaaccatactatgaaggttctcagtagggctaatggatgaaattcccttaactgttggttacagagatgtgatggaggtgcctttccaggtctccatcatggaggataagtgtttgccatcgaatgccttgacacgtctgctcacaggtcttcacccaggtttggggatggtgcccatgtccagtttttagaccagacagtataagatggcttctccttccataaaatcctcctgaatgttcttccattaaatactccagaagtatttactgatggagctaagatttagatgatactaacctgaaccagatttttttttttttttaaagcagcctagggctgaaataggctcaaaatctgccacttcctagctgagaggagcaggcatgtcacagcccactcagactcagcctcctccctcagcaattgggggctacagcagctgccccccttgctcacggaggacagagggggcagggtgtgccaagacgccttgcacgaccttaccctcttattttggggggatgaacactggttcctggtgggggatggtgcaggctgacattcttttctctgtaaccatagtgcttccacacattcctcactcctcccctcatccagcaagaaaacacggtgcttacctgatgagctctactgtttctgaatacatcgtataaggagatttggattccatggggccttgttccattgcatttccacactcgataaacgacaatgctgcttcagcatagttcaaagcctttccaaacttttccacctgatcaacagagttaatacagtgtcttcctaaacaatagttttttttaaatggcattgtcatgtagtttatacaccttatttgagaaacccaactctgacttctaaaatcctatgaagctgagagaagaaagaaatagaatacttcttttcctacttattttctcaaactgctactggcttggagtaagtgagcgaacagttatatacagaattgtatcaaacccatgtgacagctgtcaatcaacagagctcagaactgcatggctgctctgatttctgtttccctctttctaacccctaatggtttggcgacttcattccttgttcctccatgctatgctaaatatgcatcaaagttggtaggtctggtcccatataagagttttcatacttcttttggtacatccccaacttggatggttctaggccttggttattatcttttacattatttgtggcacttatatctccatgccttcctcttctcaattttttttaatttttttatttttgagatggagtctccctgcaacctctgcctcctatgttcaagcgattctcctgcctcagcctcccacgtagctggaattacaggcaggcataggccaccacacctggcctcaattgttttttttttttgttgttgttaatatttagaacctcacttaagagtgagagtgagtaggggaaaggagaggagataaacctcaaggagctatttcagctttgctaaaataggacaaaaagttgaaaattattaataaaaatgatttttggttgggcctggcggctcatgcctgtaatcccagtgttttgggaaggtgaggcaggaggatcactcgagcctggaagtttgaggttccagtgagctatgatcgccccactgtgctccaacctggataacacagcaagacgctgtctctaaaggcaaaacaaaacacatttctacgggattatctgtagctgtcgaaatttgtgttattctttccccacatcagcaagggcagccacaaatcagctttatattcttaagatctcatcagtctaaacttatgcatcaagttcctggttccataccttactactctttgtaggtaattacatattctaactctggattgcagaatctccccagttttcaaatgattcattcatcaattaaaacagaatgacataatactcaaatactattccaagtcttgccactaaaaatacaaaaaaaacttcattagtaatgatagcttcaaaaccagaaatgcagagcaaaacttcctctccttagcaaatcaaaattttaaactgcttataaaggtagtgtaggctataatgcaacatttcttttttcttttttttttttttggagacagggtctcactctgtcacccaggctggagtgcagtggcatgatcttggctcattgcaatctctgcctcccgggttcaagcgagtcttctgtctcagcctcccaagtagctgggattacaggtgtgcaccaccacacctggctcatttttttttttttttttgtatttttagtagaaacagggtttcaccatgttggccaggctggtctcgaactcctgacctcaaatgatccacctgccttagcctcccaaagtgctgggattacaggtgtgagccaccgtgcctggcctataatgcaacatttcttgataacactttcagatgaagtcatttcatttagtattaatatttcctaaagcacccaattctgtggtatgtgcactccacaagcgaaagctctttccaggaacatataatagacttggagagagaaaatgtacacctacaagacagttcaaagtgcaaggcagtctgtgattacccaacaaaatacaaaatgaggcatccagtgcaaatgagatggaggaaagtgagctagtgatggggccgcagagaggctgggaaggccacagggaggagactgaatatgacgccgggaaggaatggtagggtttggctagatttggggaggatgctgagggtgtgagtgtgcccatgagagtgtgtgagagtgaatctctgcaggtgcaaaggcccgctggctggcaggagcaaggtgtgcttagaggtcagtaggggaccagcctggctggagcagagtgtctcctcttgggaaatcgtcaacaggaaagatagggttgggcaagaggacaatgaatgaataatgctgtaaactttagatgctggattcaggcagaaaatctctttctccttaaaaatctgatgctcttctccaagagtggccattcattggcttctccagatgaccagaactgtccatcagactcagattgtgtggacaagagctgtaccttccgctgccctcctctattttctgatacgtaggggttattcctcctgtaccccagtgtacataggcagtggtcttcacgtaaataagtgtttaataggtgacactggtagcattggaagaggggtactgttactgtttaaacatcttcagtattctgaaggtcactggaaatgccttcttcatttccagcacctgcctcaatctcagttatgaacactggaggagactaaaactggaattactaggtgggaagatgtccctttggacttcattcatttaagatggaacaaccacatgatctcttttagaaaagaaaacaaagttttccatctcttgcctgagagcttcaagctttccaaaacaggagatcatccaagcaagaaaagttattctttgaaaacatcaaatcatggtgactttagagtcttacgtgcagataatagtttctgtgttgtacagtttcagagaaagcattcatttcggcagatacatgtgaagaacacaagtgtttttgaaaagagatttgatcctgggaccaagccaagggtttgtcaggctaacaagagaaaaatgcaaatctagattttactttttaaaggaaaaaaaaatactaccgcccactgcctccactggctctagttactattcaaaccttaggactaaattgaaatattcatttgtctagggctttttcccagtcaggcattattggttgaagtcatactttattgggctatgaacatttgattatataaacatttctccattgaacagacccggccatccttgtaatagattttataattaccccagctatattgtcccagtgatgaagctgcagtacacacataatttggaagaacgtatctggaaagaaaagggtctcaccattgcatctgctttatgcttcattcgtttagcttcttgcataaaataatcggcactgcgaggcctacaaggagagaatgatattaaacgtcattatggcttaagtgcaacgtctttttaaaatattccttcctttcactcaaacttaaggcacaatttaaaaactctgcttaatgcggaattaagtgtgttttttgcctttccaaactactgcctgtatgtcaaataccacaatacattttctcttaagttagcaattcgaaacacactcaacatacgccagtagtctctatttacagtggatttaacatggccccctagggcctaatttgtgaatatatttttttattgtatggttaaaaaaaaagcgagaaatcttattttaggtaatatttacataaaacaatccccttttaatgtaaagattgtaaatatacctcataataattgtatggctatatatgggtgagtatatttatgtatccttatgaaaataagtgtcatttatatgcatatctagtacctagagttttatgtatatattgaattatcttaaagcctcacagtgaaaaataaaaagaggtaatgttggatgattacattccagttgtaatgaagttaattgtaaaatgatgtctaccttgtaacaatgcaaacatgccatgtattctctagagttctgattagctagctggtaaacattaacagcagacatgtggattattaaagcaataaccctggccagcggtgactctgccgggagatgaaggtaactcatccagagactgatttgagtgtgtgtaatgaggcccagttacgctaaggtactcattagacagtatctttaagtgtttagcccgatagattaaaaaaatgacatttttaggcaccggcagcataaactttatataatcaataaacttgacctattcatgaatatcaaatataagccaggactctctgaacgggagattcgacggaagtagtgatattaatcatggactgtttagccaatgattacatgcttattttgaactgccttatttcagatcctaatgggtcttttaccttattgtaatattaggtagtcagaacattcatgtatccaaagaggtcaaaacgcttagaaaagcaatgtgtgacaatgacattgcattttaatcaaacaaaccagaatcacagcatagttttggggtcaaaatgtttcctcaccccatccccatgcccccctctgagggctggagccgtccattcattgtggtgggtctttcactgagggtgaggcctgaggtctccttcctaggaaggccctgctcctgccactccgttttctctcttgcatctcctgggtgcccatgctttctccatatgaatggctttgttgttgccttggtgagttttccttctttgtccacatattgacacatattgtaagaatgtccatatattgtctggtctttggttccaactctggcaattgatgttatttttgttgttgttttttgagaaaggttctcactctgtcgcctaggctggagggcagtggtacaatcacccatactgcagcatcaaccacctggggttaagcgaccctcccaccacagcctcccaggtagctgggactacaggtgtgtgccactatgcctggctaactttttgtatttttagtggagacggggttttgccatgttgcaaaggctggtcttgaactcctgaggtcaagtgatccacctgcctcggcctcccaaagtgctgggattacatggcttccatcacatcaccatcctgctcacagacctaaaatcaatctccagggtctacgagataaaatctcagttcagatccccaataatcttgcccaacccacttaatcatattgcttactcacgaaggcccttgaccaaagtcagaggtggctcctcattgtcttgataacatggcatcctggtccgaggagctctgctcatcacttcccccacctggaacactctcctctctgttcattcactgagtgccttctaggagccgaatgttgcctggccctcaatttcccccgccgtaaggcgttccgagtaaccttggtccatgttcccctctgtccttcctgagctcacacagcacttcttgtttactacacttggtatttcattatcttctgagctgtactgggcatgtgtgcaacttgattgctggtacgtttttagtaaggaccatgctgtagacttctttgatctttcccaccctgtagtttttggcacacggtagaaggtaagcaggtctcccttgaatgaatggcactgaattcattttgagcttagaaaagagtggtgccttccgatggggtgcagcatcgcatccaatgagccagagagtgtctccatggcaacctgaaattctccacatcattatctgttctatactctagtatataagttaggtcattttttttttcttgccctgttttgtcactaacagttcactacttcaaatgcatttcattaaaggattatcttggtaataagctatggtatcttagtttccaccagccttctaagttacccttatggatggcagtggctcacaattcctaatataagctccttaatcaatattgttttcatctgcagcataggggcatatttttaaatcctgatatggaggctgagtcacagactctcaccatagcacatgtgggtaagtaacacacctaattttctgaccgtatcagagcagctataatcagagcagtaacctgagatgctaatagcataggtaccatctggaggccacttaacgaacacatttgttagaactctcatctttgcatagaatggagggctcactataatgagtcactgaagattgcctgatgattggcccattttctcctttcgagtgatttctagtgctgtacttccagagcagatcattataaagccagcaggaccaatgggatgtcacccagtgtccagccttgccacgaatcacaaaggcatcccttctgacagcaatacacaagtcagtaggaaaagtaaaattgcttgtcaccattgtgacagttatagaatataatacagcaaaggtactaaaatgagatcttatctgagtgttcaaatagattttccatctaatcttctattttttttttaacatggaaaacctagagttttcatttttcatttgtgtaataaaattcttcccattgtttcccacagtgatggtattttatgatgacacatgagcaaacctaataaaagtttaattaaacaccataaatggaactaactgtgaatcatgggctcttcagaaacggggcttgagtgatctgaaagccagagcttagctgcatgcatcttcattatgagagctctctccaacaaaagcattctgagcacttgatccaaatagaatgttttcttttcttctcttccccctcccaccacccccccccccccacctagaaacacacggtcttggttctcagcagcatcagggtttgagctacccccatatttcttctggcatgggaatattaaagcaaccttgctttttgttctcctttgtggccgggatagagttgaatggtctcccacggagagcctggcagactcctttctgtaattcctacctctgtgaaatgccgccctcagtagagccagcctgttttgtgaaaactggcagggatgagagctcaatgtgtttgaacaacaagttcctcggcgcggcagaaattggatgattttcttagggaagttgaaatccaaatcagacaaataggcaactgcataccaaatgaattcatcatctgctatccgatatgtcagcttgtcatctgataagccccagaggtgttaatatgtcccaagctttgaggagaatgcataagaaattaagtaattatttttaatacacagagtcagtgaagactatggatgagggcacttcagagtcagccactccaggatgctggcactgcctttataggcacttccccacagatccaggtagattgcatttgggtagcaaggattcaaacacagcttttatttccacaactttgatgtcggctggggctcagagtccctggaaccgggcttctcccaggcacaagcggtcattcactgtttcttcaggccacaggactgcttccctctcagccggccacagaaggcagggtttgctctgcaggacgctcaggctaagtggggcgggtgttgaatcaaaagtaactttctgttgaaatgggaaattatcaatctgatggttgtttttctctgagtgtgacatttaaaataatcttacaaaaccctaaagatgattggacagctgagatttcaatccaggagatctgaatgtccttgtctccgcaccctgtcccccgcacccctttgcaaatcctacttcatttctttctctctctctctcactcactcttactctctcactctgttttggttagaacaaaagaagctcctggccttgagacagggatttcataatgggagaaattccatatgaagaccaataaaggcttaatgattaatcaggaaaacaaaaaggtagggtccctgctttgaaaggactaggagaggagaccctcaagagaacatgcccactgcaagcccctggtgggggagcgccttcccagctgcaatttcgcctactcaaggatcttaattggtgtcctttgactaaatcatgctgctagggattcaaccttttacaatatgcgagtattcccatcctctataaaattaaaatcctttagctctgagactgctgtgcaagtacattacaaatgtcaagtccctcttccttcctcccggccacatttcacatgccatggccttcagcgcctggcgtctatagtcagtctttcctcactgtcgggaggttcaggtagccgggctcctgttacgggcaccatggggacagaagggacgtttggtggtttggctgaatgtgctgattgtgactgacttttccatgtgacatacaggcagcagccagcacttcctccagggagcggcaggcagccctggcacctggggttctctggcttcctagcacagcagaacggtgggcaggatggaggaggtggttttccagccaagcatctcaccaccacttagccctgttcaggacttctgtacggaggccttcatgacacagttgttctctctcaattttccccagccaagaattcccctgtcactaattatgataccaagtaacttacagctcatggctttgcactaataagatcagtttctaggcctcaagttgaatcaagtgttgtcattcattgacacaaattcttacagatccgttttttaaacaaaagtttgataaccacactagtgtcaccttaatactgtggctgtcaagtagtgaatgttgtgcgtttgcttaatgtcaggggaggaggtgaggtcacactgccaccaatatgagcccacaacatacaaaggacaggctgacctgattacatttttaaaaataaatgttattcttctcagttctgtctgtatcccaaaggaactaactggtgcctgtttacaggcattatagggattacaggcacatgctaacacgcccggctgattttttggtaagtaacctaggaaaacgggcttggaaacccattaatttacattcacctgcatgtagattccttatagtcatagaaaaaaaaaattgcaggcactcttccctgggaatgtaatttataattcagctgggttcattcaacacttgttattgagagcctactggcttcagctgttgtctgaatcccatgtttattcaaccattaacaagtatttataatacaaagagatgagtttacttttttaaaaaagctgcatgatgcggctttaaaaattaaatgacagtgtggcatctgttactttttggatcactgtaactggatttccatcaactcgaaatcactccagtgttaattatctagtcttttcttccactggtggcctctctttggtcatttcactgcttgtttttacaaatggctgaagttcactcttcaccctcggtgaagagaagtcaagggaggtgacagggctgaggtcttcctctgtcactgaggctgctggtggggaagctggcacagaatggaggtgggcaggaaggaggccgagaattaaatttagtaatcctaggaaaccttcctggagaggtcatcatgtgcctctctctcccctgaagaactgagaattaattaatcattatacttcagctcttgtgcctgtacttggcacttagtaagtgctccatatgtaccaaaaggaacctgggagacgttttgcacaattttaggtgacattctagcccagtgatctcttgaaggttgcttatttttactgcttaaaggaagagacgatgcctatttttgcttttttttctttaagatggagtttcactcttgttgcccagattggagtgcaatggcatgatctcggctcactgcaacctccgcttcctgggttcaagtgattctcctgcctcagcctcctgagtagctgggattacaggtgcctggctaattttttttttttttttttgtatttttagtagagatggggtttcactgtgttggccaggctcgtctcaagctcctgacctcaagtgatccacccacctcggctcccccaagtgctgggattacaggcatgagccaccgcgcctggcctatttttgcttttcaagcttgaagaatctttccacaactttcttagttcgatggttgagtggctgtttgagttgcatgtttattttactgttatggatttcaaatcagttgggacatatggcaattggaatgcgacatctatctctccatatgatggatatgtaacagtgtttttttattctattatatctatatccataaaaggagaaacagtttcattgtagctgtcagccaggaaaattatacacattgctaatgggaagaacaaatgataacagcctctttgttgacaccaatagtgacaagattatattagtttcagccatagcagattaagaaacatttcctcttataaaaagtccaagggctgccagccacggtggctcacgcctataatcctgcactttgggaggctggggtgggagggttgtttgaggccaggagttcgagaccagcctggacaacatagtgagacatgattttttttttttttgagacacagtctcgctgttgcccaggctgaagagtggtagcacgatctcagcttactgcagcctccacctcccaggttcaagcaattctctgcctcagcctccggagtagctgagattacaggtgcctgccaccacacctggctaattgttgtatttttagtagagacaagatttcaccatcttggccaggctggtcttgaactcctgacctagtgattcacctgccccagtctcccaaagtgctgggattacaggtgtgagccactgcgcccagccgtgagacgctttttctacaaaaaaaaaaaaaaaaatttaactgggtgtggtagcatgcatctgtagacccagctactcaggaggctgaggcaagaagatagcgtaagcccaggagtttgaggctgcactgagccatgctcataccactgcactctagcctgcgtgacagggcaagaccctgtctcaaaaaaaaaaaaaaaaaaaaagtccaagtacctgtagatcaaagtacaatcatttagttgttgctgtttctgacctagctttctggttcatacactggaaaattccttgcattttaatatgacatatgtgtttgtattttgtgtgtatataccatgctctcaaaaccacccactgcaagtatgcggtggtgtgagtacctcagggtctaatgctccttctgtttgatcatgttgttgggttatgacttccaaatgcaaatttctatgttatccttatatacaattttaatctcttctttttacaaatggctgaagttcacatgaacaatttatatcactgaaccctaattataaatgtagttggccacctgactgtactcccactccatgccctccctggggggttaatcaccacctacctccctggctgcttggcaaaggcgatgaagacagtgagaggaagcggggtggtgagggccaggagtgtgtgtggggtgggacgcagctgccaccacaggaagagaagaaacacacatgccctcctgggctgccctcaagccttcctaaacccagttaccttggaatgtgttcatttaacaaaacaaacaacaaatgtggatttggctttcacccccaaaaccctgtgccctaattagcttacaggagttcatgcaatacttgaagactaaaacttagtattttaaatttcccagggaattgtacagaggtgaataaatagatcatgccgagactccgggtggcagttagggatggaggagcggggcggacgatgaggctggagtagccacccctgcatggtgctttctgtgctccatgtgacaccccttaggagacggcatttaatggatcctaggagggccccgctgagcgagctgtggcatttgtcactgggactcttggacatgtagagccattttattttccagtgtccagtggggttagtggtttgtagtctgctcctcagctggactggaagccctcagagggcagaagtgcctatttctgctgctgctccaccccagagctgaatttttccttgttcacccagccatgtatttgacgcccgtaggactgctaaagctgaaaagaggattcttctgccttccaggcttgtccttgacacatacattttccctacgagccgaaataattttcagcatcattttatcatttctcatttgtcattttcagcctctcgagagcattccaggatgttgtttttattcatcttctcctcttgtttttcctccttttaaaatgatgctgggaatggaagttatacttgtgtgaaactgaaagtgctagaattgggtgaaggatgatggcatttttcttcctatataagaatcatttatactatgataaagaatatagcagttggaggaaaaaagctttcaggagtaaaacactattattcattgcctattataatttacaaaaacaacaatgcttctctttctagtagcataaaaccgccaacagcccaagtacaagtgcttagaagtgtaagactcattaatgctatttgcctttgttttttgatgtcctggatccaaccccattagcactgattattccgtctacccaaaaaccccaccaggactcaggcgtgcactcaaaattaaggctccaattccattcaagagggacatttaaatgaccaagtcccaggggaaaaaaaggccgcactgtagctgaaggtggccacaccaaggtgcccatgccccttccacctgagcagcttctgttctgtcttgcccctcaccacatttaaaagcgtctgaacttacatatcatcgaagacaagtttctgcctcttgcagtccctgtggccgttggagcctggagaccacggcttcgtctgcggccgtgacttgtggaggggaatgttttcagaattgttgtgagctgctttctaaacaacaaacaacacacatctttgagaaattggccacctggtgaagcgagcagcccatcacatacatacatacgtagaatatctttggctctacagaacatctttgtgtgctgtattagaattgatggtgattttgtctcaataaagaaatacatgcattctaggtatttgctgagggcttctacctgtgttctcaactgtcattcttatgacactatcaaaagggaagtcatgacgcctactctcacagatccagaaacaggcttggtgaggttcagcaagttgcccacactcagtgactgtggtggaggccaggggttagggtttagatgcccacttttcccagtccgctagactggaggctggccagttcagtcttcatcagcatcctccagggggctggtgaaaacacagattgccaggccccaccctgagagtctgggattcagcagggctggggtggggacctagaatctgcctttccatctggttcccggtgatgcggatgctgtaatcacccatgatcctggaaccacgctttcagaaccattcactcatctcaacagtcaaccagtcactcatctcacaggtttgctggttcttgttggctgtctgtgaagaccagaaggagtcaacaggaatcactaggaattacttaaaaaataaatcgactgggcacggtgtctcacacctgtaatcccagcactttgggaggctgaggcagggagatcacctgaggtcaggagttcgaggccagactgaccaacatggtgaaactccgtctctactaaaaatacaaaattagctagacgtggtgatacatgcctgcaatcccagctactcgggaggctgaggcaggagaatcgcttgaaacctggaggcagaggttgcggtgagccgagaccatgccattgcactccagcctgggcaacaagagtgaaactccgtctcaaaaaaaaaaaaaaataaataaataaattctaggccaggcatggtggctcacacctgtaatcccagcactttgggaggccaaggcaggtagattacctgaggtcaggagttcaagaccagcctggccaacatggcaaaaccctgtctctactaaaaatacaaaatttagccaggcgtggtggtaggtgcctgtaatcccagctactcaggaggctgaggcaggagaatcgtttgaacctgggaggtggaggttgcagtgagccaagactgcaccattgcactccagcctggacaagaacaaaactgcatctcaaatatatatgtatacatatgtgtgtgtgtatatatatatatatggaacacactagtctgtggaaaagttttaaaaatcacattacttgggatacagacatttacatggcacctattgtgtgccaaacacatggatcataaaacaatgtcagtggttaggaaatgcaaatggtttctctgaagtaattaaattgagtgtatacaaatgcttctttaaatagggactgcttttacgtgtagcactgtaagggttagagtctactgtcatagaagaccaggaagctcagatgtcaacattttaaaattgttcttaaactcctccagtggcctctgcttgctcttggtaaaaggagcgatcccagccaagtggcccctcagccattctttgcctgtggcctctgttccccagattcatgagcgtgtgcagttctttctcgggacctctgcacttgctgcttcctctgcctgtaatgctctttgtctcttagtatatggtgacttgccttttagagatctcgcatcaggggtcagccatctatggccagggagtcaaatctggccctttttttaaaataaagttttactgtaaaccaatcctgcctatgtatttatctactgtctgctttcctgctacaacagcagagttgagtagctgggatggagactgtgcagcccataaacccttaaattatttatctgactctttacagcagcagttctcaactggggcaagttgacaatgcccggagacatttttagttgtcaccactgcgagtgggtgctcatagcatctactgggtggaggccagggatgctgccaaacatcctacgttgcacaggacagccccaccacaagtaattactcagtccaaaatgtgaaaacctgcttcgcagaggccgggcgcggtggctcatgcctgtaatcccagcactttgggaggctgaggcgggcagatcacgaggtcaggagatcgagaccatcctggctaacatggtgaaaacccgtctctactaaaaaaatacaaaaaattagccctgggcgtggtggccggcgcctgtagtcccagctactcgggaggctgaggcagaagaatggcgtgaacctaggaggtggagcttgcagtgagccgaggtcgcgccactgcattccagtctgggtgacagagcgagactccgtctcaaaaaaaacccaaaaaacctgctttgcagaaagtttgccactcctaggactaattcaagctgctttgttataagagctcctagttctttgtgagttccctttttagtactgaaaccattggtggtgaatcatgcatgtgtgtgatcccctgtataaggctctctccctagaactgtaagcttcatgggggcacaaatgggatccgctggattgttattgcatctctggtgctcagcacagtgcccagcacgtaataagtacttaccgaatgagcacctcttcggtgaaaaataactaaataaaatctacaattggtttatagttctctgcgtatcatagttgctcatgatataaggatatagagggaaataaaaaaacttgagttggtggctttttgttccatgtttttctaatataggtcttccccaattctttcagtctagaattaaagaccactgctcccaagtgagggtgcacaaaaaaggttcatttcctgaggatgctgtaagatttaggctctcgtgggaacttccagcaacttgtaataatctttaattcatgggataaagtgttacacactgctccctccctcatctttctcatctttctttgcagaatcctgttcttttttttttttttgagacagagtctcgctctgtcacccaggctgcagtgcagtggtgcaatctcggctcactgtaacctccacctcccaggttcaagcgattctcctgcttcagcctcctgagtagctgagattacaggcatgtgccaccacgcttggccacccagctggttgtgataggcacagtgattatgacaggggagggtttggaagtaactaatgttcctgaaaggatgagtggtccaggaccactggctgttagaggctggcatggcagtgaagaggaactaacatgtagtgttagttgcttaggcgtccctaggtgttggagtttttttttttttttttttgagacagagtcttgctgtgtcgcccaggctggagtgcagtgccgagatctcagctcactgcaacctccacctcccaggttcaagcaattctactacctcagcctcctgaatagctgggactacaggcgcctgccaccacgctaggctaatttttgtattttcagtatagatggggtttcaccatgttggccaggctggtcttgaactcctgacctcaggcgatccgcccgccgcagcctcccaaagtgctgggattacaggcatgagccaccacgcccggtcggggtcttttcatgatattgtctcttttaagtcttatcactaccattttgcaggtaaagaaacaggagcagagagattaagcaactggcccaagatcacactgcagctaagaggtgaggtcagattgtgaacccaagtcccctgctcttcccctggggcgtgctggaatcacccgagatcactggaaaaggggtggtggtgggggtcccccactgcagctgcgacactggccaataagggcagagtgggggccctgtagctttcagtgtggggtttcaatcccagatttaactctgccctgggataagaaatttttcccaacagaaagattggttggttcaaactcctaatttactttgtcccgggatggtattactttgaggtcttttcttttcagaaggaaaaataaaatcttgcctaagcaaccgagggttagaactctccctcagggttcttcttccccgctctctgttgggacagtgaagggggctgtcctctgttgggtcttcctagaagcgggaggcattcaggaattctcaagggacctcaagcatgtgttcagactgtgctaggttagagacagagcttgggggtgctcaatttcattttggttttaattgggaaaggaagagcatcaacaaaccgtgaggtctccgccgtgaggctgcagctggctgtcggccttaggctttttgctggaagaggctgaagtaaacaaactgttgccattaggtcggctggaagaagttaagtcctcgctggtgtatttgtgtttagatgcatcagagaggggtgagatgggcgaccgaagcattttttcatttttatttattggtattgccacactgaaaaaggaaattacggtaatggaatgttacagagtcagcacagggaaaggtaaatgttttcatatgacccaaaccacccaactgggacctgttggtaggagaagcttattgggaattattataccaggaaacaagttaatggcattaggatcataacaaacaataagcaaatctcactcactctttcttttctcttcccatcaggatgagtagtaattctggagccagcaccaaagtacacgactaagactaataacaccttcattttccaagtcctttatccaaggatctcaaaatacccaacaaacaacttactgttttcctaacaagcataaggagcaagcagtgggaaagtcaatcaacaacaataaatgaattctacatttctgtctttttttgagacgggatctggctctgctgcccaggctggagagcagtggcaggatcttggctcactgtagccctaacctcctgggctcaggcaatcctcccacttcagcctcctgagtagcagggactacaggtatgcatcaccacaccgggctaatttttcatattttttgtagagatagggtttcaccatgttgcccaagctggtctcgaactcctggattcaaggtgcctcggcctcccaaagtgctgggattacagacatgagccatcgtgcccagccaaattctacacttctttttattttttatttttttgagatggagtttcgctcttgtcacccaggctggagtgcaatggcacaatcttggctcactgcagcctctgcctcctgggttcaagtgattttcctgcctcagcctcccgaggactcccgagtagctgggattacaggtgcctgccaccacatccagctactttttgtatttttagtagagacggggtttcaccatgtcagccaggctggtcttgaacttctaatctcaggtgatccacctgcctcggcctcccaaagtgctgggattacaggcgtgagctaccgtgcccagtccatattccacatttctaaaaagacttttgctatctcatctgagcttgtactaaatataatatagaaaaataataaaaccagagaacaacctgcaatatgtgaagccaattcttaatatctgagtttatgacttaaccagggattgatcagattaaacctagaatataaaaacggtgagtaggaggccgggtgtggtggctcacgcctgtaatcccagcactttgggaggccaaggtgggcgtatcacttgaggtcgggagttcgagaccagcctggccaacacggtgaaaccccctctctgctaaaaatacaaaaattagccgggtgtggtggcgcatgcctgtaatcccagctactcagctcaggaggctgaggcaggagaatcgcttgggagaggtggacgttgcagtgaggcgagattgcgccactgcactccagcatgggcgacagaataagactccgtctccaaaataaatacataaataaataaaataataaataaaaatggtgagtagaagttacagtttctgattcctaactccttattttaccttcaaaactactgtctgtgcttgaatgtaacattctccaaaatcaaccatcagtgaagagggattcacttatatctgagtttgcaatgtatattatattgttaggcctctattacttaaaagtattgtttggggaagacagattagtttgaaataaactcagtcatcactaatttaggatacttccagaggtcacctggtagagtcagttaaaaaatggtaaagccatctaacaaagatttactcattattcttggggttgggatctcttaattgcacgtgttggttatcaccgcaaagaagccactaaagtcacttcgaaaagcaatttccttagctggtggtcacagtggagaaattacaaacacagacctctagaacaaatgacaaaaccaaggttctgaatgttatgcaaatggatacatgtggggatagcatttctggtgaaaagcactgttccaaaagcacggtgtgtctaacaacatagaggctgtgtcacgcaaaagtgctttgggagaatcaaaagttgctcatctagtgatggctaagatgctgatgctgaagataatgcgaacagcctgattataattgtttctcgaaatgtgagtgaagaaagaccttttcctcagtctctattatttgacatactttatgatttttacagtgcatggaaaacaaaactgtgacattaaatattatcatggatatcatgattgcctgtttttcatcactgcaagtttatatatatattcaagttggccaaagaaactttctttggagctcttctttgaaattggcaatccccttctcttggactgctgtacagcactggtaaaacttgatagtagtaatcacaattccagaggtacacagaccacctttctcagaatgtactctaagcattttatatgcattgtgtcaccacttaacagcaacaaaaccatcagaactaagaggctcttccaggctaagtctctagagcaagagttttttaacctggggtccaataacttgaatagagaagtgacctcttcattttcactaacctctcactgtaacagaacatttccttcaactatgagtaaaggtatgaaaccagagtcatggtttagcaggagcagtagtacaacacttgagaccgtgtcaccggtataaatcacagctattttctttttttctttttcttttcttttttgagatggaacctctctgtcgcccaggctggagtgccatggcacaatctcggctccctgcaacctctgcctcccgggtttgagcgattctctggcctcagcctcccaagtagctgggactacaggagtgtgccaccacacccagctaatttttttatatttttagtagatacggggtttcaccatattggccaggctggtcttgaactcctgaccttgtgatccgcccgcctcagcctcccaaagtgctgggattacaggcgtgagccaccgcacccggccaaatcacagctattttcatatcatattgcagttgtgcatacatacggtttatattcctcactgcttagaaattctggaagccaccagatcagctagaaaggttatttagtgcattaacaagcactaaaggatatcacacatttaaaaatatttggggactacattttccccatttcccctttcccaatattttgggctggcatccaccctgcaaagaggaccgaggagtgggcagcatgcaggggcagccctccctcctgctcagacccacaggagccctcgcctttcaaggtgattccggcgctgcagtgtgcctgtgtgtgtgcaccctcaccctccagttccctcgccaagttttagcactgctctacatcttttcctaacctttcagtttacatttttatgtgttgtgccgagacattcatctctcttcaaaattctatgtatacggtcagggagggtgaggagtgtcttagagaggaaaagtggtttccgtgctgtggtatttcaaaatggaaagagcttctacgactgatgataagctacttgtttctaataaatacctgggatcttgctttgcttgtaagccattcatcacagaggggagtcagtgctggatgcgtccatctggaacctcttgagaggagtgtgtgggtggccatttaaccttgggagcacggacccttctaaggccacaattttagtctatatccaattaattgctttaggtgctacacatggagattcagcttgaagtgtgtatttcttcgtctgtgtaataagcttagtgttcttaggagtttagcggttaccattaaaatattgattagaaattcagttattaagtttttttgggggaagggcatgtcttggggagtgcagagctgtgtgtaactagtatctggtctttggttatggagaagaaccttgcgtgagtatctggagctataatgtgtggcacatgtgtagccataataataagatttgggttaaaggagggaagcaagtctgcagaccttgaccagagtagtcctcaaaaagcctgaccctcctccaacatagcaggtgactttcagacccagagatctctccagctcacttccactttggagggaatgcacgtacctgttgatgttcatgttgcagtggtttgcagacaaagtattactggtggaggtggccagtcttgaagagctgtctttctctccctgggacttcttgatctccctgtagtcgtcttcgttgtcacactgtatgggaataaactaaagtcaatcagcactggatttcaagaggtattatgagttcccaggcaccgacttccacagagcaaggcctcctgggagccccactcacctggcttccccgaagcacagcctgagcagctgtgcccctgccatagcttccccattagctcctcaacaagcaaggatgaaatctgtcagttttacaattgacagctgatggagaggagaggcacgacgccatgattcaacattttgaattctgaaagctgctctgccatcaaccggcttaggatttagccctccaactggtctgagttcccactgcagctccagcggcactcaccttggcatttcttggtatcagaataaagtacagcaagtgtgtgttctctgggattcatgccataagggcagtggcaagcctggacttttctgttttaaaaattcttgctttggccaggtgcggtggctcatgcctgtaatcccagcactttgggaggccgaggcaggcgaatcacgaggtcaggagatcaacaccatcctggccaacatggtgaaaccccatctctactaaaatacaaaaaattagccaggtgtggtggtgcacgcctgtagtcccagctacttgggaggctgaggcaggagaatcgcttgaacctgggaggcagagatttaagtgagctgagatcacgccactgcactccagcctggtgacagagtgagactccgtctcaaaaaaaaaaaaaaaaattattgccttttgtgaactgcaagcagaagctattatctcttggtgccttaattctagttttcaattactatcccatgacatcttagaatccataaagtacctttttctaaaacagtactttgattggatccttgttgccatgattgggtttaattttatttgtttatttagagacagtcttgctctgtcacccaggctggagtgcagtggtgcgatcatggctcactgcagcctcgacctcccaggctcaggtgatcctcccgcctcagccttccaagtagctgggaatgcaagtgtgtgccaccatgcctggctaattttttgtattttttgtagagacggggctttgccatgttgctcaggctgatctcaaactcctgggctcaagcgatcctcccaccttggcctcccaaagtgctgggattacaggtgtcagctatcaggccagcctgtgtttaactttagatatgtgttaaggtgcaacacaaatatattcagaaagtaccattttccatgagataacaggaacctagtatggtatcctcagggctgtctgcattgttttccaggagacaagtgccaacaccaaagagagaaagactctgactttctcgctctggctgggattttgccacacagcctctgccacaggggctcccagatgcccacactgtaatagtacccccatggagggcccaaaccaaagctccgagttcttagtccttagctccagggctccagcagggcgagactccacaaatttgacagccaggtctatggggtcccatctccagcacccagtactggggtactaatgcccagaataccaagtaaagagcactataagaatgttctttcacttctcttgtgtctgtgtttaatgattctttagattttatgagtacagccaggtgtcaggcttactgtaaatgaagcttcttaagttaaaataaaaatggccataagtaatacaactatttaaacacagaatattacggaattttatgtaagtctttctgcacatctctctagtaaactctgcatgcctggatggctttatgtatttccaatctgtctatatattaccaatgtctatctctgcatatttcatgtgtatatttccatcagcgtattcagttagccatccatcccagaggtaatagccacactcattcccagatgattaactgattgattgattcctacactcaacaaagactgagcaccagcaagtagtaaggaagacagggtgtgtagagaaaaacaggaggaatagcaggtagggaagaaaatgagctgccaagtattactgagttgcattgttggaacatattgtgtgaatctgacaacacccctgcaaagatgtcaacatttttttttttttttttttttttgagacagagtctcactctattgccaggctggagtgcaatggcatgatctcagctcagtgcagcctctgcctccagggttcaagcgattctcctgcctcagcctcctgagtagctgggattacaggcacgcgccaccacgcccagctatttttgtatttttagtagagacagggtttcaccatgttggccaggatggtctcgatctcttgatctcgtgatctgcccaccttggcctcccaaagtgctgtgattataggagtaagccaccacggccggcccagatgtcagcattttctagatggagaaactgatgttcagagaaagtaaggtcacctgattaaggtcactgaggaggccaaggaccataaataaccttctgggtctagcgcaaaatgaaaacgctgggccctttgttcaaaaagcaggaaaagagtgatgttataaagccctcaaatagaaaacattctccattctttcacagtctctgtcatggaggtgtctacagtatttgctatacacactgtacttctttgggcatggggatacttggggaggcaagtgtagcctctcaagggctctgtctgcccttggacaaggtatatgtgtgcagcccaccagtgtgggcgttccccttctgccaatcagaggccctacctgtggtgcccgagttgtcaggcatttccccaacaacccacagcaagtgggcaacccccaggggatttcaagaccctctttggaatgtcttactacctggatgagggatgggcaagattcttcctctgcctgcacctaggccccttcttggggcaagggcagcaatagtccctggactaagacaggaagtgggaggctgcctagggcccagggtgccaggaggcagaagcgcaggcagaacctgccctgcagaaacaggcaggaggtgggaacacagtgagtcaaagctccatatgcccctgcacatgtaccatcaatttgcagcatcacaaattcaaagattacaggaaaaattttaagatggcagccacaagcattcaattccaaggggccctgggtgatgcacaccactatggtcccatgcatggggcccatgaaaagctggacctgcaggagggaaacggtaaagacaggatttgaagtcaggacactttggtgtgaaaatccacacactttccattatatgtgagcactctcagggcaatggggaccaactaagggcgcccactgccggctaataatggccagtgctgggtggaaactatgttggggcctctttataaaattatctttgctggccacgtgcagtggctcatgcctgtaatcccagcactttaggaggccgaggcaggcggatcacctgaggttgggagttcgagaccagcctgaccaacaatggtgaaaccccgtctgtactaaaaataccaaattagccaggcatggtggcacatgcctgtaatccaagctactcgggaggctgaggcaggagaatcacttgaacccaggaggcggaggttgtggtgagccaagatggtggagcatcattgcactccagcctgggcaacaagagcgaaactctgtctcaaaaaaaaaaaaaaaaatttttttttctttgcatccataccaaggaaaagcaaaaagctgccccttgaacatatttcttttcatgaactttcttgcaagggcttcaaattctactttatagggataaattacttaatgttattaatattatgtgaagaaaaacatcctttggtactttattttttattttatttatttatttctttgagatggcgtcttgctctgttgcctaggctggagtgcagtggcatgatcttggctcactgcaacctccgcctcccaggttcaagtgattctcctgtctcagctgcctgagtagctgggactacaggtgtgcaccatcatgtctggctaattttttgtattttagtagagatgggattttaccatgttgtccaggctggtcttgaactcctgagctcaggcaatccgcccatctcagcctcccaaagtgctaggattagaggcttgagccaccgtacccggtctggtactttagaatgaatttctctggtcataggtgcccttaggttacaaagatgattgtcataaaaaggagactgagtgccttctccatgcgcacttacaaagcaagaaatatattcatcgtggccaggacaaggtaacaagctgtactccttagtccccttctcaatcagggattcgaaatagctgtgaaacgtatgtgtccagtctaacttttctattgatagactagactgtcttcagaaaactggaaaatatacagacctcagactgatttcttattgtgacgctctgaagccagacagcctgggttaattcctggctcagccccttaggacctatgtaaccttgggcaagttgctttaggctctctgagcctctgttccctctccgtaaaatgggtatgacaatatttgcctcataaagttataaggatgaaatgatttaacatgtataaagtgcctagagcagcatctgtcatggggacctatatacctgtgagctgttgttactgaaaactttgtcctaaatttggagccatccatgcatattgcaatcttggtctgtcacccattgtatttttcacagtgataaaaattacttatgaagatacagtaacaggaggggttaaaaaccctcaaaattggctttaatggatgattaaggtattcccctgcacaaaaaccttcgaaatgggctacacgttcaggctctgctgccagagatgccccccagctctccctgtccttgcttttgctgcccttctcactccctggactcaccgcttccattcctgaccctggacgtattcaaatatccctcctctacagagccctgttttcagggcccctccaccatgaagccctccttgatcaatgctaacagaagcaacagctgctggttctgatgctgcatcagggtctgccgtattcattttcacctgccacaaccttgaacttcatgaggccactggcctcttgggccaatgagtgatcccaccatcaatgtcaccccattcctgccagcaaagagtgagggttctcatgtgtttagctttctcacaggccctacatccagctgcgtgtgcacacgcttgataaatatttcctattttgacatgcagtgggacaaggcttaattacctataactataaaatagggataataggctgggcgtggtggctcatgcctgtaatcccagcactttgggaggctgaggcaggcagatcacttgaggtcaggagttcgagaccagcccggccaacatggtgaaaccctgtctttactaaaaatacaaaaaaattagctgggcatggtggtggacacctgtaatcccagatacttgggaggctgaggtaggagaatcgcctgaacctgggaggcagaggttgcagtgaaccgagattgtgccatcgtactcctgcttgggcgacagagtgagactccctcccccccccccaaaaaaagggataataatggtacttccctcactgagcagttctaaggactaagttagatgttaagtgcttacaacagtgtctggatatagaaagtaccctagaagtgtgtgttaggtaaggacacacaaaactcctgcggcagcctaccgtcccaaacagcagcctatgggtgctctatccaagtacccacaagttaagagatagccccttcccctccacgcccccgcaccccagtcagccccaggcctaccttgcgtttcctcttggattttggcaaagccttttctgcaggtgtgtccgaggtgtggctgggcggtgcgctctcagagtccttggtggcaggggcgctcaatacccctggctcctggggcaggtgttctgggatcctggacaggagggtcaggtcgattttgacccagagagacctgatctcatcactgtcctttagaggggagagaagttcgttccggccaaaggggaccagtgtgtagaactgctcctccagctccttggcgatgtcactggtggtcctggcgttgatggagcctacaggggccctaggaccactgcccccgttggcagcggcctccttcagcctctgatcattcccggaggaggcagaggcagccacggtctgtgctttggacagagggtactcctcctgctcggactccaggtcggagtccgaggaggaggatgaagatgacgactctgtctcaatgaactccttggatttggggacgatcctgcttagcccccgcgtgcggcgcttctcgcaggtcacggaggagcgcagctccttgcggtggctcgctctgttgttgccacagggcctggttttggtgggctccggggggaccaccacgctcgtccccagcgcgtccgcggccgcgggctcctcgggccggtggcagttggcgccgtccccggctgaggtcctctcggtgcgcctggtgggcttcttgcccgcggacctccgggcaggcgcgggcgcgttctccgcgggcgcacagggcactgcgggtggcggggcggctgcgctcaccgccacggccacggccgcgggcggggacttctgcttcacgcctttactcccaggggccttgttggctgtccttggcctttgctcctccttgcaagtgctcttgatctccttctctctcaggctgggctggcaaacgtcggggactttcccacagtcctggacgtcctctttcaccgggttgtagtactgattgctctctgacccgtggctttcattttggatcagaataggaggcttgtggggattaactttgtttagccatttatccagctgccacttgttagaggatgccggttcagcctgaaagcagaaaaccggtgacaaacaaaacatctttcattacaggctcacttaaaaggggcctggctgtttttatcttgacttacttctctaagtatatgagcagaaaacgaatgggctggaagcaaaaggaaaatggaagcattaagcgtgtgtggcagccccatgtggcactcaggatgcctggatgatgctgtccttaccggcccgtggcactaaatgtccttgcagcacttcctctttggaaaaataaggaaagcattgtgtctcattagaacccatttcctagtacttttgagtgttagtataaatttttttatataattatatgtacatatgtaaacttgaaattccccaaaactcagagaattgtttagaggccctgagcataaatcacttgtttttttggtgagacttaaaactttggggagatctgaagggggactaagtggaacctacaatcccaaacaattaacacatgatttatgtgttgaaggcaggtaggctgtagtaatttggtagtaggagcaatgaccttgggaagatggcttgttttgcatatagaactatttcagaggtatttgtgcatctttggcagcctgactgggtcagtctatcctcaacctgcttccatcacactttgctagaaatatttcaaacatggaggtgagatggaacactttcctgcaagcaggtttgctaacttagagcaactcatgaaagtcattggttttgaactgtggccccacaggttggctctgtggttgagggtggggggatggctagggaatgccctgaaatggatgggaaatgtgtagatgcattttgtttctagaagaggtctgtacttttcagttgtgtctctaagaatctatgtctcagaagcaaaaaaaaattaaggaccaatccaataatttcacagggagtaaatgctgatgtctaaaaagtcaatttatccagcattatgataattaagagaaaacaggtgtattgagaagaatagaattttagccagagtattttcaatttgtgactctaagtgaaatggggaaagtattttggctaaggtgatgtgttttttcttccctatggccttccacctttcgaattcgtggcatccattgtttcagaggagaccagataccaggctagagtaagaagacactgcttagctccatacttcaagcttgatcagttcaagtctagagcaaattgggtctgttgccagagaaaaaatggtttaacacaataaataaaaataataaagtttaataaaattttaataaaaataataaatacatttaaataataaaatttgaaaaggttcctttgaagtatcaaggtttgtttttcaacagtgaggcctgtattaagagcagaactcagggctcttggcctcaccccaggcactgaggatttcagaaggggaataagagggctgtatcatagaagcaggggccttggctgagtccgggcacaactcagggaaatgggaagcctctgatgggccagaacgggttggggccaagaggaattggccacagagcgtggggatcaggcaaccagagctatgacagggaccatggacatcttgctggttgccccaaaccagatgggaccaactgccctttggggcagactggcacagggtgtctggtgacttggagaagcaagaaaatttcagtgaaggccagaatgaggatgaaggccccttccctgggctgtgaggatgcggaagcccatcctggagtgcaggtggggaaggggggaccccctggccccgacacagattctggtctttgacgtgacatttttctttgcttgttttcatggccaccaacggaaccggggcaccagagaaatatgcaaatgagtagaaagacagatggtttttgtacctctgagttctgcgtaaatcatgacctcgctttatttggcttctccagagaaagggaacacgggaaacctatggaacatgcccagtgcatgtggcggtggcagatgccctcccatggtcagagaaagcaggacagtgggacacggaacagcttctcggccaagggggatccctcacctcccctgagattagctgagagtgcctgaaaactaatttggtggcaaaaatcaatggcttctaattttgtctccctcaacccccatttctctcatcaagtcagtgccttcgcctgtgcctcagcttccctagacaaatgggacacagtaaacaggaatggatgctgaaggggcctcttgcagaaagggtgcacatattggaagagggcacacacacacacggcagaacacacccctcacactggccccgccactgcgtttcacactagttctccctcactgctaccatccggagccttctatagcccacatctcatatgtgagagaagtctgtttgtagccaaaacacagctgcacacaggaaaattcacactgaaacttcctagcaggagcattaacagaagggcagaatttaatacatttagtacaggcccactgcctggtatgctttagggtcattttttctgcacttcacagctgaggaaatcagtttgaagtacccactttcaacacatcactaaatcatacttttttttccctcaaggatctacaataacctcctattgcctctcaaacaaaatccaaatttctaaggggggcgtttaagggcgtccattatctcgtaatcatctttcattgtcagaatacctacagtttaactcccacttcatgtgtattatctcatttaatctttacagataagaaaggttatcatccctaacttgtagatgaggctcagagaggctaagggacatacccagagctgcacagctaccgggctctacggagactaactttgtactcatctaggtttaaagaccaattgtctccacggctgcatcactgtgtctcccactgtttggcatagcctcgtgaaagggggaccgcattcctttgagaaatgtcagtcttcaacttaaaatgacagaattagatctgaattttggagaaaacaccaagaacactccaaacagtacttgttgccctctgttatactcaattgcgttgtcttttgatgttcgtatttgtttcatgtgtatatatgtcttgtgtcttcaaaaaagccaaatgcttctttcaggcaagggccaggtctctgtttctttagtatcccttgcagcatctatactaggtcagggaggcagattgccacatctctcctcctaataagaacaactcacaatgaggtgtcactcaaattgtaccatttattcctttattatcatcattttccccccgacaacctcacaggttaggcagagcatgattatctgccattctggaaatgaggcaattgtggccaaggaagctgcaaggatacagagtttagtggcagtgaggaggggaacctcaggctgcagacgccaggccactggcatgcggctggccacagtccgcctcctgagccgtccatccggggtttctgcccaaggttctggtttgtttgctggctcactgctttatattttcagccatgactctcctccctaattgatcttccctctgactcacgcaccagctctccatcatgcactctggtccctgcttcatctaaatccttcaagtacccgctgccatggacctcgtaggcacctaataaatgagaagcttgttgagtcagcgagcaacttgaatcacatttctgttgatttttaagaacgatctagggcagcattttccaaaatgtgcttttagctcatctatcccatgaaggagggtttccagagtcagatcaatctgggaaatgccacaatggaaaacacagtacacccgagcaatagtaagggttgcgtgatgattcgataggtaaagaggtggaatcaacctattttgtcccagatctctttaacattaggtatccaggcttttttattttatttttttcctccacgtaatatatattgtacaacaaaggccgagtgagttccgtgtgtggggtcaacatgttagctgagtgcaaaagcaacttctcctgcaaagctctggtataagaggctgtacagtgcctggaaagcagattagactccggtgagaaaaagttgtctgagaccaatgaagcccacatcatgccacagagagggcccctccatgctacgcgggaacatggcattaccatactacagtgatttacgtgaaacaaattggctctcaacacacacagccagaaagaacatctcctacgcaacccagctgagcccagtgggttttctgagtgctgggacatggtggggagaatacagggcgcctcctacgcccatagcaggatgttacagcaggggagtgaggaacagaggcgttctgcttcaaagcagcacaaactggtctgagcagcggaatgtgaggtgcatggctatgaagagcctgactgtcatgtggggttcaggaaaaggagtcttacagctctctgtaaggtgacctgggccagctccgccagaccaggcagcacagctgtggaggacacacagggtgatgttacttcctgcctttgccatttgcagtctgcaaactcattttctttctaaagggtgtgtgtgtctgtattatccttaggaaaagtgttaaaagaactttacttttattccaacaaatacatttctttcctgcagaaagaacgaacgtgcagcctggctaacacatcacctgctgcttctgcagtcctctgtgtagggaagccaggaatccaaaaccacacatagcatcaggtgacttaaacttttaggactgactcctttaggaggctcttgcccctctccttagcgaggggcctctgatagctgctggaagaaatgacaagagcctcctttcatcacccaggagttcaagtctttgtaattatctcagtgacatttagaaagcatttgcttaaagcactttataactgtactgctctttttttctttctttctttttctttgagacggagtctcgctctgtcacccaggctggagtacagtggtgtgatcttggctcactgcaacctccgcctccagggttcaagcgattctcctgcctcaggctcctgaggagccgggattacaggcgcccaccaccacacccagctaatttttgtatttttagtagacacatggttttaccatgttggtcaggctggtcttgaactcctgacctcatgatccacctgttcagcctcccaaagtgctgggattacaggcatgagccactgcgcccggccaactgtactggtcttaaatgaggttccagccaacacaggagctctaggacctacatttcaggatgaaaataagcctgaacattcatgaatttaacctgcaaagccacaaggaggagcctggatggatgatcttcacagacacaaacagtttttggatatcctcactgcctgccctgtccttgcactgtccctgggacgcagttatttcttataactaaatattccagaatttctccacaaagtatagcataaagcaggctttaaagaagcctgcttaactcttctactttatttaactcctgtatttttttcattttgaattatccccattagaatgtcagctctatgaagatagggacattttttgtcatataattgtgtattccagggccaagtactgtgtgactgatgctcagtaaatatttgttgaatgaattctgaatgagtaaatgaatcaatgaatgagtaaatgaaattatgctgaaggaataataatttagtttctgggaaaagccagggttatgttaccataaggctttcataggttaatgttgctaagagccttcccctcatacagagattgatagatggataaatagatggatagatacagatggacagatggagaggcagagactgaacctcatgggaaggagagcgtggagagatggcttggttcaggatgaatggagagtcctgagccagggcagaaaggtgctgaggagaaaatgaggagtgtggggaaacaaaatgtccctgatttcacagtgctcctgcaaaaagctttagcctcctgaaagaagtagggaggggaaaaacctgaaggaactgaagagccactctgtgaacctgagatggaaccactgctttcaggtgtgataacatccaaggcaccgctataaaagctggacacggggatgctgatcgggcccattaaggtgctcccctcccactgagatggtttgtagaagtgggtttagttccatttcagagcctatttaggaatatggcccccccaaatggtacagagggctgtaagtaaaaaattaaacctgacaatcattagtcatgtcaaatgtttacgcactcaagaagaaactctattttactccttgtttagaaattagagtctacccttagagctctgcagcctggggaagtttctctcagccctctcccaagaatcttcatgctctgaattactatttaattttccccttcctactttaaagtagaaacagcaatggtttttattggtaccttctaatgtttttataggaggcacctaaatcttccacatagatactcatcacagctataaaaggtttcatcatttttttagggtgatgctaatttttctttttctattttcacaaagaaaacacagttaagaaggttttattaatatttatagcccttcttcttctgatccgtgacaaaccgcaaaaaggtaagaatctgaccatgtccaacccataaaacccctttccctgtgatttatgggtggtcacacttcccaggcggtgagtggctctgtccagcgactgccctggctgaccccaagggagacctgagccataggttatttcctgtcagtgatgtttatagcatacttggaaatttctggaagtcaagagagaatctgggggcaatgaaagttgatgtttctgtacttcaaaggaacctgtgaaattaggagactgtgaggagggggaaaatgtggagcccgaagcccatagcctcctccttcccagcacctggcttggggtctgcaggagggaggagacctgcagcagtgtgacagtgacaatgcccggacttgctatcctcatagagacagaagtgggcagaggagaggcctgagccaggcagcgcttacctcggggctggagaagtgggggggcttgctgccctcactctcgctggagctgctctcggtctccgagtcagatccggagctgctctctgagtcgctggaggagctgctgctgccgctgctgctgctgctgctgctgcccttgctggaaggcaccgaggttctgcagttgggctgctggaccacggcgctgccagcccgcgaggcccccgggaagcagagggaaggaaagccaagtgagcaaacaggaaaacaccaccaagctgtcatgcaccctaaagagggaggaggcacgcagcctacacatctgtcaaccatgacctggaactcaaagagcaggcatcgaggtcaaagtcatcctaaaggttaaagcaactcatatacagaaataaaattgggggtgaagttggtgccccttggtagtcgggcactggttattcgtgtggccattttggaagggaaggtggtataacatccaaatggctgtttccattttgctgctgttctgggaatggcttttcaaatgcatccccaaatccaatcatctacaaaaatgcaaggaaatccaaaaagcttgaactattttgcaaagcatgaaaatgactgctttatttttgccctagaggaaaatgcagcatgatggcagggattaggcagagggctgtcaggaagggcacggcgttctgctctgagctttcatgacctgctggaaggttccagagacgaagggactgtccaagttcatgtcttgcttcctcccttttcccacctgtagttgagtgctgtagcgattacaggtgctgggatgttgttataaactgtaaccttcctttgagccctttcctagagaactgaagatccctcactgacacactttcgtatattccggactttaaaattcaatcccggtgctgtgacttataggaactgcatttcacatttatacttgatgtttatatccatgctgaaatttgccagaaagtcattacatactcaaagataacaagaaaaattgactgatgctttccgatagtaattaattaaccataaaaattcaaatagcatacatccacccagaaagtgtttgagcagaaaagaaaatttcagtactcacataatattcaacatcttcaaagtcctttattaacaaaattgaaacacaccatactgtgttcttttgaggtcaagctctaaataccaaaaatgccggtcactcttgtatgttgagtcagcaaactgcttccaactgtgaccagtgcttctataggaccgagcatcaatgaaggccaggggccagggagcttgtgggggtttacggtctcaagtgcaaagcagcctggacatggtaaaggacttgtttcacccatcccttaaatctttgatacgtgctttgcccaaagaggactttcataaatcctgggtatgggggtggggatggaggtaatactcattggagctttgtttctataaaaaccaccagacaagaaactgtcttgcaggggatctaaaaataaaagcacctcttggaacggcagggttaggggaaccagagtgtgaacataactttccctagtggggttttcatttcttccaccaatgtcacggtccacactgattgtctgacaaaattcttcagcagcagacaacatctgcacatttatgccttgcctgagctgcagcgatttcttttccagcctgttatttgtgtctagaattgagtgaggaatcctggatcttaagacagagtagggcaaggcacagttagagctcaggggctgtaatatttctttccttccttatgaacaaaaatctgtctttcctgttggctgaatcgagatggttactgtcattggaatcataaaaaaaggacgattgaattctgactgaacatgaacatctgggatccatgttaatagtctgtagaacctgacagaaacaagcaatggggaaaggattccctatttaataaacggtgctgggagaactggctagccatatgcagaagactgaaactggaccccttccttacaccatatacaaaaatcgactcaagatagattatagacttaaatttacaaactaaaactataaaacccttggaagacaacctaggcaataccattcaggacatatgaatgggcaaagatttcacgacaaagacgtcaaaagcaattgcaacaaaagcaaaaattgacaagtgacatctaattaagctaaagagcttctgcacagcaaaagaaactatcaacagagtaaacagacaacctaaagaataggagaaaatttttgcaaactatgcatttgacaaagctctaatatccagtgtttataaggaacttaaacaaatttacaagaaaaaacaatcccattaaaaagtgggaaaaggacataaacaaacacttcaaaagaagacatacatgtggccaaaaagcatatagaaaaaagctcaatatcactgctcatcagagaaatgcaaatcaaaaccacactgagataccatctcacaccagtcagactggctattacgtaaaaatccaaaaataataggtgttggcgaggttgtggagaaaaaggaacccttatacactggtagaagtgtaaattagttcaaccattgtggaagacagtgtggcgattcctcaaagacctaaagatagaaatatcactcaacccagcaatcccattactgggtatatacccaaaggaatatagatcactctatcataaagacacatgcacgcgtatgttcactgcaacactattcacaacagcaaaaacacagaattaactcaaatgcccatcgatgacagactggataaagaaaatgtggtacacatataccatgaaatacaatgcaaccatttaaaaaaaaaagattatgtcctttgcagggacatgaatggagctggaggccattatctttaccaaactaatgcaggaagagaaaaccaaatgccacgtgttctcacttataagtgggagctaaatgatgagaacacatggacactgagaagggaaccacacacactggggcctattggagggtggaggatgggaggaggcagagggtcaggaaaaataactaatgggtacaggcttaatatctgagtgatgaaataatctgtacaacaaacccccatgacacacgtttacctatggaacaaacctgcacatcctgcacaggtgccccttaacttaaaaaaatcgttttttggtagatcccaaaacactcaaaacactggggggaaacactcaaaaataaaaaagcaaaacaacacatggctcaaaagcttccttgttagaaggatggggttgggggacatagatgtggaggaaagatatgtgtttctctgtcaccctctggagtgacatctgccaaagattagcaaatgaagatgaataaagaacattctgattggtgatcaaagccattggacatcatagaaaaccaatcagtatattctatctgctttcactcaacaaaaaacatgcgatgctggttctgtgtgctctgggctttgcgtgtacagcagaggcagcaaggtgtgtgggattccttgtggcttgcaccacaaagtgactgtcttttgaaaactggcactttaatttctgggaaagcgcccattcaacagttaccatgctgcctgcctttaatggctgcggtcctgaagtgatgaggcacactagcccaaggaggcagcatctccgatctgaattacattggcagaaaaaccttatacgttaatgttttcctttcttaaattacgaaattcacttaaaatgacagttttactggcctaactattatttgtttttaaaacagctgagagagccaagagtttaggtttttcttcatactttacttgtaagggttgtgaaatttatgatgtctggattaaatatattcatgtttcaatggtcccggtagagcatgcataatatccagaaacaatcatagcaaagatgggggcagactttcctggaagggcgctggtagctccagttgtgggatcaagatcactctccccacttccacaaaggcaactcctctaacccatccttgcatggggccttggggtcagctgaccattctggcctcagtgtagtgactgctcccaccacgggtgcttgcagctgctttacccatcgtggggcagctgcagcagtgagggtggcagagccaagatgaagaagccaggaatggcattccctgcagacgagtgctagtgaaaggatggactcggctaagccacaaacacacacatatacatacgtctatagaatttgttgttgcccaggctggagtgcagtagtggtcatagctcactgcagcctcgaactcctgggctcaagcaatcatccctcctcagcctcccaagtagctggaactacaggcatgtaccaccatacccggctaatttttgtatttttttttttataaagacaggatctttctatgttgtctaggctagtcttgaactcctggcttcaagcaatccttccacctcagcctcccaaagtgctgggattacaggtatgagccactgcacccagcctaggctttatatatttaaaattgcaaactgaaaattttggtgtgccaattggttgtcatgtttacataccaaagatgctttaaaaaaattaacttaagcctgggcagcatagtgaaaccctgtctctaccaaaaaaacaaattagctgggtgtgctggcatgtgcctgtggtcccagctactcaggaggattacttgagcctgggaggtcaaggctgcagtaaaccatgattgtgccactgcaccccagtctgggtgacagcaaggccctgtaaaaaaaatatatatattatagtggattttttcctgaaatgataacacggattggttgacatgatgacataggcttggacaatttttagcatgctacctaccaagttcttggacccagtgccatctcatgaacacggtgccatttgacagcagccagaaaacattattgagatcatggaataaaagtctttgtgtcaccaaagctcagcacagtgcctggcacataataagcgttcatgtgtgattactaaatgaaaaagtaaagagaaaaaatccaacactgggttaatgagttttttttttaaaaaagagattgaatctttcgagaaggttataatgtcacttttccaattaaaaaatatttaaaagtacttcaggacgggcgcggtggctcacgtctgtaatcccagcactttgggaagccgaggcgggaggatcacgaagtcagatcaagaccatcctggctaacatggtgaaaccccgtctctactaaaaatacaaaaagttagccagacatggtggcaggcacctgtagtcccagctactcaggaggctgaggcaggagaatggtgtgaacccgggaggcggagcttgcagtgagctgagattgcgccactgcactccagcctgggcgacagagcaagactccgtctcacaaaaaaaaaaaaaaaaaaaaaaaagagtacttcagcaacctttaagacagacttcttcccttctgagaatatttctttaaatgtactcaagtttcatctgctataatttaagcacagttccctcttggatggtttgtttactttttgcattttgacttcatgaaatgtttggctggttttgtgagtggtcagagccaaatacacctttgagaggggtccagctttctctaaatgatctgcttggtgtgtttcttcctatggctgtgatgacaccttccttttggaatctggccttggctaagtctgaatgcagatcataaaagaaaagatctggaggctgggtgcagtggctcacgcctgtaatcccagcactttgggaggctgaggcaggcagatcacaaggtcaagagtttgagaccagcccggccaacatagtaaaaccccgtctctactaaaaatacaaaaaattagctgggtgtggtggtgggcgcctataatcccagcaactcgggaggctgaggcaggagaattgcttgaacctgggaggcggaggttacagtgagccgagattgtgccactgcactccagcctgggcgacagtgtgagactctgtctcaaaaaaaaaaaaaagacctggaaccaaaatgacaaaatcttggatctcacagtcaagggtgctcctgcctgccaagtgtattgtggggcctgaatacatatccaaaattgtccacacacttttaactgacaagtaacttggagagaggctctctgcctggttgttgctgtgtggacagctgtggtgcccacatcgcaccacacatgctgtgggcactccactgggattgactgaataacaatgtttgctcctcctcttcaacactctttgagaacacatgcttgatatccaaaccataatcagtgtcctggcaacagtattcctttattaatagcatcactattgatattaattcatctaaaaccataccacatggtaagtgaaaatggtaaatgcgggattgaagaggtttgctattgctaagaattgtcgtctaaaaaaaaacccaactggcaggactgttgcttctatcctgaaatgtaattgtttgttctgcaacacttccaagaatgatttctctatacaacttggcttttgaagctcttcagggtctggtctcaatcagatttccagcttcacctcaatgggtctatccctaaaccttggcaataatacatttctcagcgtctggacaggctgggtctgtttccagcagggtgcccttgcatatgatattttctgtgccagaaagtcctttctccctttttcctttgagttactgttacctcctactccctctgcaggactgagtggctatgtttccctactctgtaaaggttttcccagctcccctaggcatcaatgatgtttcctcctctgagtccctctagcacactgcccacttctctattgcagcccttaccacgttaaggattggaatcatctaatttatccatgcaatgtatttttttctgttcccttgggaatatgcaggagttcttaaaactggtaactttagaatgctatcatttacatacgtatcaggttgaaaattgagaacccacgggggccacgcaagtagcatccatgagtgaagtgttcaggtataagcaaaacaaatgtgtaacattataaatggcagtagaccctcagctccccagccgaggggaaggaaccaaactggagaatcccactaggtcgaatgctgcttctccaggctagcctatctctgtacctggaaacaagagctcattattaccaaatcttttgattttttttcacatgaagccccaaatccttatgtttatatcaaatctcctgattttaaaatgctggtaactaatttgaaaagttttaacaatgaaaagtttcattgtattttagcaatgaaacacatttggtaaagaaaacacacgtgggtaagaagaggcctgtggggcaccattctgagacctctgatctatgtcccattattacatgttttgagatggctcaatataaaatagaaaaatatagagaccacaaccagaagaagttttacccactcaggaatttagactagcagggccagggacaaacaaggggtgaaccaaacactctcacttcctcagcccacctttttttttcttaaagtgaaagcaagtttattaagaaagtaaaggaataaaagaatggctactccatagacagagcagttaccaaacaccattttgtatttttttctttatttttttaaccttaggatttgtttttttaattttttatttccataggtttttgggggggaggggaataggtggcatttggttacatgagtaagctctttagcattgatttatgagattttggtgcacccatcaccctagcagtatgtactgagcccaatttgtagtctttgatccctcactcccctcccacctttcccccaaatccccaaagtccattgtatcattcttatgcctttgcatcctcacagcttagctcccacttaggagtgagaacacacgacgcttgattttccattcctgagtcacttcacttagaataatagtctccagacccatccaggttgctgcaaatgccattaattcattcgttttcatgactgaatagtattccatggtatatatatacaccacattttctttatccacttgttgattgatggatcagtccacttatttaaaaaattctattttgaaataaatacagattcactggaagttgcaagaaaaatagtacagagatcgttcttgtgcccctcacccagttactcccaaggttaaatcttatgtaactacagtacaataccaaaaccagaaaactgacaatggcacaatatacagttccttgtaattttatcacatgtatagattgtcaggcctctgagcccaagcctgcatgtatacatctagatggcctgaggcaataaaaaactgcaaaagaagtgaaacagccagctcctgtcttaactgattgaccaaccttacaacattccatgatgacttgttcctgccctgccccaactgaccgatcgacctcgtgacattcttcttctggacaacgagttccatcatctccccaccatgcaccttgtgacccctcctctgctgagaatagataaccacctttaactgtaactttccactgcttaccagccttgttgctcacacaaagcctgttggtggtctcttcacacggacgcgcttgacatagattcatgtaaccaccaccacgattaaaatgtagaactgtcccatcaccataaagatctccctcatgacacccttttaggagcattcacgccgacctctgccctctaccattcctaatctctggtgaccactcatctgttttccgtctctaaaatgctgtcattttgagaatgttatagaaacagaatcacatagttatgtgttcttttttaaactaaattattgagatacaatttattcatagtaagtgtccttttgagatgggccttttttcagtcgacacaatgtcatgagagccatccatgatttttaatatatccatagcttgtttctttttattgccgggtaggattccatggtacagacctttaaaggttcctctgttttttaaccattcacccaatgagggacattctggctgcttccagttttggactgttaagaataaggctgatatgaatatttctgtataggtttttatgtggatgtaaacgtccatttctctgggacactgcttccgggactttcaaatttgtcttttgtcttcagaattggactctgatgagtctgggtggggatttctttgagttcaccttgtttgggatttgttagcttcttgagtctgtaggtttatgtcttttgtaaaatttggcatttttaaagccattatgagtatgaatactttctggataatttccagcctcactctttctcttgtccttctggaactctgatgacacccacgtaagatcttttcttacagtcctgcaggtccctggggctctgtccttctctaccccccagtctgtttattctctgttgttcctatcaggcaatttctcttgttccatcttcaagttcagtaattcttccctctgttctcttcattctgcggttgagctcatccattgagtttttcaaattttggttatggaatttttcagttataaaatttctatttgccttttccttgtattttctgtattattgtggtgagaccccccctactttttcagttgtctcaagcttgtttttaattgcttactgaagcattttatgatggctgctttaaaatgcttgtcagataattacaacatctgtgttggtctcagtattagcatctgtggattgtcttttctcattcaagttgagattttccaggttcttggtatgatgagtgattttctattgtattctgagcgtttttggtattataataccttgatttttaaaaattattgcttgtttttgcaggcctccactaatgcgatgttggcaggggaagggagggttgtctccctacagttgtgcaaaggtagaagtttaagctccccactcaggctttgctgatggagagggggccacagttttttttccccccacggtgtttgtctggaatagggtggttattgtctacaagtttcccacggtggctcacacctgtaatcccaacacactggggaggccgaggctggtggatcacttgaggtcaggagttcgagagcagcctggccaacatggtaaaaccccatctctactaaaaatacaaaaattagctgggtgtggtggcgcgcgcctgtaatcccagctacttggaaggctgaggcaggagaatcgcttgaacatgaaaggcagaggttgcagtgagctgaggttgcgttactgcactccagcctgggcgacagagtgagatatcatctcaaaaaaaaaaaaatttattcttgctaggatatgaatttcctgaccctttcactacagagaactggctttcctgtggcttccgtctgtgcctactgccaggttgccagcttctccagcatccactctgtgctatacaaggaaaaaaggaaacctggggaagtcaccaccatgtcttttcctcaggcccgaaggcccaagctgatttgccttctccccgcctttcagccttattatgtttgttttatatgtaacatccatggagtttagctgtacttagcaggaggaagaggaaaaagtgcattaacatcttgtcccagaacaggcaaccacccacttggtatttagcaagtagaaaggaaccctctctcaatacttccaacctccagctctagttaattatctcaaaagctgacgaatgaaacaattacaaaagtctctgctatagttcctgcccattttatcacctagtcaaattaggcattaattcattcatttaaaaactgctattatgagaattaagctcagattttacaagggtgtataccaaacctgaaaaggacatgttaccaagaatgtacacagcctcgtgagaaaaatgactcaaatgaaatgaggctgtaaaaatgttaaggatagaaagttgagtgctttaaatgttatgttcatagtgaaacattctctcagtatatctgtgaggtaatgggctttccaggattccagttagctggggacagagaaatggattggaatatctaagtgttgactttgctttttccctgggagaggatagggttttgctgatgctgggttttgctcaagattgagttagagcctcttggggcacctggaatctgagctggtgcacggcacacctgttccagctctgtgggagcacctctgcctcagtcattccgtgaccttgcctaaataagccgaggacctcatctaaactcacagggtgtaagtttgtggtctttccctgccagtgtgtgggctacaaagcagcatgatcacagttatgtaaaaatatacacacagaggaaaaaaatgctggaaggatattcaaatgttaactgtggatatttttggatggtggaattatggggattaaatggtttttgaacttttctgtattttcaaaattctcattttcttttcaccaataaaacacatgacaccattttcaagtctacgtgattgtgggaaatgactattcatgtattactgaatttagcttgctcgcattttatttaggagtttagggggttgatattcacaggggaacttaatatttacatttacatattttacattttgggggagatttttggcaggttttgtatcatgatggttttagcttaaaagtataaattggatagtgttttaccttttcatagtgttctgggaaacgttaagtaatataaaagttatctgttccttgaaagtttaaaataatttgtcaccaataaaaccatctaatctcagaaccttttagaatggcaattctttgatatctttcacaatttattatttggttattggccattaattcttttgtcaatttttgaatttttttcccaaaagatcctatttaatttatattttcaattttattaccacaaaagttatataatgttctcttataataaaagcatggtatctattatattacttctttttaaatttttcctctttcttcattatatttgccaaaagttttctattttcaaagaaacagcttttgattgatataccataataactctagtattttctggctttgctgctacattttcatgttcatttataatacttttacaaacttcttgtgttgaatgcttgtttcagctatgtttactcttccttaataatagcagcctttgcgactatcattctgcctctgagtatacccgtggttgcaggcgatcatccttgttatgttctgtttttattttccttactttctaaatagatcattgaagtagtttttaagtcttgtttgatcaaatagtcatttagaagaatgcttttcaatacctgatgacatttcagtgggataaacattacacttaggtccaaaaataaacaggatgggaatgtataatagcttagcacatgtggaaacctcagtggtcagcagcttcagcccggggcaggaaccttagagctgttttgagccgatttggaaaaggtgagaggagggacaggcagcacagctcattaactctgaaccaggagtgggatgggagtagagaatggcctggggaagggattaggccataaagaagacttatgcaccactgtgatatcccaaagggccctgaaaccttctattggccgtagggaacaataaaagtcaacagaacctgccacatttagcagaggagaaactcagtaatacaggaggtccataaacttggacataaattaagtctcacatttcactgctgatgctattgtagcatctggaactctttcagttacaaaccaaagaattcaaagatcctcctgaccagcccattaggcatttacacagacatatcagggagtgaggtgctgaggcccaacttccaatttaagaacagtgttgagacacaaggcttgatccccaatttgagataccagagagcacagatgtcaccttgtggggtcctagttacttccataaaatgtcatagatgacaataagccattagttcttaaccaggtgctggatcccgtgctctcttgcttagaggggcgctttggcttggggaatctgttctaacactcgaaacatttcttagtttggaattcctgagtttatagcatcactacctgactactgacatttgctaagaaatacaatttcttttgttcagggttcagccctgcttttggatttatcagcttttctttttcagatgggtgaagaaccttctcttgtagatgaaccaagacaaaaaagctattgcttggagctctgggtcatattgggaaccaagttttactttcagttgaataaagacccacgtgtggccccaccaaagataaaggcatttcacaaataaagaaaaaatacaataatgtacagacattcattggttcccaaatattcctgggcttactgatagtttttcagagtataatgtaataatatatttatttaatactaaaagtccatcagagaacagtttctatacagctgtcttctctggacccagggctttgaatggggcagagccctctagcctgtccttcagatggaagtgttcttggagatctgtacatgtcactgggcagcatggaaatggctgccgatctttttatgtacgaacatgaattaggctgggagtccagatggtagagggccctggaggacgccaggcttgtccgctgtaaaaggcttctctgaaagccctgtgttggcttggccaggtcccctctgcaccacacagcttggcaagaccagtttgcagctgcacttcccgcctgtcctgggcactgtttgagagactgtgacaagcggcagctgccttctggtgatacaactcgcctccccactttcaggcgggtggtaccactagagacactgagttgaaaagcccttcttggcccagagagaacctcaagcagggaattcaacatccttcttcgacaactgggatgggagctgccatgtggcctgggcccagccatgagaaagctgagaacatccacttggacaactcctcccctggcagagggagctgaaagcgtggatggagtgactgccatctggtgggcgtgtgggagccagggtgcatgggatgggaggcgctgcctctttggaggctgagatggctggctggcgggtgggatggccgtgccaggggttgggggccattgccctccagctgccaagagtgagcaggctgccccagatgagcgaataacctcagcagtgtttcatctaacctgcttgcaggacacagcttccatatgcttccaacttcctctgtgtgctctccctgccactgcagctgctggatatgggcagggaagctcctactcgatggcttttcaggcaccaggtctatggggaaatgctgggagattctgggctaccagaattgcctgatactctgagcttctttctagccctaatctcagaggttagattcccagggactgcttatagaggtgaaatcatgttgagggcacctctgtaaacccatctgcttcctacctcaatcctggaagagagaggctctactgtgaggaacacctcttttaccccaagcaatgggagcgttttaaggcaatgtaacccattagagatcctgccacccatgcacttatttgtaatagtccttccatttattcatatatattttcagttcgaggaggccttttggatagtgcggcctcaaacttccatcctcatggaaactccataatccatatggcagtaacactctaccagagctctttgactttttttttttaaaaacatctttattaagataaaatttacataccacccctttaaagtatataattcaatgtattttataatcttcataggattgtacaactatcaccatgatctaattttaaaacattttttatcctcatttatcctccttaaaagaaaacagcactttgggaggctgaggcaggtggatcacctgagatcaggagtttgagactagcctgaccaatatggtgaaaccctgtctctactaaaaatacaaaaaaattagctgggtgtggtggtgtgcacctgtagtcccagctactcgggaggctgagacaggagaatcgcttgaacccaggaggtggaggttgcagtgagccgagatcgcgccactgcactccagcctgggtgacagagtgagactgtctcaaaaaaaaagaaaagaaactgtgtacatcagcagtcaattcccattcttcccactccaagctccccttgcccccagccctaagcaagcactaatctccttcctgtagctataaatttgcctattctagacatttcatagacatggaatgatgtaagtatgtggtcttctgtgactgcttctttcacttagtgtaatgttttcaagggtcatctatactgtagcgtgtatcagcactttgctgcttttcctggttgaataatattccattgtatgaatataccacattttgcttatcctttcattagctgatggacgtcggattgtttccattttgggctactatggataatgccactatgagcattcatgtctaagttttgtgcgaacatacgttttcatttctcttgggtatatacataaaagaggaattgctgggtcctttgttaactctaagtttaatcttttgagaactgcaagactattttccaaagcagttgcaccactttgcattcccaccaggagtgcatggggttctaacttctccacatgcttgtcggcaactgttattgtccatctttttcattctgcccatcatagtgggcgtgaagtggtgtctcactgtggttttgatttggatttccccagaggaaaatgatgttgagtatcttttcatgtgcttgttagccatttgcatattttctttggagaatgtgtattcaaatcctttggccttttaaaaacttataattgagttatattaattttctatatattctggatacaagttgtttatctgatatacattgtgcaatgtatatcagtatatatctctgtctgtggtttgtgtttttacttccttgatggtatcatttgctacaacacaaacatttctaattttgcggtagttcaggtaacctgtatttttcttttgtcacttgtccttacttgacttcgcttaatagtaacagatgtttaaatatataggattctttaactgttttcaaggcattttcttttcaagtcccacctctgagcctcacaacaaaccaaaggagtagaaaagtcagctacagttatgtctacagaaggcagagcagaggggtccagtgactcactctaggttgcatatcaggttagtggaggagagaggttgaagcccagatctcgggctcctaatactaccctgtgttctctcaggagtgaaactttcccaacaagtggggataaattaccaggcttctggtcccatttggacacatcaggtcattttgccccgtgaggcaggatggtgcatagtcagacagacccaggtggacgttttactgcctctgctcgctggctatatgacctttgggaagttatttaccctctctgagccttggctacctcgttgacatttaaaggggtaacaaaagtgacaacctcatagtgttgctaggtggtttagatgagaaaatgctcataacattctttttttttttttttttttttttttttttgagacagagtcttgctctgtcacccaggctggagtacagtggcgctatcttggctcactgcaaactccgcctcctgggttcatatgattctccttcctcagcttcctgagtagctgggattacagacactcgccatcatacccagctaatttttgtatttttagtaaagacggagttttgccatgttggccaggctggtctcaaactcctgacctcaggtgatctgcctgccttggcctcccaaagtgctgggatcacaggtgtgagccaccgcacccagcctcataacattcttaacatagtgcctagcacatagcaaatgctcaattaatagttaatattattctttaatttttattaactgtaatgcttcttccaacaaagtagcctaaccagtaagaattcttccagtttacctgcattattaactcacattacccatctggtcattttgcagaattataaatgttttctcaggaaggaattgaagagatcagctagtccaactccccagaaaacggaagtggtgtgtacaagattgcacagcaagtgagttttctaacacgacctctcagaagtctcctcttttgtttccataaacctggctgcttcagtgcaaagctacagatagctctgatcgattcattcattcattcattcattcattcattcattcagagacaggggcttgctatgttggccagggttgtctagaactcctggcctcaaacagttctcccagcttggcctcccaaaatgctcggattacacgtgtgagttaccatgcccggcccagacagctctgattttgaacaaggtcaaaggaagctcccaagagagactgcaaggacccagagagatggcagtgcccagatcttagtctggaatcacatttggctcctgaaaaccctctttctaacccagtctctgtctgaacaaaccaattccatttctctcctgtgtttaaagcaaataaagtgagctctgaatgtcagcagcatgtggtgtttaatttgcatctcaccaaggaatacaagacttaaggatgatgagcgaaaaagatttttatggaaaccaaattacagcatctgagacacaggcttgtggccatatcagctcaagctgtgatcttgttagctgtcataaaccaagctgggtttgttccctgggtgaggacactcagggcaaatgtgtaaaatattactcaggtgtttctgcagggagtgctgttcatccttttcaaaggctgcaccacagagcacagctgatagactgtgtctggtgacagggaacagggaccacaattaaaatgagtgaaaacacagtaagaacatgcatgtctcgccatcagaagcccctaaggaggggcgtgcccgggattgggtaattctgaggctcaggggccttaccaaggacttgggctctgtctgtctttccttactgacacccttggcttgtctttaggtggattcgcctcactcctctgatggctgctgcgattctcacacacagatgacagtgtccagagaaagggatattactgccctgtgtcccttgctaagtagatcacccctcactggcttgaatgtcaccacacgcccatgactaagccagttccacagcaagggtaataaggcaacaaatgctagcttaggccaattaacagtcaccccttaggatggaggacgaccaacctcccctgaagaccctggccactcagagtagagtgacccaaacgggttctctgtgaggaagtgatggatgactgctgagcaggcaatcaatggtgtctccctcatgcagaaggcctgctccagtaatgggatcctgggtattccagacaaaccagattagctagacatctgccccagaccaacaggctggcttggtgggtcatcccaactgagactccgggagagaggcattgggcctaggaacctgcacaccagggctctagtcacagctgtgctgataaccccactgtgggtctcagtgacccacatgaagagatgggcttggactagatgatttctgtggtccgtcacttctaatacccttcgataaatgtatacttaattaaaaagaaaaaaacaggccaggtctggtgactcacacctgtattcccagcactttgcgaggccagggtgggaggatcacttggggccaggagttcgagaccagaatgggcaacatagtgagacccctgtttctgcaaaaccaaaaaaatttgccaggggtggtggtgcacacctgtagtcctaattactcggaggctgaggtggcaggatcacttgagccaaaggagttagaggtttcactgagctatgattgtactactgcattccagcctgagtgacacagtgaggacctgtctccaaaaacaaacaaaaatccccaaagaccctctgaaactttggatatttgtcctgtccaaatcacataatctgagctgcattgttggaggtggggcctagtgggaggtgtttgggtcacgggggaggattgctcatgaatggcttggtgccctcccccaggtaatgagtgagttctcactttattagtttatgcaagagctggctgtttataggagcctggtacctcctcctcttctccctcttcttgtcatgtgacacacctgcttccccttcaccttccaccatgagtgaaagctttctgaggcctcaccagacacagatgctggtgccatgcttccagtactgcctgcagaaccatgagccaaataaatctcttttctttataaattacctggcctcaggtattcctttacagcaatgcaaatagattaacacaccgttttttaaattactatccctagagatgcctaacccgaatttccaactagaagctgtgttaatttctattttaattctttctgttcctcccatttaggctgatgagcaatggcgaggccaagaaaagaccagagaaccctggagccagagtcacagacaattcactcctgctaatcttcagttgactataacaagctgcctggggtttcctccctaaattcgcacacagcattgctgtgtaacagctgagcaagtgacagattcctggctttgctacctctaggagtctagataattctcatcataactaagtctgctatgctgtgctgtgggtagagatttcttaacttgctgtatataaagtggcttcaagggatctgcctgcgacctcgtccacccagagcattttggatttcaggtttaggtgggtgaggatttttctgccatgaagaatggtcggtgctccttgcctgtcactgttgctctgcaaccatatgtgcctggtactgttctgagtgtggtggggacagaaggcacaaggttaatcatgtccttatagttggaggacctagaataatgtttaagagaaaacagtgtatgtcaagcgctcaatgcggccataaaattcctagtcctaattcttagttctaagacttgagaggccagggggaagaacgaggagtagagtttccaggcaggaattcttggaggaagtggggcctgaaacactgagcaggatttgctaggaaaagagagaagggggcaagctccaggcaaagcgggtggaataacaggaggctgggatttgcagggcgagttgtgtgggggaagctgaaatagacgcaggccacggggaggaaccatttatccttccttcaattttatagcatccagcaccaggcagcccttctatttagatatgtgggtgataaggaagagagctgaaaaaacagactgggattgcctggtttcctatagggtgtgaagctgaaattctatgagcaaatctatgtaatttaaataagactacaccaactaggacgtgctgagaacaatacaggaccaggggtctccagccccactttggtacagtcactgctggagtggagggaaaatgagtcgagggtgggtgcgttctcctccaaccatggcaactcattctgaatgcactgcagaggctgtgcccccagaggaccctcagggaggtggtcctgatcgaagatggctcccacgtgcagacgctgagaatgagcccaacccatgagaggcaaattaccacgaacacattttattcaagggaaggaatgtcaaagccaggcctttgtttctttaaggtttgctgaaaatagaaaggttgttttatgggcaggctgagcaaagagagagaaggcagagagggagtggtaagaaaaagaagggggaatgaaataaactagaatgtggtcaatataattttatttgctttattattcctgagtatggtgccaataagtctgagttctgcgactcccagctccaccatcacagagaatgtgagcaatctcgcttccagaaatgagctgcccactaaaaggaaaagaatcaccacatcacagaacaggccaataaaactctcagctcagcccagcctgattggatggagtcctcccagcaggttctgaatgacctgtgcatcagtgctggaggacaaggcaggcctgccgggctgcagcccattctttcattgaactcagaccatggggtcagtggatgcagagtcaggccctggctgggcatgggcacaggcaggacgactcagacatgtactggagacagtccttgccgacagggagctcccggtggaagctctggttcatgtctttgatcagaatgactctgcttcaaacaaaggtagccttgcttttttccactgcagaaaagatgagtgagagagttcccaggagacttttggtggtcgaagggagagaggacaggaggaaggtatttagtcagacttcagagcacacctggcagcacgtgcctccgttaactccaaggagcaaaatgcatttgggacctccaattttttttgttgacctctggttctttttttttttttttttttaacttataagataggcctttcctgatgccaaataagggcaatgatcagcttccccattcctggagccaggacctgccacatcatttgcagtgcaaaatgcaaatgagagccccttgttcaaagagcaagataaaagtgccatcctaggcgctcaaaatacaaaggttcctcctttcttctatggtctgtcaattggtcaaggcattttaatttgctacttaatgtcatgcttgctgggcactggaatactcatgcggtgagtgtaggatcccacgggtatctggaggctcgccctgcaatttagcatgtgcaaggagctccccacctctgccagcccaggatgggcgtgtgatgccctggctggggtgagtgaggttgagccaggtatctctgtgtctcatgggcccaaccgacacgggagagaagacaatccccatggggactgcaacctttgaactgggacacatgaggcctctgggttagggtcggggagaggctcgtccccctgcccagccacccactgcatgtgcccttgtgctgtcagcttggggcaaaacgcgggtgccatgtctgggcctgtgagccctgtcctgacctggcatgcacccatgccctcctggggtgctgggtagcagcagttactgtgtagggtggaacaggcaaggccaggtggggccagggcagcaggctggagctggcagctgagagggacccatgggagccaaggctctgagcccaggcagatgctccatcatcccattggacttcacttaaaaaacacgaattcaaagataaagttattaaggatttcaatatgccaaccacagagcattaaactaagtaagaggccatcggcgtacagggccctgggaggctgcacagttcactgctcctgcctggagccaccgggttgcttctacctttgtcttcctctaaaagaaaatgcccaagccacagctacctccaaggttctggggattgttgccttctgaaggcatccagttcctgccaatcatctacccagctacctatctgcttgaattcccctaggtgcttgctagtagaaaggtggaagaaaatttcccagactatctccaggtaaccaaggaggtgacagtttgggaagcttacagaaagctccatggagacagaattttaaataagctggagtcccatgtaattaaaataattttgaattaaaactaccacttcagtaattgcttttatattataatatttactaccattgccattgtgtaacttacctcattagctactgttggagaaaagtcagtcaatgaataattaataggatgtgataaccaagggagtaatggtgtttaaaaacagagcttgaaagaaagtgtcacccacacgcagccccattaataagagcctcgcagtccaatgccacttgcaaggaggtgaggccctggcccgttgcctcctgttattagaggtcaatagaaaaatctcctcagcctcatcacagacgtgcacataggtcaggaattctccttaatggcagcaagaaaaagcttccactttatcaaagcagacagtccttggcacaagtaactcagcaaaaatacaaattagaaatagcacccaaaggccagccaggtgctgaggctgccagccatgcttcagagaaagtggcagtctcgtgtctgccctccggagacgaaggcgggagggcagcaagtgggagctccgccagatgcctccgacctgcatacggctccaccctaccgatttccaaacaggcccagtgcttgcagcaagcaccacacacacttgacacacacaagatacagtctctcgtggaaaatctggaggaacggttgtgcacagctcctgctggaagtgagatgcttattctactgcttggaaagagaggagattcattttcaaggaagctttcttgaagggcgagatagaattttgacttaagttgcatccactgtttgtatatagatggtctttcaagatcctgacattttcttatgcaatttccaagaaagatcaaatacttttagagaatacttttttcttaacggtctttcaatcaaaatatcgtttgcgtagggttgccaggcaaaatacagggcaccccgtgaaatttgaatttcagataaacaatgaaaaatatgcaatattagggacacatttagactacagaattattcattgttcctggatttttacttgctgaatctggcaaccttaagtttgcaatctttcttatccatccaacataaagatgtgtggtgctgagcatgtctggtgctgagcacagagagggcctttcttggaggggttgtgtatggattacttaaggaagataaatgacacctggaaacagcatcaacattaaaccatgtgcaggagatttcctgcttgaaattttgcaaagtgtcttctgggttgtatgacaggatactagacgaaatgacaagcgagaggattaattataattaatcacagaaggaaagtttgagggcctgggaattcatatttcaggttgccaaagctatttaaaaagcaatgtaatacaacagttgtaatggaagaacagtcagaagataaaagtaaagcactgataaaatatcatatgagtctatttcaaagttgcaaaattcaaggttaaaatatttctctttagagcttttgaattagttgaaggggatgaaaggcaagctttatgtaaccacttttccagtgaaataaaacctgtttacatcttggtgactgaaacaccttccagctaatttagaattctcaagtggccacatgaaaagattagaatttctataaaaagaaatgtcccagttgcgttccagttcaggtatagagaacgcagttactgaagggtcttcagttcatctgagctagctgagtgccacccatcggaagctgctgcgtttggacactagaacattagaagatgttattttattcaacagaaccagcttggtagaaatgttggaatttaataaagacaagctctctttgtggtgttttactgaaagaacacagtatctgcaaacctagagtccatttcccaagctcacgtttgttgttgccagttttatttttacactacagaaaaggtagaaaattcctttggaaagtctgcctccctcccttccttccttccttccctcctctctctttccttccttccttcctctttcctcccttccttcctccctcccttcttcctcccttcccttccctcccctccctttctctctcctccctccctctccttcccttccccttccttccttcctccctccctccctctccttctcttccccttccttcccttccctttccccttcctcttccttccttcctccctcccttctcccttctccctcccctcccctcccctctcctttcctttctttcacctttaaggtcaggggtacatgtgcaggtttgttatacaggtaaacttatgtcaccgggtttgatgtgcagattattttgtcacccaggtgttaagcctgttatccattagttattgtttctgactatctccctcctcccagcctccatcaactgacaggccccagtgtctgttgttctcctctatgtgtccatgtgttttcatcgtttagctttcacttgtaagtgagaacatactgtagttagtttcctttcctgtgttcgtttgctaaggataatggattcctgctacatccatgttcctgcaaggaacatgatttgttcttttttatggccgcatagtagcatagtattccatggtgtgtatgtaccatattttctttatccagtccaccactgctgggcatctgggttgattccatgtctctgctattgtgaatagtgctgcaatgaatatatgcatacatgtgtcttataatatgatttatattcctttgggtatatatccagtaatggaattgctgggttgaacagttctgtttttaggtcttcgaggaatcaccagtgttttccacaatggctgaaataaaatttacattcccaccaacagtgtataacgttcctttttctccacaacctcgctaacatctgtttttttttgacttttaaataatagccattctgattggtgtgagatggtatctcagtgtcgttttgatttgcatttctctaatgatcagtgatgttgagctttttttcatatgcttgttggccgcatgtatgtcttcttttgtaaagtgtctgaccatgtcctttgcctactttttaatagggttgtttttttcttgtaaatttgtttaagttccttagaaatgctggatattagagctttgtcagatgcatagtttgcaaaaatgttctcccattatgaaggttgtctgtttactctgttgatggtttcttttgctgtgcagaagctctttagtttaattggatcccatgtgtcaatttttgcttttattgcaattgcttttggcatctttgtcatgaaatctttgcccattcatatgaccagaatattgcctacgttgtcttccagggtttttatagttttggggttttatacttaagtctttaatctatctcgagttgatttttgtaaatggtataaggaaggggtccaatttcaatcttctgcatatggctacccagttttcccagcattatttattaaatagggaatcctttccccattgcttcttttgtcaaagatcagatggttataggtgtatggccttttttctgggctctctattctgttccattggtctatgtgtctgtttttgtaccagtacccatgttgttttggttaccatagccctgtagtatagtttgaagttgggtagtacgatgcctccagctttttgttctttttgcttaggattgccttggctactagggctcttttttggtttcatatgaactttaaaatagtttatttctaattctttgaagaatgtcaatggtagtttaatgggaataacactgaatctgtaaatttctttgggcagtatggccattttcatgacattgattcttcctatccaaaagcataaaatgtttattcatttgtgtcctctctgatttccttgggcagtggtttgtagttctctttgaagaggtccttcacttcccttgttagctgtattcctaggcattttattctttttgtgacaattgtgaatgggagttcatgatttggctctctgcttgcctattgttggtgtataggaatactagtgatttttgcatgttgattttatatcctgagactttgctgaagttgctcatcagcttaagaagcttttgaactgagacaatgggggttttctagatacaggatcgtgtcatctgcaaacaaagataatttgacttcctctcttcctatttgaataccctttctttctttttttttttcttttttcttgagatggagtctcgctctgtcacccatgctggagtgcactggcgtgatcttggctcactgcaactgccacttcctgggttccagagattctcctgcctcagcctcctgagtagctgggattacaggcacgtgccaccatgcttgactgatttttttttttttttgagacagagtcttgttctgttgcctaggctggagtgcaatggcacaatcttggctcgctgcaacctctgcctcccgtgttcaagcgattctcctgcctcagcctcctgactagctgggattacaggcgcgtgccaccatgcccagttaatttttgttatttttagtagagacggggtttcaccatgttggccaggctggtctcaaactcctgacctcaggtgatctacctgcctcagcctcccaaagtgctgggactacaggtgtgagctaccgtgctcagcctaatttttgtatttttagtagagatggggtttcaccatgttggccaggctggtctcaaactcttgacctcaagtgatccacctgcctcggcctcccaaagtgctgggattacaagtgtgagccactgcacccgggccctttatttctcttgcctgactgctctggccagaacttccagtactttgttgaatatgactgccttttgatcagttttgacccagtactgctctcactaggttaatcagccatttcagttaaggcttggccctgagtgacttttgtcagtgaagtctcaggatacaaactcgacatacaaaaatcactagcattcctatataccaacaatagctgagccgagagccacatcaggaatgcaatctcattcacaattgtcacagaagaacaaaatacctaggaatatagctaaccagggaggtgaaggacctctacaatgagaactacaaaacactgctcaaagcaatcagagatgatgcaattcctctgtagacccgattacatagaccctccgactgtactgagtgcagctttccttttttagaacaggcaggtaggatggtgtctcagtcggtttgggctggctataacaaaataccatagactgggaggtttaaacaacagacatttatttctcacaattctgaaatcttcaaatccaagatcaaggtgccagtggatttggtcccatggggaggctcctcgtcccggtgtgcggatggccatcttcttgctgtgtgctcacatgacctctcctttgtgagtggtctggtccctcttattcttcttataagggctctgatcccatgatgggatcctacccttatgacctcacctaaatctaatcacccccaccaaaggccccacctcctaatactatcacattggggattagggcttcattgtgtgaattttaagagaacgtgaacatttagttcataacaggtgctgagatagataagctagtgacaagtaccatgtttcactatagacccccttctgagggctgcctatgggggcaagtgtccccacacctcagaaacactaacatcatggaagggtgagctcaggaagacccacatttcttttacgagctttgccttttctaaggttttagcatcaagacttccaggagatgctcttcatcggaaagctcatggccagaggcaaagataacactggaagcatgatgaggatgcgctgcatgaagcttgcaaagggggaggttaacacggaaatgttaaatactaaccacagtgatggcagtggtgttagaaaacatcagtctacaatagctactgaacacctgtctcagaattaaagacatgactaggatacagtctttactgcttcctcaataaatttacaacaaaaatagagattaggccagagtgggaaggattacagtcccagggagaatcaacaggcatgctttcacatggttggggtacagcaaaggggcccctgccttggtggaaagagaggggccaggtatattagttcattttcacagtgctataaagaaactacctgagagtgagtaatttataaagaaacaaatttaattgactcacagttccacatggctggggaggcctcaggacacttacaatcatggcggaaggtgaaggggaagcaaggcacgtcttacatggtggcaggagagagacagagagtgagcaaagagaaagtgccacccttttaaaaccatcaccttgagtgagaactcactcacaagaacagcatgggggaaaccactcccataatccaatcacctcccaccaggtccctctcttgacatgtggggatgacaattccagatgagatttgggtggtgacacagagccaaaccatatcaccaggcgtgttctgggctcaccttgtagaagaagtgacgtagcagagaacacagggtttcaatggtcagtggagctgagacagaggagggcatttcagaaggaagcagctaccagctaaggctgaagacagggaaacactgtgagctgctgcagggaggcaggcagagcagaacacggagtggggctcaggcagggcctggctcctgggagtgcctggacgtgtgatccttcccctcggccgccaaagtcccaggactagcactctagaaatgcatgtgctcttctttcccaaagaaccccagccccaggtcaatgaaatggttaagctggacttctctccacaggtggcctgattcttgtgtgaactgccacctgtcatgacacccaatccagacaatgtcctttaaatttgtccccatctgcctatcaagagattacccatagtaaaatacatacaatataaaaataaccattttaaccaattttaagtgttcagttcagtagtgttaaagtacattcacactgctgtacaaccatcaccaacacccatctccagaacccttttcattttcccaaactgaaactcaataccccttaaatggcaactcccatcttccatcaccccaagccctggcaacaaccattctacctcctgtctctatgaactggactactccagatactgcatataagtggaatcatacaatatctgtccttttgtgaccatcttctatcatttagcaaaatgtcctcaagattcatccgtgttgcagcattgtggtagaatctccttcttttgtaatgctgaatgatattccagtgtacagatatgccagttttgtttatccagtcatctgctgatggacactaggattgcttctaccttttggctattgtgaataatgctgctgtggacagggtgtccagacatctgttcaagtctctgctttcaattcttttgggtaataaccaaaagtggaattgcttgatgatgtggtaattttatttttaatcttttgaggaactgccatactgttttccacggtgtctgcaccattttagttcccataaaaaatgcataaggttccaatttatccacaaccttgccaacacttttttttttttttttttttttttttagatagagtctcgctttgtcacccaggctggagtgcaatggcgtgatctcagctcactgcagcctccacctcccgggttcaagcaattctcccgccttagcctcccgagtagctgggattacaggcacccaccatcatgccaggctaatttctgtatttttgtagagaaggggtttcaccgtgttggccaggctggtcttgaactcctggcctcaggtgatctgcccgcttcggcctcccacagtgctgggattacagaagtgagccactgcacctggcctcaacactttttaattcttattttaagtagccgtcctaatgggtgtgataaggggtactgagtttcagtttgagaaaatacgatatctcactgtggtttaaaccaggacacttttaagagtgaaggaggcaccacctgtaattatacagaggcatgggcgcaagctggggtgacggcagctatggtccgtccagggcatcacacggggagtggtgccactggggccttctgagctccccggggctggggtttggaagaccagagcgccaggcttcgttggagagcagaatagccttcttaggggcccagctcctacctatcatctacccagctgcctgtctacctgaattcccctagttgctcactgaaagatagaagaaaatttcccagactatctccaggtaatcaaggtggagacagttttagaagctcaaggaggctcctgtggaaacaggattttaaattagttgaagtctcacgtaattaaaatgattttgattgtaatggtcacttcagtaattccttgtctatgaaaatatttaccagcattactattgtacaccttatcacatcagtcaccatttgaaagaagtcaccagccaccctaaccatggaggtgaagagttgagagtgaaggaggaaacggagtgtttgactttatcctttatcactcgtcaaggccaatggcgaatcatgtcgctttttgtttttttagtgcgactgtactacctagagacacgggctatttggaatcagctttttgttttacacgcctctttccccaaaatcatctgctaaggcttgacaacagtgctgagaggcggacgggtgactattactctctccacttgacagatgggaaaaaagactcagagaaataaagtcagtcagtcaatagtcaggggtacatcaggcaccgtacacgtgccgagatttgacaggcacaagctggggtttgctgtccatggaaggcaggaaatgaggtgtctcagcacagcagtgatgagggtcaccaaaaggcaagcagatggtgctgtgtggacgatggcaatgcatggagggcctgctgggggatagggtgtttaagctgtagcctaacgtatgggtagaaggtggccaggtaagctggaggggaggaaagaaaaggagccaggaaaggaaaacagctccagggagaaggtccagcatgtgtgctatagtttgaatatggtttttctgtcccccaacaaaaccagcattggagtttgagcctcactgtgtggttttgggcctggtgggaggtgtttgggtcatggctgtggtggatccctcatgaaaggctcggtgccgtcctcccagaagggagtgagttctcatcctggcaagatgggattagctctcatggaatggattagtccatgagggtgggttcttacaaagcgagtggttccccacttcctggcccctctttgcacctgcccacttctcctctgaccttctctaccatgtttggatgcagcacagaagccctcaccagaagccaagctgatgtcagtgccccacttcctgtacagcctgcagaactgtgagccaaataaacctcttttcttccttcctttttttttttttttttttttttgagatggagtctcgctctgtcacccaggctggagtgcagtggcatgatctcagctcgctgcctcctccgcctcctgggttcaagtgattctcctgcctcaacctcccgagtagctgggattacaggcatgtgccaccatgcccagctaatttttgtatttttagtagagacagggtttcaccatgttggccaggctagcttctgacctcaggtgatccacctgcttcggccttccaaagtgctgggattacaggcgtgagccactgtcccaggccacatcttttctttctaaatcacccagtctcaggtatccctttatagcaagagaaaacagacaagacaatgtgcatgcacaggtgagggagaatgaaacctctgtgactgtctgtagtcacatgaggctatggcagagctaagctgtggcttggcagagccaaggcttgaaggggacccaggaaatcactggtgagcccttccgattattcagggaatctgcatggtctccacagccctggagtttcacttcctcattgaggcaagggagttagatgactgaaggccggtgcccagagaaacaatatatgggcagggttcacattttaaaaacccatggcatacaaagttggtgtagagaagggagcaaaatttgtccttcattttcaaatgctagtgaataggtaatagttctccagtcagctggaatgaaggggaaaagcttcaagaaatatgtcttaggaaataacgttggcttggcactcccctccttcattatatgtctaaacacaaccattgcacttttcaagttttttttttttgtcatcttctatatttaagtgcagaacacagaaggatggttgaagtccccagatccacttccttggatagaacagaactagacgaggtgtgttcttgcaagcagcccccagcagaatccagccatctgggcaggagaacagagcagcccctggccccatgtgcagtgctcagacttgtgctgtgagcacgacttgaggcagagctggattctgtcatacacacacacacacacacacacacacacacacacacacatatggttgctgtatatcatgtatatgatatatatctctatgtacgtgatatatacacaacatatctatgaatatgatatatacacatatctctatgtatatgatatatacacatatctctaggtatatgatatatacacatatctctaggtatatgatatatacacatatctctatatatgatatatacacatctctatgtatatgatatatacacatatctatgtatatgatatatatacgtatcacatctatgtatatgatatatatcatatatacatatcatacatatacacatatcatatatgtatatgacacagggtcttgctgcatcactcaggctggagtgcagtagcacaatcatggatcactgtaacctctgcctcctgggctcaagcaatctttccacttcagcctcccaagtagctgagactacaggtgtgtgccaccatgctaatttgtgtgtgtgtgtgtgtttctgcagagatgaggtcttgccatggcacccaggctggtctcaaactcctagactcaagcgatcctcccaccttggccttccaaagtacagggattacaggtgtgagctaccacatctggccaattttgttctatttcaagggcactcaggttgatggaagagggatctctcaggcatctagctccatctgccaggccctccctgctgaaggccacaatgccacccctaaacctggctctaccccctactgtgttcattaaccttgggcaagtggctccatctctctaggcttcagtttccccacatgtaaaataaggatactgacatttgtcccctgggctgtctggggatgaaatgggatgatggcagcaagtccccagcacagggcctggggcagcaagcatgcaaccctgagagactacgaggtcacatacgccccccacatctgccaggaccacatgcctttgccagagaggggcaggttatcatctggcttggtgggaaccttccaacaacagcgaaggccatgaccacagtccttctgtaattccattaaatagtttagtggctggggccatgattcaaagagaacctggacctccttcacgtagtccctcagatgactacaccttaatttgctgtgcttgcattgggtccatggttatttttcttggcttcttagcaccagcattagccaggctgaataggggtttctgtctccaaagtaagatgaggaactgtggcctaatgtggctccctgactcactggctgggaacagggtgaacagggccacagggaggccatgtggggagctgccagggcttcagactcttggcctgggctgggcttcatcgaggccctgtccagtcggctggattggggccagtgagcaggcttactttgtctgtgaaatagaaaaaggggccatggactcacccttcacaagcagttggttcacttcaacattttaatggaaccgacctgaaattaatgagcactgtcacactgagtaaatactgcctctcgggatgagagcggcaatgggtagaaggcagtgtgacaattcaaacccaaggccacggacaattacatagaggaagtctgttcagaatttggcggatcgaatggctgtccccaaataacaggcatgcagatggctggagtctgatgctgcctggcgagggcagaggcagatgctgcattctgagggccagcaagaggacacgacgtggcagtgggccagccagccacagccgggagccagcacaggaaagggagttggacggagtcagaaggtcaggccgccccagtgaacagggagcacattaacctttccaaagccacgggggagcttatcaggctccaaaatgcagtcatcaaaggccagccagcccagtgcagccaaggctggcccggggctacctctgggagcaggtcacggggcggcagcctgtgagcggaggtgagggcaggccctgtgcccagagtgagcagctgcagggtggtgtgctccagctggctctgggagtcccaggctggagagtggaatggtcagggtgggactgttccaggggtgggaaaaggggggaaatggagaggacgggagtgggtagagggtgctggcctgaagggctcttaaagccagagagaacagactccatgggctttggccagttttctttactaaaaggagatgaaaaacagaacaaaacaaaacagatttgatatcatgactttaactcccatgaaaagtagttaagtagtttggttttaaacaaagcaaaacaaagcaaaacacctcagtctatctattggctttaaaaccacccactcatcacagatgcttttgcggcacggcctccgcccactgcaggcacaggcatgagtgatgaagacagtggcacctgtgttcagaaacacatacgggcactgaaatgcatcttttttgaatctttttttctccctgtcacatatatcatttgttgcgtttggattgcttttgaggtcagatctggctcaatgagaatggggacgacatatgcaaaattaaaaaggggggactaccaggtgtaccttcacatggcatcagtgtaaacattctaacagaaccgaccaccaattaaccaatcaccaaccaacacattccatgcagacagcaagtgcttaatttaatctaagtacattcaagaaggaacaggtgtacttctacttcagaaatagatattttaaaaaaagaagtagggtagacagcagtgacaaacactgaaaactatgctaattaagtcttctctctcttaattccaactatgagacgtcatgcgtattggatacttaaaatttttttggatgtaaatttaaatataagttaaatgaaccattatgcattagatacacagtgttatgttgtccttggtctagaagggacagctacattggcattcaaaaggagtgtgacatagtgacaaagactcaagtaaaaataatttatagcttagtgatttcaatattttacccctggtaacttaatatacttagtctgaggatgagttcagaagagaggtagcacaaagtgggatgacaacgggccagaaccagtatttttttttttttgagatggagtcttgctctgttgcctaggctgtagtgcagtggcatgctcttggctcactgcaacctccgtcttccaggttcaagtaattcaactacctcagcctcctgcaggtgcacaccaccacacccgactaatttttgtatttttagtagagatgaagttttaccatgttggccaggctggtctcaaactcctgacctcaggtgatatgcccacctcgacctcccaaagtgctgggattacaggcatgagccactggccagaaccagttgtcttttcactgcctctagggacagtctggttccctttggccctttcctgtgttcgcagactgcagcgaggctgggggactccggtggtgggggtgggggactctggtggtgcgggttagtttttctcgtctgtggtcacagacacctggctaaggagcaggggaggggtggtgggtggggctgtgcccagctgtccccccgcccacagaggatctaagtaacttgcaggaagtcttctccactagcagagaaggaaaggacgcatgtccaggctaaaactccagcacctcaaacccaggaaagagaacatgggattcccagcccaggcctatgagaaagggggcatctggaagaacctgggaaactggcatctgcaggatgtttgctcttaccccccaccgcctgtttttcctgtttttaattctggaaacatacacataacatcaaattggccaagggtgtccagttaggtggcattaagtacatgtatgttgttgtgcagcctagaccactatcattctttctgaaagagatcaaaactcttctaactgtgccccagatcaagtcaccccatgtgtttctgcaggctcgtgggaattgtgaacattgacttgaatgggttaaaactgaatttcacccggaggagccttgggctgtggcctccttaccagacatcaggcagcgagtctgtattagtcctcaggaatccctggccactaaaccatcttaaagggcaattagtggctttatacaactcgttatttatttactcaaaagactgtatcctcagcctgctctcttcttctattgtgtaaaatacatatttgggaccttttaaaatgtgtgttatgtacctgatagaactcaatggcttctctggagccattctgttttattgtggaaattagtactaggggggcttttaaaagctgatttttagacccgacagcctgcgtttgttcacgttaatgcagtggattgagctaacagccaccaaagggctgtgagggacacctctgtggcctctctgttggagcagtgaggccaaggggctccacttttgtgactatagatggtacttgctgggcctgttagagaggagaggactgcatggagactcagttggcacttatctctcttcacactgcccccgacagttctctgccagggctcccccacgttattgaacattactgtttgcttttgaaataataagtattatttactttgaaattataaaatgagaccaattctttggagattagctggaaaggtgtcaggatatgacccagggtgacttttttatgtatttatttttttaattaatttttttttttttttgagacagaatctcactctcacccaggttggagtgcaatggagtgcaatctcggctcactgcaacctctgtttcctgggttcaagtgattctcctgcctcagcctctcgagtagctgtgattacaagggtgtgccaccgcacccagctaatttttgtattttttttttagtagaggtagggtttcaccatgttggccaggctggtcttgaactcctggcctcgagtgaggggaatcctaaagtgctgggattacaggcgttagccactgcacccggcccaggatgacttttttccgtgagtaaagtaaaaagacaatgtggcagaaacaggtggtagcctcctcggaggcatgcaggagcctcacctgggacccaaagacccacagtttggcttttaggagaaaacaggctctagtaaaacatatttcaaaatagggatggcgtgagtaatagaagggatatttcttaggatttgttgatacttgtttttctataatatcaatgtaaaaacatgccccatactactagttatgaattgcttcagacattaaacccatactctgttatcttcttctcttggtttttaagcctcttggtaggacttaaatcaaagaacatcttatgatacctcatgcgtgatttttcttggtggtgcgatgaggtaattactatcatatggagggagaaaggaagcgcctcttctattcatcacctcttttaatctgtacataaacctaacaaggagggcattagtagcatcctgcttctgcaactgggaaagctgagacttggatgtgtaaatgctttgcccaaagtaaattccagaccaagttcaaggactcaaagtcctgtgcttgcttcacgatgtcttgtaaaaagaggagagagtagggaaagctgggccagagggtttttttttttcttttgctttcttgtctccttaatcatgacagcataaatgagtggcataatttgtattcttggtcttactgcattcaataagtcatgattgagcagtcattttgtataaagtactactaatagtcaagatgtggttcttgctctcagtagttaagaccagacataaataaaggaggcagagactgtaagctgggcctatgccaggaattacatgaggtgctgatggaataggagctgtgggcgctggggcagttggctatttaaggtttccgtagaagatgaggcttgaccccatgcttgagggatgcactgcgtaaccgaagatccctcccatgagttcttgcactggcagctgtctagagctggcttcagacactttctactcagatgcccacagccacagaggggaggcctgccactccctgtccaccctgcagcctggccctgcccaggccattccttctgtgttctcctcccttctccactcctgggtcacccgatgcttcctgtcctccacatgacacctcatatgtgtcctcccccttctccttcccctgtcagagagtagggtaatattgtacctgtgtccctccagtgacactgatttcttcatagtctgatgcagagggctgctactgaagtagctaagagcaccaactctggagctgcacagaccactctgtggctttccagactgggggtgaattacctgagtttggaaagcaagactcactaggattttagggagagtactttagaagatgaaatgaggccaggtgtggtggctcacgcctgtaatttcagcactttgggaggctggggtgggtggatcacctgaggtcaggagttggagaccagcctggccaacatggtgaaaccccatctctactaaaaatagaaaaatcagctgggtgtggaggtttatgcctataattccagatacttgggaggctgaggcatgagaatcatttgaacccaggaggtggaggttgcagtgaactgagatcataccactgtactccagcctgggcaacagagcaagactctgtctcaaaacaaaaacaaaaaagaacacgaaatgaaatgaaatggagtttcatggaaaatatctctttaaggccctcacattgcattcttccttcctcaccaagagagtcgtcgcgaggactaaatgaagtaaggtatgtgagatgctcagtacactaccggacctgcgactgttctaaggagatctatgactacttatgtgtatgccagcgttgtggtatactcagtatttatgcacaagcctacatgtcctctaccacactgtagattccctgcgagtggaatccttgggtaatgaatttttgtgtcttctatagagaccagcagaatccctaacattttagggattcagtactgtaaatattcactgaatgaatgaagaagtacaaatgcaaaacataagtatgaatagttggtgaagacagcacactttaagtcatgtcaacggtacgaagcacaaaaatgagggggcaggagagggagggaggagccagaggctatctggcccaatccccactcgctacaagagacttctcgatagcatcatatagttctcttttgttattgagttctaatctaattccactctaatttaattatactgagtggttttgatctttttttttttttgagactttcttgcctacttttggactgagtttttttctcatttttccatttcttccccctgtgtgtttggattctataacatccatacaagcaggcatgaacacctctttgagccactaagcgatgagcccctcatcatctacctgtgattcctgaggcatctgttgcaaggatggatagccacagttgcaaagaattatttcctcttttaagcccaaagttgccattattttaaccacaaagcattggtctagctcatccattcatttatcaaatgacttacggtgtctgctaattgccaggtactgtgctaggtgctagagataaaaaggttaccaagccagaaatattgttacgatgcaaaacgtggcccaaacctcctatctccgaccccagccaagctgctctattggtgcttgatgggaggcaagagaatcatactgaccaggagtccagggacctgggatctagtcctggctctgccacttgtggccctgggtgagttgcatcacctgttcgcggctcagttttctcatctgtaaaatgggccccatctatctttcagggttgttgtgaggatcataaaatgagacagtaaatgtgatagtgattctaaactctaaagctctcaaagtttttattcacaacttaattgtacatttaaaaataactaaaagagtataacacaagggataaatgcttgaggtaatggattttttaaaagttttttattcatatggcatacttaaaagattttttttttttttttttttttgagacagagtctcgctctgtcatccaggctggagtgcaatggtgtgatctcggctcactgcaacccccgcctcctgggttcaagcgattctcctgcctcagcctcctgagtagctgggattacaggtgcacgccaccacgcccagctaatttttgaatttttagtaaagatgggatttcaccatattgatcatgctggtcttgaactcctgaccttgtgatccgcccgccttggcctcccaaagtgctgggattacaggcatgagctaccgagcccagccctaaaagacttctttataaggagccatattgctttggggagaccgaaggctgctgagggcctcagggcagggttgatatgcacctgccagcacgccaccataacatcttcatggaaccttaacactttcttaaaagtgctccacctccttttttttgacccttaaagaagagaccaactattagtactgtgtggcaactgtgcctgtcctctcacatggccaggggactgggtgacacattacccagaaaggtacacttctgtgctggtggccactccaacacacttcctttgtttggctggagctcgtccacttgacaaggggtcaggaagatgaagctgaatccaaccccctacactgccaggtgggtacccgctgccctccccaccttgctatggaccatttctgatctggcttctggacacagaccatttcacattcttctacctacatggaggtgaaactcccttagttttaggcaattcctcatttacttaatttcattatatactccctaatgggcaacaaggagattggatgtgtgagatttatttgagaaagggcaaaactgagggcagcaaatgtgtaagccttgtgagtcctttctccttgcaaaggcaacactcgtctggctggtgaagccaagagcacagccacacggctgtttctcatcctggcacccccagccccagcacagcaccccacagagcatgctggatgcgttcagtaaatatttgtgaaataaatgaataaatcaatggcagttgtttggatttcaatataaatggatcttgggcctgagatactgccagatgggcagacaggttacagtctggtgatgcatctccaaggctataaaaatgtagccgttgctggagtcgcaggctgacatttcagatgattatatgcacaatttaaccacatggctatctgtgccctccaagtgccatcgcttcaacaactgttttcatgttggcttttttgctcgttcctctctctttttttttaagtcaagcataattttttgcagcctctcgtatttctagctgaacgtgatttattcatataaaattatgttccatttttataaaacccaagttactgcaaatgatgcttgaggtttcacagaaaatattaattcctgatctgctgctataaagcatgcctgctcgctgagagcagcgctgtcactctgagacagatggaagcagtccaagggtatgattaacttcttagtcctggcaattgcctagtgctcctcttgccctagatttcaagattgacctccagcttctctgcagacgcgcagttgctcagcttgataaatcacatgaatcccttttttgatcagagttatctactatttactactcatgaagggaagttaatcgtattcaaggcacttcatatgctgcacacatatccttccttcttcctaacggcactttgcatattttccacattggcggtgatgtggcttctttcgcagtgcagagggtccacaccaaagatccacctttatcctgtttgtccttcttctttgtctctactaaccagcatcaaatacaccgacccacaagaagaaaaaacacgagaggcacacaataagcagtgaataagtgagacgaattctgtccctttgcaaactgagattttcttgtaattggcttctttactttgtcaagaactttgctgggccgagtgtggtggctaacacctgtaatcccagcactttgggaggccaaggcaggcagatcacttgagcccaggagttcgagacctgcctgggcaacatggtgaagccccccctctacgaaaagtccaaagattagccaggcatggtggctaccatggcactgggcagggcacggggagagctgagatggcttgagcctgggaggtcgaggctgcagtgagctgtgatcacaccactgcactccagcctgggtgacagagtgagaccctgtctcaaaaaacaaacaaacaaacaaaaccagaaaagaaaaaagaattttgccatctcttcttgccctgtttgtctgcttttttcatttctgggggacataaatgggcctctggtaggccagttgactctcagtggtataaaatagataaaaaaattctactgtccagagtagaaaagaacagacaacacaccatcccactctcacacaccccttcttgtcactgctgggcgggaggcgcaagtgagtggggctgaagcccaaactccccttctgcttgccatggtgatccagtttcaacctgaagcacattttgcctatttggggtgaaccataaattaagtccattggtcaggcaaaaccaagcaagggaaaaggttttttggggatgatcacagttgatttttaaaatttatgtaacggaaatatcacagttttaatttatcaagatgttatattgattacagaagattctctgaactttaaagcatacagtctaaactgtcagatattggatttgtgctgaaatgccaatttagaaaataaatcaggcgactggagaaatggaaagacaagactgactttccaaagacatctggacattctctaacctccaacaacccagagggatgagacttctacccactccttaggaagggaaagggaaacacacccctttctttttcttataactggtctcatcaggtcagatctcaaggctttgaagttgggcttccttatagggaaacagataacaaaaactggcttcctacagtgtaaactcatgtccttccaccaaccccaagtcaatgaaatcctgtttcatcatcgatttgtgtatcttggaacaaaatagctccggccttgtctaaatgtccttgtgttcactggacactcaaggttgaggctcagtggaagtgaaatgagcccatggatgagcaaacttataggacactgaggttctgaaggaggataagacccagagtgtgtcacagacatgctcctccatgaggaaccagtgtgcatggccagagccagtacgggcttttctgtcctgtcccagaattatagaactcaggaagcaccttttgaggtctgaaaagtgcttctcccccaagaacaaagatgaaggcatgagctaatcattatgaaattttatataaagaggtgataacaggctgaaagcaaaaggtttagggaaccaggatggtttgtgtaaatgaatgtataataggttaataccaggctccaagtagccagagatattgggcctagaaccccactttgggatattcaggacctggggagatctttactcaattcctttcccaccctgaggttcctctggcagccagaacattaggcaagtcatacagtggtctgacttgaggcactcgggtcatttttctagaaaatattggtttattcaaaagaataagtaatgtgagagaaaatgacatctgtcacttgataagttattctctacttaaaaactagaaaatatgaatgcaattaattcagcaagtgttttaaaatcattattttgaagaagggttttaatttccatcttgaaatggttacaaatgcttatcacttatggggattacgtctgtggccctgaattagtagagaatagacaatagaaaaagaatggctgttattgaaaagtcaaaaaacaacagatgctggagagcctgtggagaaaaacgaatgcttgtacactgttggtgggagtgtaaattagttcagtcattgtggaagacattgtggtgattcttcaaagacctagaggcagaaataccatttgatccagcaatcccattaatgggtatatacccaaatgaatataaatcattctattataaagacacatgcacgtgtacgttcactgcagcactgttcacagtagcaaagacatggaatcaacccaaatgcccattaacgatagactgggtaaagaaaatatggtacacatatgccatgaaatactatacagccataaaaaggaacaagatcacgtcctttgcagagacatggatggagccattatcctcagcaaactaatgcaggagcagaaaaacaaacaccacatgttttcacttgttaagtgggagctgaatgatgagacccatgacggggaaacacacactgggtcctgccggtgaggtgtcaggggagggataacatcaagaagaacagctaatagatgctgggcttaatacctaggtgatgggttgatgggtgcagcaaatcaccattgcacatgtttacccatgtaacaaacctgcatatcctgcacatgtgcccctgaacttaaaatacaagttgaagaaaaaaaaagaaagaaagaaaaaagaaaacacacagagaaggtagctttacacaactgcactgctagaatagcaaagtcagctcgtcactttgaaatgaccaattctgaatagaaaaagtgctacagtaaagtaagggaaatgccctattacatttgaggataaagaaatttgtaagaagagtggtgacaatgaaaacctctgtttttgggtggggaatgggcttgacaagggattttttgtgaaaatatcagaaaaaaaggaaatggcattgttcatcattaacatccatggacattttctctttaggacaaagttgtatatgttttgggaagaaatcttcgaatgtatcagtcctagtttctgatgaattgtctttgtatttgtgaccatgtcttcaaaataaatccttattttcctaaaataggttttgattcattctactaaaggtcataatgaccttttttttcctgtatttatatgtgtagctttactaaaatataatttacattccaaaaagttcacccatttaaagcatacaattcagtggtctggtatacttacaaggttgtgcaaccatcaccataatctatttttacaacatcatcatctccaaaagaaatcttgtactcattaacaatgaccaagtttcccttgcgtctcagtgcattttgttgaaggaactgcttacttaagaagaaaagtcaaagacagaaaagaaatatgtataggaaagaaatgactatgttatattctacatgtgttttgatctagactctttcctcctcctactgacacattcagaagcagagcagtcatcagcttttgtgaaaatcccaaaagcaattccagaagatcatgtgccagccactcaggacacgcaggcttgtgtggttgtcatggggaaggttttgtaattgaaataaaaatactcatgctcagtctgccaccacacagaaaatgcttttcactcatgcacaccagataattcgcctaagtgacaggttttactttggaggaagcaccgagctaagctggtttacacagtcaatgatggctcattccatgaaaaaggaactgggaaggaaggcagggtggtgaaggttagctagacaatgtggaggtggctgccagccagtcagccaagggcacagctcctcctgctgcttctaatgctgtggagacacacagggatttcatctttacctcctgacagttcctcaaaacacgcgcgcacacacacacacacacacacacacacacacactctctctctctctctctctccaatcttagtaagtgaaaaaacaaaaaccaaaaccaaccaaaccaaaccaagggtctggtctattctagaaagtgactttacatacccacattcaactatctgtctacagcctttcagacaaagcaggatataaaatacagcctgtgtgtgtttcttgatgaggtttacacatctcattcagtaacacgcgccaggagaaagacgccaaagcaaggagtaaaaagtcaagcacgtgggaccgtgagttgttgggttatgtgcataaaatatttcaagagagagaatcttatcaaaagatagatagctcccggtgaaatgatatggaaaaagtctgaagaaaacatctcaaaataaatgaagtatttattgctgaaaaatgagcttagatctcagccagttccaaagttcagaatttaccgcaccactcaggcctttctctctaagtttcttgtctcttgtttcattgcacaacaagggattcttcatacttgctatgaaatacaacaaggcgatttttgcagtgataaactccacacatgcatgataaatccaagcatgcaaaatgtttaacatcccagttcagagatactttagggacaaaatccgattatgaattatatgccacaataaatagggctcaatgtttcataaagcaatttatagttcataaaaatgacaaaatgtacctgtcagagagagcgcggagagccgttctctgagctgcctgctggaagaaagaaagggcagagatgtttatttaatattctgacttttgaattacgtgctcaatgaacacttaaaaaaaagacccctgcattacacacatttttgccatgtggccaaattttaaacgactagcaatgaagtagagagcactgttgtaaaatgtgaaatgtgtgtgatgaaatgaaccttcacggacagttaactgaagcccggcaatgcacacctgcaactaggggatgagtttgtcgggggggcaaaggactgtacccaggtaagcttggacaggcctctggaaattggcaaagaccagagctacttctctgaaatcactttcccattgctttattgtcctttcctataagaaaacaaaaaggtctgttttggtttctttgtagcttctttcccaatgaaggtgtaatttttcactcggatttcagattgaaagtttccacagttggaatatggaatgccactagaaatctcaagggattattgatttgctttaggcatagttaatgatattatgacaatggtttttaaaattcacattgaaatgttaatggatacaattatctgctgttgggatatgctttaagataatacagtgggagggctgggtgcggtggctcacacctgtaatcccagcactttgggaggctgaggcaggtggatcacctgaggtcaggagttcaagaccagcctggccaacatggtgaaatcctgtctctactaaaaatacaaaaattagctgggtgtggtggcatgcgcctgtagtcccagtgactcaggaggctgaggcaagagaatcgcttgaaaccagaaggcagaggttgcagtgagccaagatcatgccactgcactccagcctgggcaacaagagtaaaactccatctcaaaaataaataaataaaataaaaaaatttaaaaaatacagtgggagaagggcagagtgggtgggcacatacataagacaagatggccttgggctgagaactgctgacgttaggcgatgagcacagggcaggttcttatattattctggccatttccctacatgaaatgaacaaaactttcattttgtattgaaaatgtattgatttgttttttgtttttttcttctactaaaattaatgtgtgtgtgtgtgtgtgtgtgtgtgtgtgtgtatgctgaaatttcccataataaaaaaactaaaagaaaaaaatcataaaaaaggctctattttggccgggcatggtggctcacgcctgtaatcccagcactttgggaggcccaggcaggtggatcacctgaggtcaggagttcgagaccagcctgaccaacagggagaaaccccgtctctactaaaaatacaaaattagatgggcatggtggcacatgtctgtaattccagctactcgggaggccaaggcaggagaattgcttgaacttggggggcggaggttgcagtgagctgagatcgcgccattgtactccagcctgggcaacaacagcaaaagtctgtctcaaaaaaaaaaaaaaaaaagggctccatttctccatcggattctcccaagttttgtacttgctttccttttctctggctattctatttttcacccatttgccttctatctctgggcccaatgaggccaaggaaggcagatggcacacgatgctctctgtctcagaagtcatgactggggaggtcagtagaccaggcctactcagcatgcaccgggaaacaaggagtgtgcaatggtcctttcctctttgcatgatacacaggtcatggttactgtttttttttttctgagacagagtatctctttgtcacccaggctggagtgtagtggcctgatttcagctcactgcaacctctgcctcccaggttcaagcgattctcctgcctcagcctcccaagtagctgagattacaggtgtatgccaccacacccagctaatttttgtatttttagtagagacagggtctcatcatgttggccaagctggtctcgaactcctgacctcaaatgatccacccgcctctgcccctcaaagtgttgggattacaggtgtgagccaccacgcctggcctatgtttactgttgaccaaggacctcacaatacttctcatgctgatagcccatcacatttagatatcaggaaaaatagaatcttcaggttagaaaaaaaagtcacctcagaaccattttctctgttatggaaataaaatacacccttggtgacagttccacatcttgggataaaaataaaagtagaagcagttatcgtcccagaaaagctccttcctaaggtaggagctggatgacctcggtacacttttagaataacatggacatgaaagattaaggcagggcagtgtcaggaaggtgcagggatgggcggccactcctcaaatggtgcctggaaccatgagccggtgtcagtacatatctgctgagtaaatgttagagggatgaatcagtcaggaaagccttccctctgaaatctgagcataattttaaagacaaggaaggatgtggtcaggagagagaaggcattgatagcactgggctagacggcacagcaggggcctgtcccagcctctggcagcagctctcaaccggggcacccatgactcccaaaccctgggtgtctggaattgatgagggtgtttctgtgcattacattcatgagggggatcaataatggcagtagtgtctggggccagggatactaaagcccttcaaagagcaggaaggtcccttgtataatgaagaattgtccccttaaaatgacaaagggtgcctgcagagaaacactgcggcagagtaggaatgaaaggagagcagaaagaagggctgtagggaacatgagctccagggcctggcaaagataaggggaattgagacaacttccataagtaatgcagcaacactgaattaggaaaaccatctagtgtgttgagccggggttggagagtccgacattctgggacaggttttgccattcatttgctatggaccttgcgtctggccttcaacctccggcttagtttccaaaccaccctttccttctctgaatagggtgctgaaagagacagtcagtccgtgtccaggctactatggacaatccaaggggttactgtcccctcctcattccctagattctgaatgaagaccccatgtcctggtattccattgtcataggattaccacaacagataaaagaatacagatctactgatcttcttgataaggagagctgagggagcagcgagaggcaggggaagaggaccggagcctgaggaacccacgcagacacctccagggatgggtgcttccctctcccctcagtccctctcctgtgctcttccatggagccagcgcagagcatgctgataaaacgcacccagcaggcaacaggtggcatcactgctggcaggtttgtctcctggagagtttccctctcactcagcaagatggctttcgctttaggccgcgatacttgaacttaatttaactccctactcctgactgtttggctgaatatacaagaagtatttttgaactgccccaaagaaaggtggaatgtattattagtattgtctcttaacatcatctcagcaggagccatgagagactggctcctcctggagtaacagaaatcataagaggtgtaactaaaagttcaatagaaaccttcaacatggcatctgaatttctccctagtcatggaaatagaccaaggctgtcaatattttaaaaggctattgactcttttctctcccacctccaaacaattcctgctgacttctgtgatacggaaacagcgcttgctgatgtgcagctggtcagaaaatgatttaaaaagcgaaaggaaaacaaacaaacaaaaagaagaaacactgctgtctggccgccaatggagtgcctaggaattgaggcatcccagtggcggcacctgttggcaatgccacaggactgatgttagccccgtcttctaatacaagctgagttggaagcttagagcaagggctgctttcctttagcagactggtgtgatgctgggaacaaaaggtccttctgggccgagagacagggcaccctacgaggcactaagcagtgttctctgttgattcttcactcttccaatctgtcacatgatgtatgctaccacgcatgcaacagcatggtacttagcaccatcaattgcctgcactgctttttttctttttttttttttttttgagatgttgtttcactcttgttgcccaggctggagtgcagtgatgcggtctcagcttactgcaacctctgcctccctggttcaagcgattctcctgcttcaacctccagagtagctgggattacaggcatgcgccaccaaacccagctaatttttttgtatttagtagagacggggtttcactgtgttagtcaggctggtctcgaattcctgacctcaagtgatctgcctgcgtcagcctcccaaagtgctggggttacaggtgtgcgccactgcgcctggcctgctctgctattttttaatgactaattttcattgtgctatttaatttgcagtcactctacatcattaaaaattttacaaaaactcaccatctattatgaaagaagaggagtatatgtcagatgttttaaataatttgaggaaaaaacccttcatggcattatattaattgtatatataccagagcaaaggccaccaagatgtttttactgactcctctctttaaaaaaaccttcagcttttgcacactattttattttactactggaaaataatgaaacgaataaatattggaattaaatggcaaagaaaaaattaggtgactcatgattgaaacttgaaaaagtactcatagtaaactagatgaattgcccaatttcattccttcaagagttatacattacagcaactatatttttctcttcctaaatctcacatcatctcttccttgcgacttgccttttattcagttctcagcaaaataggttgagagggttaagagaacacgtcattgatccttcctgagttcattattcattacgaatgattctaaactccagtctatgagacaaaacatgttcttttttttctgccagaaattgccattttcaggttctcctcaagagatgacatattttctctgtctttattatagcaagcttgttgcttgggaacacaatcagtagatattcaggtttcaatgtatgctaaatgaattacaagtcacattctgttattgaagggaaatcaaagaggaaattaaatgcccttattgtaattgggtcaagcactgaacaagctcatggatcctggagtggggaggaaaacaaagggagaggctgaaattcagagggctctcagaatgatctcatttcttacttgatagaaacagaacttacgcctggagaggtttgtaattcagtctgaagtacctactatgtgcaagcactggacttggcttaggtggcagtcacaacaagcaaagcccttgcaatattgtgcttagtgtctagaggtggggcagacatgaaaagctacacacacacacacacacacacacacacacacacacacacacacacacacacagcagtctacattccaaggggcatggctgaagaggacagggtgctctgaaaccaactaatgaaggaaaccttgtttggaatgagtgtcaaggaaggcttactaagtaagaaataacaaagctgaggcttaaaggataaagaaaaatgatcacatcagagaaatgggggtgggtggcgaggggagtgctctaggcagggaagctctagtttgggagcaaaggccaggagctggcctagatcctggctcagctgaagaactacaagatgtcactgtgctgcggttcggcaagtggtagggacagcagcagagcaagatgaggccaatcccaagggttttagacatcaagtgaagtatgttaggtattaacacaggacaatagaaagtcatcgaagggtttacattaggggaagctgggtgaagcatgcatggggcttgcttatatgttctttgcacttcctgtgaatctattatataattaaaaaaaatagtacggagggaggcaataagatttttcaaacatcttgctggcttctgcatgatgaatggaattgggtaggaagcgacaaagtttgaggttattgcagtgatgtgggcaagagaagagcatggtagtagtgaagatggagagagctagtgttacattgtgaaggtctgattgagggaacaggtgactgattggatgtggcaggccagggagaggcatcaggtgtgaggtccaggtttctggcttgggcacctggtatggatggagatccacttgttaagtggattaaactgggggcataagagcagggggcaaaggcagaattgagtgttgggtgtgtgaagttaaagttgcctacaagatgtttcagtggagactctgagtagctagctggatgcatgcgactgaagttattaaatgccaattaagtaagaaacatcaataacagtcataaaaaatggattgaggtttctggatctacattttgctactgttctaagagaaaaagatttaggtttcaactggttgggatatatctttgtgttttcattatggatgtcagtaacctccatttttgctatcaacagtatcagatttattctgctgacaataaaggaggtatctctgcacagggattttaatcagcttgttgcacctgtgataggacattgtatccatattcaaatacttgaataaacgcccttgcagccaatcttagtttgtgttttgctgttactgaagcacactgtaaaatttagacccaatcacatatttttatagaagttctatttgtaaagccttacatttttgctgttctttttcaagttgagacttgtacttattaatttatttcacggtttaatttccttccacatctataagcaattttatgtttcattatctgaacttttatgccattgttttccacttcagtcctagttaatgggtctcttaactttttatgttgtgggcttccatttagtatttttcaacccgtttagtaatatctgcaagacaaaggaaaaattcttactcctctctattttttcctcagcaataatgagtcttttgcattttcggattcctagaaataaatgctgcctaggaagcattttgttcggtcaactttgacctcatcccattctctataggggtcaggcagtcagggatgataatataatttatcatccaaataagaacaaatttgagagagaaaggggatgctaaccagactggagtcagagacaaaacgagaaaacctggctgttctgggcacatggggctgtacagtcgctctaatgaggactgctctgtgcaaatatgacttgctgcttataaaccctgttaaataagatcatgataagaaggcagacctcagggcctgaggagcatgccaataacgaaagcacagagctgaacggggtcagcagaggacgaatccttctaattcctaatgttgagtccaactgatgcttgtgtgattttctggctctctgtctatcagctcctccctctgttcacagcagacactctgaggtctagctcaccctttgtgttaagtgttaactcttttgtaaaagttctcaagctcctctccatgcactcctagtctgtaacatgaagtagccctggattctagtcatttttggggagtatgccgtctgcctcatgacaattttatttttggcttcccaagttccttaaaagaacattgatggcagagatcctagctcattttccctccacctaaaagagctctctctcaacccataacacttacaagatgtgagcaggtaacctcggggatgacaaatactactgtttgccacgatctccaatctaagaggtttgtggaaatacatttttttcacatctgtgtattatttccctatttgctttatttaaatacttggacacattttcctctttgaaaaatatttgactatcttctgcttccccacattacttaggtttgtttatgtctactagaaatttgatagacaataaaaaacatttattgagcacctagtatatcctgagaaaaatgctgattagggttgaccataccagatgaagtttgcacaggcaacattatctcataaggtggattctgttatcaacagagtgatctgggggccttacgtgaggccagattgtcagggacggctctaatttggcaagtcaaatccgagaggactgagagagacatacttatttttttgagcatttctaggacatttcactccctagagataaacccacgtgtgacatccacttcctggttctccttgctccaaagcacgtggctcttctagactctggaggcttttgccatcacaaatgaaaacgaaggcagatgctatcagtcagaagcaagaagagaaaggtgtgaggacaacatgagagggtgccgcagggactgtccctgtccaggtaaaggctctatggagggcatagaagatacatggcaccctgcagggcaggacattctgaacaccatgaaagcaacattataggtgagaggggccctgaaggatgcctggaggagggctgggggacacatgcctggtgtgggggtggtaagaggtcactctgaagtgggaggatgatggcaagaagaccatgaccatgtgtgaggttattagtgttcaccatgatgtggggtgggtgatatctagccctaagccagattctcggggcaactcagcctcagcctcctgagtagctgggattacaggtgcctgttaccacgcctggctaatttttgtagttgttttttagtagagatggggtttcaccacgttggccaggcttgttttcataattttatactaacatttatttatattcatagaaaatattttatattaatctactttaatatttttgtccagtgcatttaagatattgaaacagaggtccaggaagattagcttgcctgtggtctcagagccagtaagtaaaggaaccaggccagtgagggctccacagagcagccccattctgtcttggcctcaccatggactcctgtggctggaggttgaaagcaaaggggactaggtgaattctgaactgtggcagtttcagtgagaagaggactgctgggacactgggtggatgctaacagacactgggggaaacctttatctggggatgccagtgaaggggaataataggagtcacctcttagacaagtgttggcaaaggagatgggaggatttcaggtttctgagactaacttctcttctcaagagggttatatccttattgttgatcttggcccttgtcaaaatcttctggggaagaattctttttacctccagggctcaccatgacagaactatgtaaaggaagtagctgtctgggttaggtctgggtaggagcgaacatcgctgaagattcgcctggcagagcgggcaaacctactggtgctgttggatgctggtggaagatccaagctcagctgcctgttctcagaatcaggtggctgaaatgtggttcctgggactgagttttggcaaggcaactgtgccttctggatgtgcacacatgcatacatgtgcctgtctagctacaatttcaaagtgacagcaaacaaacaagagtagccatcagacccaacgctggctgagctgctaggagatacaatgcaggtagtatatgcatctaaacttctggttcttaggaatggaagtttaaatgtggagtgcagatggtgatgctggtcaaagtgaggaagtgatttatcttctggacagctgccttggcttccagatctcactagaatgggcaggtcttttctagaggtctgtgacatacaattttaggggaaaaaatagaaagtaaatcgccactaataagtgctaagttcgaaaagtgccagttgacttgtctttccagatagttccagccttggtggaatttaatgcagaagagatgacatgtcagagtgactggagcatgaggcgatcgtatgcacacgatgaagctttgcataaaggtgatactgacgtagctccttatcacagcctagactatttaggttctgcttggacaatggatcaagtttcctagcacaaaaaagacctgtgtgcgcagaaaccgctgcttcgtggtccaatccctccaccagatgaaagcactaagtactgcaggttccatcatgactctgtggcctgctcatctgggctttggtcattcacatgttcctggaactcatctcacagggcaatttcaatgcaggccagaccttgagcaaggccaagatggcgatgtccattaatggctttcatctttggctcagcaggtggatactgggattagtcatttcctattttgttcagtttgccaaatacattctggacctttaaaaagtccttatgctatcgcaatatgatgctttggtagagtcctgtccactttccactggccttggcaggtggttgagtaatatgaaagcaactagcgcctaaattgtgaaatacaaatgttactttgtttttgtagaaagaccagatgaaaataacacaaaatgttttggtatttttgttaaaaatgcaatctgggcttgaagaacttaaatctaagtctggctttatgtttcatttaaacctttttttacttaggcaaaatagcaatatttgaaggtaaaaacaggtttgtaatgattaggaaagattctcctaatttcttaattgcactttgcaaaccaattatacaagagaaagctgaaccagttctgaatgtgttattattgttatcaggatttttacctctcaagtgaacagtgctttacgatttatatgtgaaagtgctttcgcatgtaatgtataataatcacacagtcttctttgaaatgccttgaactttaagaacaaatccaggttgaaagaagaggtactcagagaaataatgtgaatcagatctctccagagaatcagatctctctactggaatccttgcgtgcagggttttctagcgtgcagatgaccatatctgggggcctaacattctagccactatctggtctgcttcttaaacatggtcttgttttaattaacacaaccttttggctgcagatctggtggggatggaattgggaagtgccaagggaccttgaatgatcacacatgatttttctccgtgtagaaacaacaggctaagagagtctcctgagaaaagctgggcttgtgagataaccagccctactcggagaagctttggaaaaagaaaaacaaaaactcaactttacaactgtatatctggaccaaacacctgagggactgtcggtaaatcctttactatatgacactgcccatgcctggaaatgagggatagcgtatactccaaggaacaacatctcttgtagggtttcacttcctgaaaagctactgaagaaaaaaaccattgaagtcatgggacaaagggctattcctctgagttaaataacaatgtcccctggagggagaattccacttcttctgccaaccagcaaccctgctggcagctgtgtttgagaaaagcgtgcctatcaactaatgatgcctaacccctctcctggctcctgaatggagagtctgtgttggtggtattgatacccaccattaacaaaaacttcgcttactttcaaaaatgtagatccttttatgaattcttcatcataacaaaggcaatggtttcccatttttgtcttaattgtatgtttgcccaaatttgatggatcatgttttggtttttatataattttctttttccagatttccatttagggtcctcaggctgaaactaggcatatcccatggcccaggctggttggacacaactaaatctacataaatctccattgagtctccgaggagattcgatgagaaaatattttaggaaacagcgttatgagtctctgtgctcagtgatatttaagttggctgaccatttcaattttggaaattatagtccattaacatgaaaaaaaggcaattacatgtttgtatatttctacctatgcttgtgctttttgcaaatgtttataaagagtggcatgataaaataaaataattttgtgtttgcttctggtgacagtaaaattttatttataaaatacaattactggccaggctcgctggcttatgcctataatgctaacactttggaaggccaaggcagggggatcacctgaggtcagaagtttgagaccatcctggccaacgcggtgaaaccccgtctctactaaaaatgcaaaaaatagctgggcatggtggcacacacttgtagtcccaactactcaggaggctgaggcaggagaatcgcttgaacccgggaggcggaggttgcagtgggccaagatcgcgccactgaacttcagcctggcaacagaacaagactctgtctcaaaaaaaaaaaaggcaattacttaactaaaagctttaggatggttaaacaaacaaaccaacccttctgctgaacatttgagtttcactgattatgatgggaggttcaaatatatgattacttcatatacggatatgaaaaaggtctgataggcagttttcaattagagttattgttctgtttccatattaatagaaaccaattagttattatgaacagattgggtatttagctcaggtacaacataaaatgcaagactaaaaagaaaaacgaacatacagtattctttttttctgtgttgctatgaggtttaatatatttaatatatactttttgtatggtccattggggcaagggatttcctggcattgaaaatttactcaaaatatctgtggttaagttatcataacgaatattactaatgtctaattcattaagaccaacaagccagcatcttacatgatgtttggtacttagtaggtatttgagactatactcagttttttgcaaaaactgtctagctcttgtttgcctacaaataacattgacaatacagttcatttctaatgtaggagaaacttcattttggagccttgcccctcaaacctggtcctgattactgcttcaactcctgtttatataattctacacaattttggcaggattcaagagcacataccagggtgttggcttttatgaatctcctgggatgtgaatgtcacgctgactggatgaaccctggccacaaatcccagacaagcacaatgattctatttattcagacttggctgcctgaatgcagattgactctgtgggtaataaattttcacaggccaagagcgtcaggatcaaccaagctgatcctgagaagaaaaatgcaactaaggaagtagagttgggctgcaaaaacctcctatgtttttattccatgtctgcatatcattcagctaattcatttagttactgattgacatgtactgtcaatgctttcagacattttaaaagctctgctttgtgttatgcaattgtcatattaaaaagaaacaagggaaaaaatgaagagcttccattacaattggcaatctgcttttaagagtacacccaaaactgatgtgagtcatccagtaatctctgtggtaaagagcacagaattgagatgggaatgtttcttgtgctgctccataggaaaccaaaggaaacagcaataagaactgcaattttgtgctcagagcaacctcacctacaatcttggtatcttgatgaagcaaggctttacattatttctaagagacacgactattactctatgcattataaataagaaaataattggctctttaatttgcagatttatgttaatgatctagatatctattaaattaattgcatgctctccaaatattgattggggattaaaaggcagcttttcattgtgcaagaagtaaattaacgccaatggggaaatttccctctacagattagatccaatgattgttgtctgtaaaattaaaatagtcagttaaaggggataaaccatgttcatttaaagagaaaaatgtggcaacagagttaaaataaaaagactgcccaatatgtttggataacgtaattactggaagctgcaggcatgtacatagccattcaatttagatccctggtcccttcctctccctaagctatgtatttgtcatctccgaaacacttgtctgcagttgacactatctcagctgctccttgctgaaagtcttaatcatgtgtccctgtcctcatgccttagctatagtaatgccatctacttatttgcttgtgtccaacctcccaagcttaccctgacttgagaggcagagctcatctttttgccaaatgggaagacatgcaatataattaatcagtcccttcctaatctattaaatttttttaatacttactgtcttaagtcttctaattccttcacattgtttcacaaaaacattggtctttggaattgttaaaaccaacagttacagaaaggagatcaaacaaattactccaggtatcacatacctttcatttactcagattaaataagaaagctgattctcagatattttgtgctatttccagttggaacctcatccagtgtgaaaatcataggtgcaaccataaggctatgcttccatttcatttatgtttgtaaactttctaaggaaacctggtcacaaccccagcactagaggctacagccaaaatttggttattcttgaaagggaaggctgtggagaaactcagtctcttggttttgaagacttctgtttgagataacttatgaaaacttgtagtttcaatatagcttgatgtaagcatccttaagaaggggctatagacatttccatggagatcggataaatgccttttttctcaaataggttatttgtgtattaatctatagccaatttaagatattgggccttatatttttgtcatctctgtcaatacttttgatgtttggacagaactcatttgaaaaatcatagagttcaggaaaaggaacaaaggcagagcaaaggtcatctttgatattgtacaatggacagtgggaaatactctcaattgaaggcatcactatgcatttatccacgcattcgttcaacaaatatttagcagttctgctgtgccagacacagtccctgccctcaggaaacttccagtttagctggtgtagacagatcttagaaaaagtaaacataacatataactaaaattacgatgagattcaggtaaaaagatgaaggatactgtgagacggactaactgggagttgattagataagagggaggtctccctgaggaagtgaaagttatgctgtgcctccaacatgagtaggtgttagcaaggcaaaagtgagggagtagaggcctatggaggccctaaggcagcagagctcagcttcctgcaggagctgggagaagggccgggccacaaatgagctcagtgtgaagatgagacgtggacaaagccagatggtgcagggtagtgtcggccatgctgagggctccgaatttgatcccgggtgggatgggaaacctatttaagattttagaccaaggaattacttgatctgatttttaaaagatcactgtggggaggctgtattacagagggcaggaaatagaaatacaatagtttataccagactggttttgactagctgggaatggaaagaggtagatggaccaatatttaattttggaggctgagtttataggacttagagatgaagtgactacctgagtgaggaacagggaatcatcaaggatgagtctgaagtttctaggctggaacagctgggcatctggcagtgctagttttggaaatgggaacaataacaagacgaacatgtttgtgtgtctgggtagtgatggcaaaggccagaagtccagttgggcacagactgaatctgaaatgtctgtgagacatccaagtggaaaagtaaagtaggtttgcggttcagaagagagttctgagctggggatataactttagaaattgtcagtatataaaaattgaaggtcataggaatgggtgagatcacccagagagcagacatggagaagaaaagtcaggaataaacatggaaagtttccaacattgggcagaaaatcagagtcagcaaaagagcctgagaagagaagccagaggggcaggacccaaaccaggagagtgtggtgttagactcctacagagaagtgggtgatgaacagtgttcaatgctgtaagtcttctagtaagacaggggactgaaaagagcccagtataattggctctacagaggtcattgggggcccaatgaggagcatttctggtaaagagatggggtcataatgagatcaaaagaacaagtctctatgtagctctgaggaaatggatgaactttggataggagcagggcagtgtcctctcacaacaggaggacacaggatgagtgaagatggaagcagtggtgcagatgtggtattgagaagtttaggtttctctgctagaagccagtcagccatggtatgaggtagggaaataaagatgaataagatacacggtgaaattcaggttgtttacttatgaagttgggaagacagaaaactacatttgtatcacctattattattcattctgtaacaaaggtaattataggatattaagggagaaagcatgcaaaatgacagtaccagcgaactgttataagttatgtatatatagtgtaatacctagaatagccactaaaaaagctgtacaaagagatacacataaaaatgttacagacaaatcaaaacagaattcaaaaggtttaaggaatacacagaaaggcaggaaaaagaaaattaaaaccaggaagaaactaaacaaaaaatagagtggtagacttaagctttaacaaatcaataattacattaaatgtaaatggtctaaatgtatcaattaaaacacagaaattggcaaagtgaataaaaatatgacaactattaatttatgctgtatataagaaactcatttcaaatataaccatattggtaggctgaaagtaaaagaatggaaaaaagttacattatgaaagcattaatcaaaataaagcaggagtagctgtgctgttatcagaaaaagtagacctcagagcaaagaaaatgaccagagacagagtgggacattacataatgatagaagggtcaatctaagaaaatatagcaatcctaaatgtacacacaccaactaacagagctgtgaaatatgtgaaaacaacccgattgaatagaaagaagaaataaacaaatccacaatgacagccagagacttcaacacctctctctcaacattagatagagcaatgagacagaaagtccagaaaagatacaaaagaacatcaaataagattaattgatattaatagaacaccctacccaacaacagcagaatacacattcttttaagtgcctataaaacatataccaatacaaaccatatcttgggtcataaaaaatcctcaacaaatgtataagaattgaagtcatacagactatgttctctgaccataaaggaaccaaactagaaaccaataaaagttaagattaagggcgatctctgagcacttaaaaattaaacaacacatttctaaataatccatgagtcaaagaagtcttactgaactgaatgacgatgaaatacaacacatcaatatttgtgggataaagtttatagcattgctgagagtcaaatgtatagcactaaatacttatatcataaaaaagaacgaatctcaaatcaataatctaatctccctcaagaaactagaaaatgggcaaaaatgtacccaaagcaagcaagaggagggaaataaagataagaaatcagtgaaactgaaacagaaaaaacaaatagataatattaatgaaacaacaagctagttctttcaaaagatcaatacagttaataaacctctagcaagactgatataaaaaagaaagaagacaaatgatgagtatcactaatgaaacgggctgacactatagatcttgcagtcatcaaaaggataataaaggaatattataaacaaccctatccacataaacatgacaacttaagtgacacggatagacttattactgaagaacagtgtaccacttatacccagtatgaaacagataatctaatagccctatgactattagataatctgagtagctctataactattaatattttttttttggctgggcgtggtggctcacacctgtaatcccagcactttgggaggccgaggcgggtagatcatgaggtcaggagatcgagaccatcctggctaacacagtgaaaccccgtctctactaaaaaaatataaaaaattagccaggcatggtggtgggcgcctgtagtcccagctactcaggaggctgaggcaggcgaatggcgtgaacccaggaggcagagcttgcagtgagccaagactgcgccactgcactccagcctgggtgacacagtgagactccatctcccaaaaaaaaaaatttgtttttgtttttctccccgagatggagtcatgctgtcacccgggctggagtgcagtggcttgatcatagctcacggcaatctcagcctcttgggttcaagcaatactcccgtctcagcctcccgagtagctgggattacacgtgcacaccactatgcccaactaatttttgtatttttagtagagactggttttcactatgttggccaggctggtctcgaactcctgacctcatgatctgctctcctcagcctcccaaagtgctgggattacaggcatgagccaccacaccccgccgggaaatagaatttttaagtttaaaaatctccaggcccatatggttttactagagaattctgctaaataattatcatctttttgtttttgtttttgttttgtttttttttcgagaaggaatctcactctgtcacccaggctggagtgtagtggcacaattttggctcactgcaacctccgcctcccaggttcaagcgattctcctgcctcagcatcctaagtagctaggattacaggcacatgcaccacgcctggctaatttttgtatttttggtagagagggggtttcttcatgttggtcaggctggtcttgaactcctgacctcagatgatccacctgccttggcctcccaaagtgctgggattacaggcctgagccactgtggccgacctaacatcattttttaaaagcataatctttttgagaaaagggcaggggacccttcttaattcattttataagatcagtattaccctgatatcaaaactagccaaagacagtataaaacagaaaacttccaactaatatccctcatgaacattaaaaagacaaatgtgtggtgaggatgtagagcaactgaaattctcttacactgctggtgggactttcgactggtacaaccattttggaaaatggtttgagataatttactaaagttgaacatgcacataccctactgctcagcatttatacttctgggcatagatccaacaaaaatgttcccatgtgctcaacaaaagacctgtacaaggatgaaaagacctgtacaaggataaaaagacctgtacaaggatgctgataagagcacactattctactccccgacccctgccaaaatatccacatgcccattagcagtggaatgaataagtaaattatggcatacacacataatgaaataggatacagcaatgaaaatgaacaaacttcaattacaggtaacaacatgggtgactctcataaacaatgttgaatgaaagaagcaagacacaaagagtacatgccgaataattccattgatacaaagtgcaaaaataagcaaaattacactatggtgttagaaaacaggaaagtggttattcttctgcagagtggtgactggtgggagcatgggggcacctgggtcatgtctgtattttcatctggatattggttatgtcatacacatataaaatcatttttaaagacatatcatttttataaatcatatacaaacaggctgggcacagttgctcacacctgtaatcccagcactttgggaggccgaggcgggtggatcacttgaggtcagaattttgagaccactctggccaacatggtgaaaccccgtctctagtgaaaatacaaaaattacctgtaatcccagctacttaggaggccgaggcagcagaatcacttgaacctgggaggcggaggttgcagtgagccaaggtcatgccactgcactccagcctgggcgacaagagtgaaactccgtacacacacaaaatatgcctattggatctggtgacacgaagatgatgggtgacctcaaatttcgatgaagtggcagcttggggatctagcattaattccaattttacaaacagagacactgaagcagagaacagttcagaggctgggccaaggttgcaaaactaagtagcagagtggggatttgaacccttgaagtggggccgctgtgctcttaaccactaaactagactgtcttttgaccttcaggatcacaaaggcaatggggagaaaaggaaacctcagataggagtgttcaaaagcatggagtctgaggcgatctgaggaagggcaggcaggtatagcaacttgaagctcttgtagacacctctttattacagtggcacatgggctggttgaaccaatattcacaaagacagccagatataatgtcagaaaaggttaaggatttttcatacactgtagtgtttactgaggcaagggatttttaaaatattttgggtttacggtgcaaactctgattacatctagaaaaatcatttatgttaaatgttcaattatctcagaatgccagggaatgagtgtatgtgtctgtgtgtgtgtgtgtgtgtgttcgtgcaccggctatgctgcttccgggataaagcatagtttggtcttgaagagaaaaaaataccatatcattagtcttgtttaaaagtatgggaattacaactttgtgattagaccaggttataattataggccaaagcaggacaacttaatgcaattactgttgaagcaataacttaaactatcatacgcaaaaccactgtctggagtcttaattaggaaaaagggattaatgtataaaaattattcattctgtcagttccttttattgcaaaaataggaaggtatattcacataggaattaaatgcaagaataaaggatctgacctgtacattcataacacaatattatcaatgagtacagaatggaagggggtagcttaaaaagcaaaatgagtcaactaaaagctcttactgccttagagaacatgtatagtacgtcattagtaatgtttattaaaattgagttttcattggaaatacttcctggaaatagctcaggaaattatttccaaatttaaaaaggtttgcagattgaaatagtctgtgaaccctttttctaataaaaagcatacacaatttacatgtttgatatgatttaatccataatctatgtatccaggccacttaatgggaaaaaacacaaagagttgaaatcatttgcttatcatcatgtagataagaagccaaaattaggagtgaagtcattctacatttctgctaagattgctgtgtggcagatatctggctgccctggaaacaaatcaacagatctgtaaaacactcgaagcctgagtggccttctttgcccagttaaccttcttccactgggtattctccacctgccaatctggtttccagactcctcaagctcttctccctttttcgtgcctcagtttctcccatgacatgagtaacctcttctgtgacctcatagctatgctctgctcactcttcctcgaaattctcctttgacttttatttaacctctgcttgttctctctgtaagttatttgtatttgcatgtctagacagcaaatcatctgcatagcatttcatgatacctttctattaattcactattccaaaaccaacagaacagcattattattttgtactgcatacaaaaatgacttattaaaaaaagcctctctgaattgtctttctacccatcacatgtatctaaacttgacaaaatacaacataggggatgagaaaaagaaaacagaagtgtagaaaaatctgtctttagtgtttttaaacttgctttgaaatacaaacatttcttgaaatgcagaagtgaaagtgatgaatgttaagtggatattttttcaccttaactgactgatcagaagagtatttataaccccctaactgatgtctcgagctgataaatcaacaccaggggagaatatttcaagcacatttatcatttaagacaaacagcctatactgagcataattactttttattcatcattttggctcacctctacatttgctccttctcaatgttaataatatctgtgtaagacttctcaatatttaatgttacggattgcctgttgcatgctgatgaggttaaggtcatatgtttgatctccagaaggccagttagcttctcacacacacacacacacacacacacacacacacacacacacacacacacacacatgaataaataaaaaagaaaaaaaaaaggctctgtctacttctgagggaagcctgatcttagcttccttgtaatacccattgctggtctcaatatcataaaaaattacagaattcaaggcttaagggaaattatgggcaagctattttaatatactgacccaactgcatagaagctcacacttagcagacaaaagaccagcagcctggagtgccaccattcagcttggttaacacccggcacagtccaccaggtaactgttaccagtgtcacctccaaaggatgatgacataaaagagaatcttacctgttcattctcctcttcatcactgcttagcttaaggtcatcttccagcattctgaaagaaggaacaaagaggtacaaagaggtacagatagttagtggattcagaataattcagcaccaaaatatcaccttaatgttgttattagagcaacattttggaaataagtctatttgatttcctattttttttctttccttcttatgcacttttcctctggtgcacttaggaaatagtagacagccccatcataaaaattaaccctcacaacagtcatcagctaagacgggcagctttcagaagatgctgtgttagcagggaaataatacttaacaataacgtattgtatatttcgaaatagctagaagggaagaattggaatgttcccaacaggaagaaaagataaatatttgaggtgacgaatatcctagttaccctgatttgatcattacacattgaatccctgtatcaaaatatcacacgtacctgaaaatagcaataaaaaagaagatgctttttttttttttctctcaaatacataggggcttttcccctgggcagtttgcattccacaattacttgtttagtgttttccaagctcccagtgctgggctgtgtctccgtgcctgccccaggggctttcatggtaaagagagatgagaaaaagagccataaagccataaacttgagttgtgagcgaagcttcttaggccatccatcagtcaaagagctggaaaagatgttgtccccaagatcctacctagtggggaaaaccaagcaggagggcgctttctgaaaagcctgtgaaggtgattccccagcccacccaggtccccccattcatcctgaggagacagcggggaagcacgaggttaaaagtgaaaaaaagaaacagaacttcagactctgttatttgttatgataacactgtattcttttcagcatggctaaatttttctttatagtagttttcagattaattcatttcaaaagaaatcttactcagaagtgcactgtataaaagcgtgctctccacgcagagacgctctgagggagcaggggagagcccacttctgagggaccctggggctccatacatcagtgtgaagcccgctgagcccttgtgctcaaaggcctcattgaagccagcttccaaaggctgtcccctaaaatgtacctagtgtcctttaaaagccggttgtaggcctatcactgatacatgcctctgaacattcgtaggagtcatttcagtcacttttggggcgaactggggggtaaagaactggcaggataaggcatggcccaggctctgccccacctgtctatgcatgtggggtgagtcgcttcacgcaccctgaccccatttccctatttgtgcagtgacgtgttatagagggcaatcctaaggttgaatcctgctttagattccgttgtgagtctacaaaataaatatgctccccagtttcgtcaaggagaaaaacccttctatttgctctagagaatacaacggagaaacttctaagtagtttttagggtactatttaaggcattgccatcagggcaccaaatctgcttcctcacaggctcctgctcatctcccagtgccgagaggtgtcgttcttctattatttaaaccacaagtgaacaaatgaacacgtcagcagaggctgtaaagcggcacccccaattcctctgcatgtctggcacgccattcatttccttcacctcacagacacatacgcttggcttcaaagagaagagacctcttggtgatttattagagcactgtttgggagtagcctagggaagtgggctgtgtttcctttgtccttgagtccccagtgaccagcacagtgcggcacagaacacaacgccagtttgctggctgggatgaggccccttccccaagactgttttcctacccaaaggcacagatttcttcctaatgaaaaagaccagagaaggggacaggtccttgcctccactcccatgccctcttttgggtaaaccaccactgcagtgtggtttaatctctaggactgcccagcaagcactgggtctttaaagggtgggtggtcctgctggtgggggtggaaagagtggggaggactcacacaatcatggttaacaacccccttgctgtcagatggaggctgtgtggctgggaaatttaatgtttaaatggacaatactgtgcgtggattggaaggccatcatcccccagagcaggaaagcccaacatggcccgaagtgagggagcttgggttggctgcaaactagccgtgcaactcagtcaccacatgagcctggcatggctgaaagtcaccacaacggtcaaaatgctgctgtgtgaggctctctttcaaggtagggaatgcagcttacttctgtttatttcaaacatgtgctaaacgcgtccacacgtaaacacgcatctgtttgaatctcagagccccttgcaccacaatcttgtgtgaggtgcacctctggggctgagcatttgtgcttctataatgagactcatctatctcatcatcatttccagaagaaaagcagtcagagttcaaccttgctttgtgaataatcatcactctgtcactgactttacctctcttatattaaaaaaatgaatttattgtgtttccggctgggttctaaatacaacaaatcacatgtaaaaatacactgccttcaagagagacttcaagagaagttcaaatctaactaaacttcagaatatttcgaaatatgagaaagtggccatggaaacacaaactcacacagcttatacaacattcccggagcaatcctgggtgatgctattcccaaaacatgaaatcacagacctgggagagacgaccacggccataccgcatcccagccccgacaggcacagaggtacaccctgaggagacccaggctccccgcggtctgagagcaggaaccctttgctttattctgatggtcatgagcaggcccttggctcaactccctagcaaacggcgcttgttcttgtctgtgaccactgcatcttcaagtccggtttaacattcacaaacaactccatgttgaatgctgaacatatccaagtggcctcttagagagcctaaggaggggctgaagtttatagctgaacaatgaaacatggttaggagaagagaaaacccgtgacactcacaggatcataggaactgtctgtacttggtgtatggccagcagacagcaggcatggccgccttcaccaaacacacaaatggcaccgtggtggtcatgggcccaacccactcccaaaccctggggaacatttttatcatttgtctgtttccctgtggaaacataggtatatcaaacaataaataaacaaacaaaagtgttcaaccaagagtaaaaggaagatgcaaattaagtgctgattaggctactggggaggggtggagatctcctactgtttttttttttttttaaagggaaggcaaagaccctgctgctctaaggggctcctgagggctaagtcatctgcacggaaggactagccatctgcatggaagcacagggcctgtgcatccatccacagcaccctggttacacccctactcctgggttcctccaggccctaccccagctgatggggcccccaaccagggccacccctttcacgttcccttagcccctccccttcatagctcttcagatccctcccaggggatgaagccctcaactcacagcagcagctctcattgtttaagggatgtccgtccgtagcagaccagctaagtactttctagatgttactttgtcaatccctgcagcaactcctccaaggtgggaggtgggtgctacagggggctgtggaccgtggtagtcagagcagggactccagcgtcacactgcccaggaagaatgctagctctgcctttcatctagcccagggccctgggacctgcctcagagggcttcctggagaacttactccacaatccttggatagtgctaagcacgggaccttacgccagggagcctccaatcaatgctcatttttatcaatgctcatttttaccaatattcccttttccctaggagggaagtgggcctcagagcatttaagaaactcatgtggataaacaagttgagactttgagatgtctttgtaatgatgccttaaaacagggccatttgctctattttcaggccattttgaaaagaaagggtcatgttcctgagagatggtggaggggaatatattttggcctgtaactgctgtcagctggtctgagtggctttatgtcgacaggacagtaaacacgcctatcagccccagtgcacggagaggtctgccctgggagctagcgggtggccacgaggccaggagtccctccacgaggagccaagggggtgttgccagatgacaatggggaagttgaaataaaataggtactaaaattgaactttttggctgcacgcggtggcttgttcctgtaatcccagtattttgggaggccaaggctggcggatcattgagcccaagagttcgagatcagcccgggcaatatagcaaaatactgtctctataaaaaatatataaaaattagacagacatggtggtatggacctgtaaacccagctactagggaggctgaggtaggaggatcacctgagccctggaggtcaaggctagagtgagccgaggttgtaccactgcactccagcctgggcataagaccctgtctcaaaaaaaaaaaaaaaaaaaaattgaactttttgaattgagaacagacctggacttcatggccttaacacttgaagagttatcaaactactgtcagggatactccacgttagcacctcatggtgactttacagtagagtctgaaccagctacatgagaactgtgacactttaaggacagaagcaagattttttttaacgtgcgattaagcgattgagattccacctatttttacttgggaacttgtccttacaatgattgttgggcatgttgtaacacccttcctgacacgcagacaaggagtcgaagggttatgagcccccagctgcactcgctcacgctttcatgcagggagagcgggccttgcaggagctccgtagaggaaaggacacaatgggactttcattcagaactctaaagagggagccaaagataaacaggcccatttgcagtttgccgagcactaccctggaggacctttttctttctgaaagggaaagatgaatggaaacatgcctcatcaccaccagcggaaccagtatccaaactcccaattgttgttttgttttgttttagagacagggtcttgctctgtcatctaggctggagtgcagtggcccaatcatagctcactgcagccttgaactcctaggctcaagcaatcgtcccacctcagcctcccatgtatctgggactacagacgccggctaccacgcctggccaaacccccaactgttgactcattcaattacttctgtgtccactgtgtggcaggcacctatccacagaaggtgtactgtctcccaggggtggttcccctcacacacgacattcaaatcagcattgtcattttacgtatttttaaatgccttcgaattgtgaagctctggcaaatacaacttttgcagaacccaactgtgtcatttgaaggtaaactcagtacttttcagaaaagggagtaattcagtacaacctttgcaattttaacatttgattaccataacttccctgtgtgtattgttttcttaattgagcaagtgataaatttatgttgtagctggcgcctgcatttttgaggcctaaaatttcttgggaagcagaaatagcagcctacacttaacagatggccaactgcttccaaagctcatctatatcttccacaggtattgcaaacgggcacgttaactacctgcaaatgtaatggcagccatttcacagagtagtggtttttaattaataggattttccctgaattagttgtcatttggggcccttaacagatcggaatcctttagtcctttaaagtcatttcattttgctttgttttaatggttttttaaaaaatctgagttttaattgggctgtttgattttcagatttgtttctatagctggtgctgctactatctccacctacgtgagatttaaagcctaagacaaatgtttatgaatctccattaaacatattcatatatgcaaatgtctattctaacaattagcattgcctgagagcctattcattatgcaagtgcatctctctgcagttattccccaagccatcatctccactgcttggaacacgggagggaaagttatacaactcatttcattctttctgaagtctactgctttgtcagggtcagtgctaccatctgcctgtggttattttcattaacaagtaaccaccttcttctcagcgtttgttcggaagaacttagctcatgccatcccagctaactgggaacagggaaggctagcatgggctcactctaggggttggcaatttagtgcatccaaggcacaggtgaactcacttagtctggaggcaaatggagaaatcaggaacaagatgaaggggtgctctacttgacctaagtgtttccaactctgatgttttaaaacccagggatctctacatcttttgaagcaattttggtccatagcaaggtggtatttgctcacacatatctccttcctggactccctccctcccggggagggattgtcagtgaaatcatccatgatcctgtaactctgccatgttgaacctggggtgaaggtgcactgtctcgcttaagtttatgaccttatttttagttagggacagcaacttctgatggtccttttctccactgacatgctgaatccacttgccaccttctctgcaggcccatcttccctgggggacggcatctcatctcctaccctagaagaacctcacaaaagccagtctcatttgggaaacctgccaaatcctggtgagatgctggatgatgtgtgtcttcaaaatctcaatcagtcaactgtctttcccaacagtaagcatatctatagtaatagaaaataagcagaaataaaaggaaaatggaaatcaacagtcataagaagaaacagtcagtggtacagagtctggggtggtgaaataaattttgaaatggcagcttggaggctagccagcattagcctgaattctgtccctaactagctctgtgaacttaggcaaatcacccacttcccctagacattgtttccacatctccaaagtgagagttggataaaacaaccactatatatcctcttattggtctgaattccttggttctgtgcctttaccaatgggtagaatgtccaggaagactgctggagaatgagatgatctgatactactcagcacattctaggtgctagagatataaaactggagaagtcttccttttcaagtgtctcactgtttactgggagcagcagcagttccttgaacatcccatgatgctttccagctagaaatatgtaagtgccacacacggtttgtgtgattgtgaaaatataaaaatgctccatcttttccacttagggcaatctaggccacagttatgaagtagcattctccaaatatattagactttaaaattgcttcctcctaaaagaattacagggaaagagggctggatatactctatcatttctatcaaaaaactgaggctttagaaagagcactttaacccggagtgctttctccctgaagatgggtttaaatcctgtctttgtctgttttaaggacttctagaaaattagtttctgagctcgatgttctcagtattaaagaattgagtttctaaggctaaatgaatgcaagtagtgtgtgaaagaacatgatcctttcccgggcagacagcagaggacaggtcagaggattctgactgggaacataaagtttctgtggctgtacagatttggtggtggacattacttaaacctctttgaagggggatgtgcacctaaccagaggggaaatgagatatgtacgtatttatatggctcaaatctgatgttgaatattgataatcagtaaataagtaagttagctgcctattctgtttgctagctaatggtgtgcttatttaataacttctgacaataagaatgcattgaatctgtaagggtcataacatacatcaggttaagatttgttctttggttggaaacatcagtttttgcatttttatggctgctgttattgataagttaattgctaaaagagtccctaattaagagatttgaacagataaactgttagaattagaaaagagaaccaagcataatctcctaattagcaaatccatgcactttaagctataccagcgttcacacattacctgaggatggcataacacagtggtttccaaactttattgcacattggcatcacttgggaatctttaaaaattattgatgcccagctccactccaaccccatattctgacgggataggtttggggtgcaatctgggcatcaggtttttttttcttttctttttttaaagctccctagggagctgattcatgggcctcagccccagatattctgattcacagcaatgttgggacccactatataacacagagctggactgactcataagagctgaaggtcatgaatagctctgcaccttggatcaagtcccatactctaagttttagtttgttcattaatataaggggatgatagttgagattcaaatgagacaataaaggtgaaagcccattgtaaactgtaaagcttcataggagttttcagtaatgggtttagcattacctgggatgttttgaaagatactggtctatgggccttaccccctgggattctgatttaattggttttggattggccacaggcatcaggacttctgacaagctgctatggtctgaatgttccgtgttccctcaaaattcacatattgaaacctaaccttaaatgtgatagtattcagagatggggcctttgggaggtgattagctcatgatggcagagctttcatgaatgggattagtgcccctgtaagagagacctcaaagagctctttcgactttgtgtcctttccaccgtatgaggacccagctcgtaggtgctgttgatgaaccagaaagcagtttctcaacagacaccacatctcgttccttgatcttggactccccgtcccccagaactgtgaggaataaattactgtcattcagcagcttcccaatttattttgttactttagcctgaggtatttttttttttacagtagcctgaataaactaagacatgaacatcctaagtgaatcttctattcagccagggttgagaaccactgccttaattctattttttttttttttttgagacggagtctcgttctgtcatccaggctggagtgcaatggtgcatcttggctcactgcaacctctgcctcccgggttcaagcaatgctccctacctcagcctcctgagtagttgggactacaggtgcctgccaccacacccggctcatttttgtatttttagtagagacagggttttgccatgttgaccaggctggtctcgaactcctgacctcaggtgatctgcccgccttggcctcccaaagtgctgggattacaggtgtgagccaccacacctggccactgccttaattctaacggaactatcaccttcctattaaaatcatctccaatccataggacagaattagtcacttcttatctaagtgaataatttgtacataactaatgcattatgttggaattttctaacttatctggcttcactctccccccatcttccattggaataagaatgcttgaagggaaggggtgtgtttcctcaacgcctaggataaggcataagcccatcattactaaggaattaccacgaggcattttagaattcttcagtagttgttttgagaaaccacaaggcagcgctggggaatctgagattccagcttgttcttcagccttggggaggaaacagaaaattttatgaatgccacacctttcaagctccctggagaagtccccacactttcgtcaagactgcataggatagtgtgctgggttttctgtctagtggcaacttggcatcatctcccctttgaagcactcctttctatcacaggggctggaggcctgggaactacatttccccagaatccctgccgatagggtttttggttaaatgttgccagtgagaggcacctgaatagggcttggaaaatcaaagattaacagaagcctttactactcccaggacagtgaagcaggtgcagaagcttcagcagatggcagatacgaggttctgtgagtggcttccaggcacccttctgtgaataatgcctgctggagacatctgagattactgttagcagttttctgttattcttgcatttattgatttcttgaaatgactttctgaactgatggctgatttcctgttggtcccccttccctggccctcctgatgggtttggaaggcactaattccctatgttaagtgtctacttgaaatacctagagtggtttctcttctccagatcaaactgactgatgtgtatagtaattaagagcatgagctctgcagtcagaaagcctggtttattgatttctatccagatgctgtacctcatgctagttgtgtccttatgcaaagaacttaaagttgctctgccttctgtttcctcatctgtaaaatggaaaaacgagagtgtttacctcctaggaatgttgtagaaaatgtagaaaacattttatacagtgtctggtatgtagtaattaataaatattcagtattctaactggaattttattacccattccatctcgtgacaacaactatgttacaatttaagtccatttttccttttctttttctttctttttttttgagacagagtctcactttgttgcccacgctggagtgcagtggtgtgatatcacagctcactgcagccttgacctcccaggctcaagtgatcctcctgcctcagccccccaagtagctggaactataggtggcccaccatgcctggctaatttttgtagggacgagaggttttgttatgttgcccaggctggtctcaaacccctgggctcaagtgatccacctgcctcagcctcccaaagtgctgggattatagccatttactttctctaacagagaagataaacttcttaatttctcgaccacctccgacgagcacattctaggtgccagagatataaaactgaagaagtcttccttttcaagtgtctcactgcttattgggagcagaagcagaaaagaaagccagcgaggtgataaatactatgggagcacagatgaccatcttttttccttgtcagacaatcccggcccttttatttttccttgtagttttattcttcagtctgtagttctcttctgtatctcctacaagttccccagtgtccttccaaatttatagtcacgtgtgggacacagtccactctacaggctctatcggcatggactgtagggggagaatgacccgctttatgttggaagtcaacagctctgagaattaaggcctaagactcataacttaaagctttctccacctaagctcatttagtctctccttccccaaatgtcttgaggaaaaaagccatctgcctccttgttcaggacagccatggggtcatttaagactcatcatggaattttaacaaccttatcctacgctgtgtggaccaagatgaccatctggctcctgtgattgcagtggggaccacattgtacctgggtattacagaggtgcagccatctcccctccccctgcagctgtccagttcctggaaaacgtgctcccaggaccttcagctgcttgtgactagatggaggctttcacactaatccactaatcctctctgccacaaacatcataagcagatcgtataaacgtgaagaggagaaaaagacttcaatgttccatattaaagaaaaagcatcctatgagctatttattggctggagattggtagatgatcctcacactaaggcatttccatgaattcatttttttttttttttgagacaggatctcactttgtcatccaggctggagtgcagtggtgtgatcacagctcactgtagcctcaacctcctggtttccagtgatcctcccacctcggcctcccaaagtgctgcgattacaggcctgagccaccgtgcccagcccatgaattcagctttaatactaccacttttgcagcactttgcatattttctctgatacttccagaatttttcattataaaatgaatccaggtggtttgaatatagaaatcaaataactctaatctcaaaaaaactcactatataccaggactttttctttctttcttttttttttttttggagactgagtcttgctttattgcccaggctgaggtgcagtggtgctatcttggctcaccacaacctccgcctcccatgttcaagtgactctcgtgcttcagcctcccaagtagctgggattacaggtgcccgccaccacacctggctaatttttgtaattttaatagagaccggttttcaccatggtgtggccaggctggtctcaaactactgacctcaagtgatctgcctgcctcagactcccaaagtgctgggattacaggcctgagccacccccctggcctttcttttttaaaaatagagttgaaaattaggccaagtatattgagagttctaaatccattgtcaggtacatacaactggcttttgcaatgagaaacctgattaccctgccaacatgcctctctatacaccaattacattctactgggagttgttcaactcatggtgacacagaatgtgtcaaataatccatgtaaattaagccttgccatatccattgcagaagaggggtgcatttactgggttggaagtggtgtcaccaggaccagtcaaggccactccttaagaaaggttcagcatttcgtcatggttttatatcaggtatatttcgagtttatataaaaaaagagtaaaactgcagaatcaagtcctttgttgccttcctaactttttaaacatattcatctatttctctttcagctggaagaaacgaatcttaagtgcaagaaaaaaaattcctgtgaaaaactctaagtgggaatgtacacttctgagataggatcagactacagaatcgtgttgcttctgcttagtgcttaagaaaataaccaggaaaataacgatctatttagttactatcctggaagtcatggtgtccatactgctaaagtgggtctattcactgatggaggacaggagagtagggataaaaacagacaggatccaggccgggcatggtggctcaaacctgtaatcccagtaggctgtgggaggcggaggcgggcggatcatgaggtcaggagatcgagaccatcctggctaacacagtgaaaccctgtctccactaaaaatacaaaaaaaattagccgggcttggtggtgggtgcctgtggtcccagctactcaggaggctgaagcaggagaatggcatgaacccaggaggtggaggttgctatgagccgagattgcgccactgcactccagcctgggcgacacagcgagactccatctaaaaaagaaagcagacaggatcccagtccaatgcagactttctgactttcctattttagatgagtcaagagtcctgatccacagtttcaattaaaatgacagaaagtcaactgatttcagagccaacaccaaataacactgtgaaggaagttgagtttacctttgaaaacccctaccacttcaggtgcacactccctctccaggactcatactcccatgtagactattcctttctgaccaaggaactggagctattctcatggtctggaatgggtctcctttcctgcctacttgctaaagtgtttctcttctcagtcccataccctttggattagttgtgagccagccatattgcatattgaagagttggtaagatttgactccttctaacaggttcccaagctctattgacctgtaattgcaaaaaaatacaaataaacaaaaccccaacagcaacaaagatcctgagggagtgacattaatggtagaatttttaaggtacagcggtagcccccaaatgggccatttttccttcgtctaatcttattgcatggcaaatatagacagcagcaggcattcctgactgagaaccctggtgatggcctgatggaagcagagatgagactgtctgatccactccaggcagcatggtccctaaagggccctctacagctgggagcctaccctgttctgtaataacagcacatcagcaacctctatcattgtggcaatggtaatcaattatttaagtcatatttcattgattgcctttatgtgccaggcatgttgccagccaatgcaaaccaatgatgaataagaaatggttcctcccttagggagctccagtctggaagggaactcaggctcactgaattttcttatccaggcaacaaactgtcccaggatcttttaaacagtttcctgagtgcaatgagtatgtaacattaaactcagaacaaagagaaggatctaggaatgcaatttcctatgtggccaagagatgtgttcctaccacaaacgtattcctggcttctgaggcactttgatcattgtcacccatgcagccatttttaatagtaaatagctaaatattcagaaataggcacttcacaattatttatttgatttgggtagtgtcaggctagggaaacactaccaggacaccaagacaagaagagaaatgtcccggtatggcaggggccagatgcgggagaaggaggaccagttttatcaaatgagccaggtgggtaatgggagtgagtgggagcttcaagtcatggagaacagacggagtgttctaagaactcagcgaggacactcttcaagccacgaggctgagctcctagaactctaggagacaggagctagaggagaggtgggctctcactggcctgtggaataaagaggctgatgaaccttcccaagcgagggtctcataagcagggaggaaagtatggggcttagagggagaatcaggctggtggccagtcagctgttgttatttataaatatgcttttatagtagttttagatttacagaaaagttaccaagagaacacagagggttctcgaatactccgtgtccagttttccttgtccttaggatctcacagcagaatgatacctttgtcacaatgaatacacctatattgctatgataacgtaagtccatttgaaatggagtcttgctgtcacccaggctggagtgcagcggcgtgatctcagcttactgcgacctccgcctcccaggttcaagctgttctcctgcctcagcttcctgagtagctggaactacaggtgcccgccaccacgcccggctaattttttgtatttttagtagagacagggtttcaccatgttagccaggatggtcttgatctcctgacctcgtgatccgcccgcctcggcctcccaaaatgctgggattacaggtgtgagccactgcgcccggccccagtcatttatttctatcagtatggactcttgcatgctttcttgctttggattataatccaatactagtcaactgttcctgaatcacatataaggtactacactatagtggtgcaggcactctgtacatacagcaaaggggcagaattaccatgtgctgcccatggtagtgatggacacaaatcaaaggcttatcattacctgtgcaaagtggttaaaattctggccaaaaagacattttcagtcccaacaatgcaatcagatgcttgaccagcaaaagcagtatactttccaaattataggtatctgcatatccacacatataccttaaaactactgggggcattcaattgccaaatcaaatggacaccttggtctccttgtcttgcttggtcactctgatttatgtgacatttcgtgtattccttcattgagctgttcttgtgcagcttctctgattctcgaggcgctctttcttttcctttgatgattctacccctttctggccacccttcagagctgctgtcaccctaggatccagcctcagttttcttctgaggtctctcatgtcctcatccactcccaaccatgacatccatgactgcttcctccaagtgccaccccctcaggccactgcgcctgggcatctctgcactgtggcttcctggaggctcgagctcatattttatctcacgggcatcttcagcatctaggaaaatgcccggcatgcaatcaccacacaatacatgtttgttgagccaataagttaatccctacttggatgtgcctccaccttgactggcctcaaaccagaacctattacctccccacctggaatccaacgagcacccacctggtcctctgcacgtgggttttgacttcctctctctcctccctacagacaacaaaactcctagcagtgtccatcttatttctcaagcttttcttggaattcctccctttctccatcccttgtgacgctgcttcggtttacatttcatttctcactggcataactaactcctctcttcagtcccttctccaggctctatttcccaccttgctgcagtccccctatgatttaaattcctaacactggctgcttcttagggtagacaaggctcttcatggttggcctcagctgactgcagctgctgcctggtcccagccctgtaactcaatactggaatgatgcaaagtctttatagttccacttctctgagtctcggcctgggctgcccttcctgcctgatgcccttctccctgttctcatttattactcactcctcaaagaccaccccaaagggcacagctttttggtgctcagtgaccttattgaattaccctctgctgtacccatgtctattagtgcacttgccactccacactggaatgattagtcttcatgtctgtctcatctgcctactcatgtgcttctcagttgacagtactgtctgagccttactcctttctgtatctccagtgccttggagacacaggtatttatttaattgcaaaaaaaaaaaaaaaaaaaaaaaaaaagagcattcaccccttcaaaataggagacaagacctgcaaagagcacagtcgatccacgactccaaatggaatggaatacatttaaaatacatctggagtgggcagaaaaagaaaaatgagctcaaaataagttataaaagcttactttaaaaaacaacacttagaggccaaggcaggtggatcacctgaggtcaggagttcgagaccagcatgaccaatatggtgagaccccatctctaccaaaaatacaaaaattagctgggcatgatggtatgtgcctgtagtcccagctacttgggaggctgggacaggagaattgcttgaacctgggaggtggaggttgcagtgagccgagatcacacgactgcactccagcctgggtgacagagcgagactctgtctcagaaaacaaacaaacccccccacccccaaaaaaaccccacaacacctaaatttataataaccacaatctttattattattattattattattattattattattattattatttgagacagtctcgctctgtcgcccaggctggagtgcagtggcgcgatctcggctcactgcaagctccgcctcccgggttcacgccattttcctgcctcagcctcccgagtagctgggactacaggcacccgccaccacgcccggctaatttttttgtatttttagtagagatggggtttcaccgtgttagccaggatggtctcgatctcctgacctcgtgatccgcccgcctcggcctcccaaagtgctgggattacaggcgtgagccaccacgctcggccaataaccacaatctttaaagttcattgtctattaactttaaaaacaaaggaatggttgggcagatttgtctattatggaatcagaccagcagcaggaagggctcaattggaaagtgctgagaatcccacggcttcgatcggttgtatgggtgcttatgaaataaaagttgcaagaatgagtgaacatgtactcctgttagaatccatgtacgactttttagccagagcttctcccagaaaaaatcagacttttcacaaatatattttggttaaaagtatactaacccaaggtaagaattttttttttttcaaaaaaagaaaatctaatgtgtattttgaagagtttatactcaggcatagtggagatcccttctttctgttttcttggtgggaaaggcagaagcagagaggtcaggagaaaggagatggggacggataacagcatggtgggcagtgccaggcatgctgggtgtgtttctgtttgaatgtccaggctgtgacaaagggaagtaaggaatgcatgttggagggacccatttctcatttgccctcatgtctagggcccagaggaccagtcacttaggacagctgaagccaagcaactgttgacatttctggccttgtctcctcttctccctcaccaaaatgatattagctgggacttcctcacctcctatccacaatgcattccctgttccagaaacatctcaggctgctggattaccaaggctggacccaaaccaggctgtgctcagtcactgctcattccgcccatgtggaggaaaaggttcaaggggatacttagagtctcatttgttcactgagggctccataataaagttctgctaaaaatgcatgttgctcctgaactcctgcagcctgcggtttgggacagagtgttattttggagcattcagagttgctgatgctattgtgcccttgtccccgcttggtgtccaaactggagcatttccttgctttcttagagctgccttcacttgaggccacaaaggactcgcactattaatgagcttgtgcaccagaccaactgctgcctcataatcctcaaaacaacctagagaattttttagaggtgaagaggctttagtgattatcaagaccagcagtttatcaactttggtcttgtttttggcaccgcaaccttttcttcaaaagagtcttaagtaaagttgtatcacttatccttcctgtggggatagagttgcaaaaatgcaagtgtcactctgatgtctcttgagtcaactgctcacctgctgtcagtgacagggtgtggggtaatgggatgagccctgcagagcccatgatcataggattaggtcaggaggaagacgaactccaggaaaaagctcccacaatagtagggctcttagctagaaggtggaaattcattctaacagaggtcttgttcacaagcatatttaattagtggcaagagcccaggaaaggactaaattcttgtaatttaggatggtctaaagtatggaaggctttatgtacatttctgaacagccttctcccccttcttggaggcagctgtttcaagtagcgactggtgctcagcctctggagctggcagcggagcccgtgggtgtggcgaggtcagaagagctttgctcaaagccagggtgggtgtggctgcctctgcagccctggcccacacccttcctctgtggactgaggcctcctcctgcccaaatccagagaggactcttaactcttcctcctgcaagactcagtcccaaggcccaggaaagccccagttgctaactctgatttggcccttgttgagctctccatggacatggtggcccctgtggacagggagacaggagagtggattctgctctcccccttcttcagcatcacgttcctcattctcactctctcatcttattaatggcggcaagagttgggaagatgtcacagcatatgggggcaggaggcaggggctatgcttcagacaggtgagtgattgcaaaggacaggctgatgaagggcctggaagaaggttaggaggggagtggggagggagcagtgagcctcatcccatggtgctgcatgctgggctcccacctgcaatgcctggcctccttcctctgccaattcaaatcctacacacttttgagagtccatcccaagtatcactcctctagaagtccaccagacattcctgccttccccgaccttccctcttctctgaaccctatggaggatatgttgtcttggactgagccctggcagatcttccttcaccagacttctggactgagatgatgcattaaactcctctgtatcctccagagagccaggttatcaggcactaacctaatgcagaaggaggtgacttagtcttaagctgtatcagcttcctgaaggctcaagtgccttcctgggacaggtggctctgtagggctctgagactctctgaacaggtacctctatcacagctcctgtcaccttatattgaagtgaccattctcactccagcctcgccctctgcagggcaaactgctgcagtcaccaatccatactcccatatgcattttgttatttccagggcattgcatagaattaacagggcaggaactcaacaaatggacagattcccaacaaaccaaatggaaattaagagactactgtgaagacacagaaaaaagaactggctgatgaataaggagaagtgggattttaaaaagttgtgatgcaaattccattataaactggaatcaaagtcagcattaactaatagtaacattaaaattattgccccaaaatgggtaattttaaatgtgactgtacaagaaaaatcttattttttcttgtgtacgtttaatcagattcttggaaataaactttctttctactcttggatactgcaaaaactggatatgcccaaatctaattttcatatggaaatagttgatatactattaggatttttaatctagtatcaccatttatagaaattttaaatttttttctattaaagaaaaatgcataattttttgagaagtctagatgatttcagccaaagaaaaatgaaagagttgatgagtattaatatagaaatggcctcctggatactgcaatttgtaagtcttagatttatggccggttccttaagagcagggaaatggctattgcatgctcccaggcatgattctttttatccaatgattctaatactttttctatctttcccttattaccaaaaaataatgtcattaaaatcttttttaaggaataaaagtgaaagccagtaggttttggttccttattcatacactcaggtttgtaaataagaaaaacaccccaaacacttcttttatttcccactgcatcattatttccaatgttaagttatcccatctaaaatctagccttttcactgtagaaatccacatttctcattccttaatactttttttttttttgagacagagtctcactctgtcacccagggtgcagtgcagcggcaccatctcggctcactgcaaccgctgcctcccgggttcaagtgatcctcctgcctcagcctcccgagtagctgggattacaggcatgcaccaccacactcggctaatttttgtatttttagtagtggccagctggtctcgaactcttgctctcaggtgatccgcctgcctcggcctcccaaagtactggaattacaagtgtgagccaccgcgtctggcctcattccttaatcctttgttagaactttctagtcaatacattagagataggtgctttagacgttcaaaggattttatgcacattaaggtcaaattctgactgaagggaagacccactgggcactcttgacccactagccagacaacaggtgtaaagacaggggcacatttggtgtgagctatgagcagtaggccacagtggcaggcagaggaagctgggtgccctagacatgagtgagggtgctgggtgtgtgctgaggtcacccaggcgccagggagaagccagggtggctgagggcttttaagaacatggacgcctactaatcagtgtgacattttttgcattgctctccgtaagtcctttccctgtcccaccccacacgctgaatcattctctagaacaatgttctctaacagaaatatgtgagtcgctatgtagttttaaattttctaggagctatgttaaaaaagccaacaaaaacaaaaacaaaaacaaaaacccaacgaatttttttgtttgtttgttttgagacggagtcttgctctgtcactcaggctggagtacagcggtacattcttggctcactgaaacctcagcctcctgggttcaagcgactctcctgactcagcctcctaagtagctgggattacaggcgcgtgccacatcctggctaatttttgtatttttagtagagacagggtttcactatgttcgtcgggctagtctcaaaatcctgacctcgtgatccacccatattggcctcccagagtgctgagattacaggtgtgagccactgtgcctggagttaattttaataatgatttaattattaatttaaataatataattagtaaattttaataatatatttcactcaatccaatatgttgtccaaatactgccatttaaacatatgaaaattacttatgatactgcttacattattttagtgcaaagtgttcacaatcatctgtgtatttcatacttaagcctacctcagctcagactccccatttcaagtgtttgacagccgcgtgtgcctggtagttcctggagtggacagcaccagtggccctggctgggccagtccttcgtatcttgggtgtttctggccccacgctcagttcttcactgggcgagtctcccagggtgggaccctcatatactcaaggacttcactgctgacagcttgattcatttaattcattagcttcccaacaaccaggggatatactgctggctcctacatctatgggcacacgtgtattctttttagtcgggtctcttgaaatagcctggaaatgtgcccttaaactgcaggggaaaaaaatctgggaaatgccttttcctgtaaaagctctgattttacatgcatgcccacagccaccacagtcagggctgccacacaggacagacagggaggggccgcccttccctactttgctgtgttataaatgaacatgttcagttccaacaaccttaataagcagaagatttctcaaatgcacaacacagtactccatttctacttttttattggtaagcgatgggatttcatttgtaatgtataattctgagaactcgtgggcacttacaagcactttaatgctctaagatgattgaggtgatgaagagactgcaataaaatatctctgaaaccaaagatgatcaatcacagggtcgttttccctagccagagagctctctagaatctatgaaaagattacttactggaaaaatgaaaaaaaaaaaaaaaaaaaaaaccaaaagaaaaaaccaaaaaaaaaaaaactaaaaacaaagccccaaccactccaacagggctctttaactgaacattagtcatccctttcccaagaaagacattcactcctcacagcctgacagcctcagacaacagttagctgtccaaacccattcagacaaaattgattatttttttttttcatgaggggtgcagataaaattctcaaatgaattgcctgagaagtcagtttgacataatatcccataaaatctttgctgcttggaagaactataaaaagtttcattaacatagagcttcattccactccaactctttgcaccaacttcatggcacgttagagcatcaaggctcaggtgatttacacacagggagcagaaatcattgcatctcagccaaagagtgtgcaattttaagtcggtttatctaacacttctattactcaaactctgcatttaatatttgcaaaaggtctaatgcagggtgtgcatcggcatcctacacagttatatctgcacccatgtggttttctacgaagagaagagaatcaggtcaaacttattattacacttgtattgctctttcttccttctgtattagacatggtctctggaagcccagagcatggactaacaagctctgccacatcttatagcacagcatgtgctttctaactatgtaataatgaaattcttttttttttttcttctttgagtcaggctcttaatttgttgcccaggctggagtgcagtggctcactgcagcctcaaactcctgggctaaagcgatcctcccgccatagcctagtgtagctaggactacaggcacgcgccaccatgcccagctaattttaaaattttttttgtagagatggagtcttgctatgttgcccagcttggtcaccaactcctggcttcaagtgatcctgctaccttggcgtcccaaagcactgaggttacagatgtgaaccagcatgcctggcctgatgaaattcttgatggctataggcagggacctgccagccttgcagtttcctttgctttcctcttctatcacccatttctttctaagggagtgaggcccttgtcataccctgaacgttttgaaggcatcaagtctcttaatccaacttctcttcccacctcggaatctcagtccagggcaaaaagtccacctagctcttgataagcagagactagaagaagtaggagaaagctggcgagggcgtgttttacaagagttccattcagtttcctgcagctttgagaatcctaaatgccacatggagtcctgccgcccattcagctgggcagcacggcaggtggggcgagatggccttcctgcccaaattctgcccaacttctgcccatcactgtcctgggtgtgggagattgggagggtgtgtatgtatggttgagattgtagatatcttactttgaaaaggactttccaacccaaagagcaactgtgaagagtccagagtttttacagagaaaaaaatgcaagtttcaggactacagagcaaatatagtgaggaagagcaatttgtaaaatactaaactaggtttctggacatacctctactgttaacagtaattctttatttaaataggcaagacattctgctcttgcagaaaggcccttgcgatcagaataagaggaaaatagatcctggtaaggacccaggttctgagaacaccttttagggtctgacatctctgccaggtgtgaagagctgagaatcagtggatctgagttctagccctagttctggtgttaactcctcagccataacttccttgtgctttctttacaatgaggataataaaaccagctttgtcttcttcacaggctattgctgaagacaacatgatataacagaattggaagtgctttcacaaacattgttttatgaacacaaggtaaggtagtgaacaaatacctgactttgtgaatttgcatgctgccaatatatgcacacctgcatcataaggtctcatttatgatgctctatgtttgttttttttcctttaaaaattttctgtgtattcccagctgttcaaaatataattccaagtgtgtatcatctgtagaattgggccactgcagagcactatgttgttcctgaacctaatccaaagtttcaagagctagcccatctctgaacttcccaccagcatgaaaaccctaatctaatctgtgcaacaataatctctagataggcatctctcacacttgcttttggagtactgttttagtagcttacttgtgttttttaaagttcatttctccacccacaggatagctccatatcttccagcaccactaatgagtaagtattagggccaagctggtatctgcagagtgctgactggccaagagtctgcctgtgactcatgccttaggctgtccagcattggggtgctggggggctgtagccataacatttgcaggatttggaaattccacctcaagctccaatcccagggtgttgattctggctaaccatgtttatgcaaagcaatccaagcactttgactcactttgggaatctggcattcttgggcttttgatattgagacagtggaacacttttgtatcagtttaggttctgccaataattgctatccatttaagcacttgattttttacatatttaccagcaatttccaaggctttaatggatagagttagcactcttctgcaaggagaaattgctccacagtgctaatagtcgtggattcacaggcactcagtgagaatattttaggcataagcttagttttattattgtaccttagagaaaccttgtatttttaactaggtggtaactttttactgtattagttaatcaaaagaaacataaatataaccaaaatgttatttttagtttgtactggattctataaaaatatgattacccattctagctttattttgatgttaatatttacatttaaatagaagaaaaacagtaaagggagcacatcaatgtaagaagtgtatggctttagtaaaatatataagaaactttggtaaacagggatttaaaaaactctaatcccttcaccaactcagaatgccagttccttacaaagctgcatacctgagcaaccacacatgtggtttctgtggatgagacatttaaatgatgcaatcattttgggataacagttatataatataaaggtttcacatgagtgtctagctgaaaaaccactgcgttttcctatgaatgcaaagaaacctctgctcaggtgttggaagctgtgcctctccagctgcctgccaccttccaccccttcacctgtggcttccgctggtttctgatgggcaccctttgatcactggggtcagttcaatttcctgggccactgggtcatgggcaggacatgaaaatgtaagaagagggaccatgcggttcacctaaatgacactcatttaataacaacatcaaaatccttgatgtgacaggacctatcgcctggcatactaaaagtggggagagcaattctctcatcttctgctgtagttaatgatatcttcctaaacctgcattaatcatcaagtgaacttctagggataacgtaacttctgggagaatttaaactgagattgaatttgtatctcagacggtagtgcccacagaggtgggcagtggcacaggcttccttcagcttgtgtcccaggtttatgggagaactcttctccctgtccctcaattcacacacaaaagtgcaaaacaggattatgggcatagggcatgggcaatttcatctacagcagtgccgatctctgcctcactctttgaggtcaccacaatgctttccttctgttcagaaccataatggtttctgtgtatcaattgtttgtgggcaactgctgaaagggaatcgagggataaacatgattctaaccaatcgcattctgtggtgtctatgggcttccacctgttaacatgggaaactttctgaatttaggttcatccccatcttgtggaattggatttccaccaagggttcctgctcctcatttagcgtggaagaaagtggattttgcaaataacattcatgatgttttgggcagtatctactctgcctgcaaggtaagaatgagtctgtgggagaacatccagctgctgcaacttgcttcaaagcctcctttttttttttttttgagacgaagtctcgctctgtcgcccaggctggagtgcagtggtgcgatctcagctcaatgcaacctccgcctgccgggttcatgcgattctcctgcctcagcctcccaaatagctgggattataggcgtgtgccaccatgcccggctaatttttgtatttttgatagagacagggtttcaccatcttggccaggctggtcttgaactcctggccttgtgatccacctgccttggcctcctacagtgctgggattacaggcgtgagccaccgtgcctggccaaagcctctgttttattggcttctctttggtgctcaaaattcccacgttcacattaccttgtttatttgaggtaaaggctttcatcaaaatcttcagttaagataaaaatggcaggaagataaaggtggggacttacaaattacattcttaaaagccacccacattttggtttatatctcttattaaatctgcagtacaaattggtttgtcagctctgtttacctgaaagtgtcctgagggaacagaacacatggcagagaagcctgtctggcagaattaaggactaggagctgggaagttccagagcttagaacaacgtccagaagacagacttgcaattgtgctgcagaaggacaaactgttgcctgttggcagaagatggggacagggggaaggaggaagcacagaaggaggaacagaaagggccaaagacaatgtctgtctgttgtgaggtccactggggctggccttggtcacctgcctgacctcctcggagtgagcgtgagacggtcacgtgtactcagggattgaggaggcccaatgctttcacacttcgtaaattcccggggaacactccacactcatactgaaagggacagtgtggccctgactgacagcatgtccaggaccagagtactaggcatgctggactccataggatttagaatgccacagtggccggagcagcaagctggcacactgggttagatggcaaagtgaggatgtgtgggtgtggacgtgggtgtgtgcgcaaggtggcggcaggatagactggtaacactcactcccatgcattttcagcttaggctacaaatgacaaatggcacaccaaagtgaggtgtggtcgtgcagacagaaaaagcaagggcctcctaatgcccaggaagcaaaaaggaaagaacgtctcttcggtacctcatgacttcctgctagaggcctgaagtcactggcacactggaggattctgttagtattctcatcaggtatgctgtttattagacagattaagactaaaagaaaatacacaaaaatagaaagctgcttctttgagaatgatgagtatgttttcaaaaactttaaattttaaatatttatagattcacatgaaggtgtcacaaaatgtacagggaagtcctgaacactcttcacccagcctctgccaaggttagtgtcatgagtaactgtagtaaaatgtcgaaaccaggaaactgacattagaacaatccacagagcttattcagatttcaacagttatgcatggactcatttgtgcatgtgtgtgcacgtagctatatgtaattttatcacacgtgtagctacacgtaacagtctaccacaatcaaagtatttaaccacaccatcaccacaaacgtctttcatgccagccctgtatagccacccctcaaccccaaccctaaccacaggtaaccactgatctgttctccgtctctatagttatgctatttcacaaaggttacatacgtggaatgtgaagtatctatccttttgaaattggctttttttccactcagcataaattccctgagatccatccaagttgtatgtattaaccgttcattccttttattgctgggtagcattcaatggacttttaggtagtttctggttcttggctattgcaaataaagctgctatgagccttcacgtacaagttgctgtgtgaaaatatatttttatttctctgggatatatgcccaagagtgcaaccgctgggtccattttcagctataaaaggaactaccaaattattttctggagtgtctataccattttacattttcaccagcaatatgttagtgagccagttactccacatccttgccagtgtttggtgttatcattattttagacattctggtaggtatgtactggtatctcatctcattgtggttttaatatgcattttcttttcttttttgagacagagtctcactctgtcactcagctggagtgcagtggcgccatcccagctcaccacaacctccgcctcccaggttcaagtgattctcctgcctcagcctcctgagtagctgggattacaggtgtgggccaccacactcagctaatttttgtatttttagtagagacagggtttcaccatgttagccaggctggtctcgaacccctgactcaagtgatctgcctgcctcagcctcctgaagtgctgggattacaggtgtgagccaccatgcctggccttaagttgtatttgctaatggctaatgaagttcagtatcttttcatgtgcttatttgccatctgtatattcacttcaatgaaatgtctgtgtatgtctttcatccattgttgtaactggatggtttctttaatgctaaggtctgggagttctttatatattccacatacaagccctttgttgaatatgtggtttacaaatagtttctcccaggccataatttctcttgacatcctcttagtaggtctttcacagagcaaaaggtttttaatattgatgaagtccaatttaccagtttttccttttatggatcaagctttttgtgtcaagtcagagaactcttcatccatttccaggtcccaaagatattttcttatgttttcatattagtttcctattgctgctataagaaattacacaaatttggtagcttaaaacaccacaagtatatttaccattctgcaggtgagaagtccaaaatcagtatcactgggctaacattaagatgatgcagggctgtgttccttctgaggcctctaggagagaatccatttccctgttttttccagtttctagaggcggcctgcctttctggactcatggcccctttttccatcttcaaagccagcagcatttccaaatctgtcactggctctgcaaagttccttctgccacgtaaggtaacacaatcacaggttttggggatgagcatgtgaatgatacggtggggggcattattctatcacagtttttttctagaagttcgaatgcattttgagttaatttttggatacgatgtgaagtttggattgaagttcattttattttagcctatgaatgtccgattgtttcaacaccattcattgaaaacgttccactccaccaatctccgtcttttaattgatgtatttagaccatttacattaaaagtaattattgacgtgttaggattgaagtctgccattttcttcgtttactgttttattccttttgtttctcatttctctctttttttttttcttttcttgccttcatgtgggtacttgaacatttttcttcttttttctttttgtttagagacagagtctcactctgtcacccaggctggagtgcagtggcatgatcatagctcactacatcctcacacatctggcctcaagcaatgcttttgccttggcctcccagagcactgggattacaggcatgagtcactgcaactggccttgaacatttcttagagttgcattttgatttacttataatgtttctgagtacactgctttgtacacagtttccttaggggttgttctaagtattgccatacacataggtaacttatcacagcttactggtgtcaatgttttaccacttccagtgaggtgtagagaccttacctccatttagatctctgtatcccctccagttttaaaatacaattatcttaagtatttcttccacatgcactgaccagcaccatcagatgtcattataacttctgcatcaccatttctttcatatgatgaaagaagctcatgagataaagaatagtctagtatgtttacttctatttttactcatcctgttctccctgctctgaaaatctcagctttgggcttttaccattttctttctggtggagaagttcctttagctattctttaagggtagatctactagaaacaagttctcttagttttcctgcagccatgctggagacctgcatgccttaaagtcatcagtggctgagcctcctggaagacctagcactacccacgtggcactctgtagacactaacatgtgccacttcagctcctggcaccctgataatggccaacaccaggtggcaaggtgcaggctaggctccccttgcccactcttggtcttgggcccaaggaaattagagttgaggcctattctcaagagagacagatcccttaggaggtcaatcaaggatagcagtgccgtgaaaactatcttcaatagctcagctgggtcagaacagtgttctagaagtttgagtctaaaatatgtgagccctgaaatccttcaacttctagggtgaccttgaggtgtcagagctattcctatatccagtaatactctattggcacaggccccaggcctgaaggtaccacatataacacaccctcattcatgaccaggggtgtaccttacaggaacaagaatataaccattcattagggctcagacctcagatgtcaaaaactcttagcagaaggattggctaagagctccaggaagacatcagagttagagatctcgatctgggaggcatctggacagagatgaaaattgcagctataggaatgcatgagatcaccatgagaagaaggtagaggaaaaaaaccaaaacagacccaaggctgaaccctggtaggaatatcaagaggatatagtaggatggcagcaaagaatagacggttcgaagaaggccttgtcaatggggttccatgctgcaaagaggtcaaggaagttaaagactgggaagatgtcagaggcttggcccaggggcaactaaaccatggaggcccacaatgcacagatgctgggaaccagctgtgagggaggaagggctggtgagaaattaaaggatgggaaaggagagagtgctcagtagtcacaatggttgatggatttgcctgtgtttgtattgtttgggaaaatatggaaatgttataagcctgagtaggaagaacaattaagaaaacaacaagagaggggctgggagaggagggggagagaaagaatgaggtcaacggcaccagaggagaaaaggatcaggcatttcttcctgaaatgggagagaagcaggcatgaatcaagctagaaataagtttaaggtgaaaaaaaaatagaaatttaggatgctgctccaaatgaactacacagctgactagcttatttttcttttgcattaaaaaacctttgggttggctgggcatggtggctcacgtctgcattcccagcactttgggaggccaaggtgggtggatcacctgaggtcacgagtttgagatcagcctggccaacatggtgaaaccctgtctctactaaaaatacaaaaattagcagggcatggtgacgggcacctgtaatgccagttactcaggaggctgaggcaggaggatcacttgaacccaggaggcggaggttgcagtgagccgagatcgtgtcattgtactccagcctgggtgacaagagcaaaactgcgcctcaaaaaaaaaaaaaaaaaaaaaaaaaacacgccctttgggttgctgaaattaatgtgatcctgttggggcaatggtggtttccaaatctgaccaaacatcaaaatcgattaagaaactttgcaaaaatacagcttcccaggccccaacccagccacacttaagcagaatccctggtagagggggcccaggaagcagcattttaaagtttcttcagtgatttagagggttaaaccaggtttgggacctctcgagttacgatgttcaaccatgtatgtatattagaatcataaggcaggtattggtagacccagactctccagattacaggtattaatatttttaaaaagctccacaagtgctctgatgtacaccctggttataaaccatagtcaggggactggtttggaaaaataaactatctggataggatacttgactttaccataccgattggtcctctgtcattcagattgcctgacaattaactttacacttttctcctattaaaacagcacctgcttctatccgggctgtcactggtgggctgatggttccctgtggcttctcagcggatttctccaggcagccaggcttgtgggcttaccatctctggccctctggaaagagcctggctttggaagtttttgtagtatctttaatgtaaagtatacaaaatttcattgttctttatctgaactaaccacacaatgcaccttataaaagaaacagtaagacacagaatggaggaaggactatagaaaaggcaataatagttcatatttcactgattagaaaaaaatattatcaggcagacccataattaatttggtgagaaaattccttgcaccattaggccgattttttgttttaaagcagcagtaacatcaccaaacaactacagaaatgagagtctcgcatatagctgtttggctttgagggaagctgtaagcccagccctctaaatgcctctcaaagaaatacaaattcttcttttatctaaaatgatggtgtgatccaattcctgctccagcagccccaacatatcatctgttggactctttaaagtttacggcacagacagaaactgtcagttcctctcctcttttataggacattcacatttgcatattcagcagacagcacaagcctcaaaggccatattccccagaatgtaatcatcctacttttgaaataccgaagatataatagtacaatgaaaatattcttaccccgatgaaggctggctccagttgtggcttagcaagtcaaaaactagtaaacttgcctgtaacaacatcctaaaattccaaaggttattcttccccatccacagttaaaaagccatctcctacagaacagtgtcatatctgtgacatgtccaagattaaaggaagagccttcttgcttttagtaatttgtctggttagagattaaagaaaaaaaaatcaatcttgaagctgtcagttaatatttttaaattaaaaaagccatcttcatgcttcatgggagaaatgtgtgatttttaaacagaggtaaattcctcttcgtatcaagtatcagataatttttttgcatttcagcacgaggcaaacaaacaaaaggttatccacgaagtttcaaacgcgtcttagtaacataaactgaagttaggtagccttctttgatattgaattaccaaagtatctcgctgaaaaaaaaatcccccttgcaattaataaacaagttgtggtattttaacaaagttccaaagctaagaatcttcacattccaaatctttccattcctggaagagctttggtatttagatgttaataggatgcctgccttttttttttttttctttttttggccaatcttcaggctaaagagtctgtgaagcagactttttccatcctatgacctcagttttaggatttctttcttgcaaaatttagttattttggttggcagattgccagaattcattcttattttctttctccttctggtactttctccctttacccccttctgtttctctcccttcttcacctatcttgtattattctctgaattgaattaagaatttaaagtccggttggtggactggactacagtctctatgatgtttggtagggttgttagaattagcaaatgaaaatacaggatgcctagttaaatttgaatttcaggtaaacaacaaacaaatttttagcataagtatgtcccaaatattgcatgagacacatttacactacaaattattttcaagtattgcatgggacatacatattgtaaaaaattactgtttatctgaaattcaaatttaactgggcgtcttatattttatctggcaacactactttggaggttcaatggaagggattttaaaaaaaacaaaggcatccatttacaactcctggaagaagagaaatttccactcctatcctcttgaacgctttttgtctagatgtaatgttcttgattacctcattttagtttatttttgacccagtaagttgtactaaaagctccacagagcatgtcacatccttatattaaagaagtccatcccaggtttcaggtctcactcggtgtcaggccaggccagagcttgcaaaattggtcccccaggcaacatgggaccttggcgcagtaacagaacaatgcaaatgctccagttttaattttttccttcaaaatctgaacaccaaatttagtacttttgaaggcactgatatagttttctctcctcagtgctcactttggggcaatttagcatgattagtaatagtgattattagaaaacccaatagaattcacatgaatgttgaaatgtaataaaatgatcactttttgggcattttgaaagggcagataaaaatattgatatgcttctgacatttaaagataagatgaagatcttaattacattaattattaattcaggtgtatttctgaacatctaaagaaacccaggagggcgacacataattccaaaatgccgttctcttatttagagacacattgatattcagtattttggaactattttgaagtttaatagctgaaatggaggctgtactttaaattcttaaactggactttaaattcttaattcaattcaaagaataatacaagataggtgaagaaggaagagaaacagaagggggtaaagggagaaagtaccagaaggagaaacaaaataatcacacagaggtgtgagaaaaagtatgggctctaggcgggtgcagagtcaggtgctctagcacctgtttgtgaacccagctactcaggaggctgagcagggaggatcacttaagcccaggagttcaaggccagcccaggcaaatagggagatctcttttttgaaaaaagtatgagttcaggagtcaaactgggttcaaaccctagctctgtcacaaactagctgtgtgaggctggtccagtttcctaacctttctgtgcacatattccttatctgaaaatggggataaccaccccagagagccgtaagagtatgagacaagcactcagaacagtgccaagaacacagtaaatgctcagtaagttttaggggtgaagatcacgtgatctagcccaaactatcaatagaaagataaaactcaccaagtcagagaatgtctccactttgataactgggtcatgagagaaaagatttttctcttgcagtcaaatgggtattttaaaaaaattataaatagcaatattttatgtatttactcattaaaaagaaacttctctttattttcagaggatacaacttccaaggttgtgtgaaattagcatgatactactgttccaagaagtgaagctatatggttatcagttctatccaactactggttattcttgtttcaccctacttattattctatttactcccagaaactccacaagcaaataaatgacactctttctcatccctacccccaaagccaattaatcgaacttgatcgtctagctttactgttaagcagattttcaaatgaaatagtcccaaatcactgggtttccagccatctggaaaccactttgaacttcatttgtttatccatgtttttaatgcagctcaggtgtctgtagtctgaggcagtgaggaaaacaagtgcttctgagtcaaacacctctggggtaaaatcctggcttggccatgctgcctacctgggtgagctctctctgccttggtttcttatctatacaatgggatattctaatgttgtctcctttctgagttgctataaagattcgaagagctgattcatgtatagggtgatcctatgtttcagcttacacttattgtccctgcagaattgttacactattacccttatttttataaagtatttaatacagagcctggcacacagtattcagtatttgttttttgtttctttttttgagacagagtctctattgtccaggctggagtgcagtgttgcgatcttgggtcattgcaacctctgcttccccagttcaagggattatcatgcctcagcttcttcccaagtagctgggattacaggcgtgcgctaccatgcccgactaatttttgtatttttagtagagatggggtttcaccatgttggtaaagttggtctcgaactcctgacctcaagtgatcagccttccaaagtgttggtattacaggtgtgaggcactgtgcctggccagtattcagtatttgttacctcttaatcatgatataccaacacctgcagtattctaactaaatccttgaaatcccatggaatccttatttttaaagcaagaatagccttttttgacacaaaaaggtgagtgcctgcctgaatgtgaaagtttggtcacctgcccattatctccacattccctgtccctttggatatttcagtcatttaagaagttaaaagtgggggtggaattctctgcggtagaaccttggaggcagaggctaacatattttacatgctttggcaggatcatgtgagcacagctttactaaaatacactctgccaacagcagaaggccctctgaggtgagcaggtgggacgaggctgggaagctgtcacttgacttctgccagctactcggaatgtcagatgaatcccagactgcagcccctgcggtttccaaggcccccatcactgcacagaaataccaggctcactcagcgacaggagccaggcttcctcctgtcgctcctccccagcctcctcacagcctcaagatgcaattctcttgacagtagggagggagggcagatattaagggcttttagggaaataccagccctttcttcagaaatggggtttcttccttaacatctctcccgtttcatgtgccctctgtgccaggccgcgtgtggtgtctccaagaggatctggagcaggcggacccagtcggaatcttggctctgcggctcatgactgcaaacccctccaggagccaactcacttctctgagacctcgtttttctcttctgtaatatgagatgtaataatgtaataatacatctcattggattgttatgaggattaaatgagacaacatgtccagtagactgcctggtacaaaataggcatctaaggcatgccaagtatctttatggtcccaggctgcctgagaaggggtcagcattagaggcatgcgggtgcaaagagaacctgcgatctaggggtggaaggtgggcgggcttcagtgtgcaaatatgcaagcttggcatttaggaggttttacatctcaactagaatccaaggaagagggagaacaaatccagctgatggtatttctgaaagaagacgcacagcgaatgtatgtgttccagccatcctttgtagtatcctgcattccttcatttattcatactgtacttgcttattgaataagtactatgttctcaatgctagaaacacttcaacacaagagcatgaagattcattaaagataacattgggaggaagcacaggcagtctgttaatgtcaggcaatatttattgattgcttgctgcagtcaataaatatggtaataccagccacaatctcccacagcccgggcgactcctcagaaaaacgttggcacctgttaaagccacagtgagtatggagtagctgaagtttcttaactcatgtctctgtggactgaagagctcattgcaaaagggccaaactcgcttccagagactgttccccaccttaatcataactgaagtaaaccattgcttatgtggtctaactggagtcactgaaaacttcccttctcccatgacatatattccaaatgcctacttgttgaacctatgaatgggtcctaaaatattctgggttgtcagttctttgggttaaaactttcctaggtcctactggaatgctcttgggttctccaaggggaatacttcagggagccatatattctagtcgcctcttggcagcgtgcaccagaggaaaggcctgtgtaggaagacactcactggctgagctctttcagcctcagtttcctcatctgtaaattgaggaaagacgagcccagctttcagagctactgggaagactgaagagatcatttacacaaagtgactaggccagggctagaaacatggcaggggcccagtgcatgccatttccttctccttcctcactcctttggcacaaagcatctcagaagttggtcagtaacctctactgtgttttgtgaacaggggctgacaaaagtgaacatgtgcaattgtgacctgcatttaaaaagatgaggaatagaaaatgtcagagtaatggtaggtgatctttgcgacacttttgcttcagtacacacattcacaaaggatacggtataaaatgtacttctgactgtgtaggttatagtcataaagttttgaggtgggtatatacccccaaaaattaagaacaggggctcaaagagataatgtaaacccacgttcctggcagccttattcacaatggccaaaaggtggagccaacccaagtgtccattgacggataaatggataaacaaaatgtggtctgtacatataatggaatattactcagccttaaaaaggaagaaaattctgacacatgctgcaacatggatgaaccctgtggacattacactttggaaaataagccagacacgcaaggacaaatactgtatgattccacttatatgaggtccccagagtagtcaaatgtaaagagacagcaatggtgattaccagaaatggggaggagcagggaacagggagttattgtttaatgggcacagagtttcagtttgggaagataaaaagagttctaaggagagggtggtgacggccgctcaacatgtaaatgtattaatccttgatgccactgaactgcacacttgaaaatggttaagatggtacattttatgttatgtgtattctgccagagttaatttttttttttttttttttgagacagagtctcgctctgtcgctaggctgcagtgcagtggcacaatctcggctcactgcaacctctgactccctggttcaagcgattctcctgcctcagcctcccgagtagctgggattacaggcacgtgccaccacgctcagctaatttttgtatttttagtagagatggggtttcaccctgttggccaggttggtctcaatctcctgacctcatgatccgcccgcctcagcctcccaaagtgctaggattacagacaattaaaattttaaaaaattaaattaaaaaatatttgaggaaccttgacctagataaccccccgaggaaaggtacatttggaaggagcctgggtgtagaagacaaagggtgggccctgggcaattaaacaggagacaggggaatatagactccctattttttttttttctagagagagtcttgttctgttgctctggctagagtggcaatggtgtgacctcagctcactgcagcctctacctcccaggttcaagcaattctcctgcctcagcctcctgagtagctgggattacaggcgcccgctaccatgcccggctaattttcttgtatttttagtagagatggggtttcaccatgttggcgaggctggtcttgaactcctgacctcaggtgatctgcctgcctcagcctcccaaagtgctgggattacaggggtgagccaccatgcccagccagactccctaattttataaactctcttttacgacctctgggaacccggaccttccaatgtcgtgccagaacacagaaaatggggttcgcagtctttttctatgatggtatcatttccaacagacattcctgtgttttagtgttttattctgagagcaaaacaaatacaacagcaatgcctaatcgccctctcaggtgaaactgacctttcctcctcacctcttctccttcagtaactctccccagcccaaagctgactccttggtaggcaaaggctggtcagtcttccttccttattcactgaataagccatgcccctttgcaggcctccagtctaatttgtgattctaactaatgaggtggggtctgaggaacttgaagaggccctttctattttattttttattcttggtttccaatagttggagaaacaggatctggccaactttctctagacaaaggctgtatgctaggtttttcattttcttagctgaaatgattgtggcaaatcacttaaacagatacaaaaaggaggtctctgtggacggacacctcatagactaaaagatcagccacagttcatcattttagacatatattgctagagccaaaataagtatcaggaaggtttcaagtttctctggaaaagaaaatcttttggtaacaattctcaaatcgaccttgatctctcaacttccagacactactctatgatcagtttgtgtaaccttattgttaaatgcacttgcataaatgatagatttctttatatgtttagcacacaattgttcctctgtattttttccctccatatttaatgttttctaagatagtgctacaatgagctaattaaaaaattttaatgaatattatatcaatgcagggacactgacatgaacatgttgcactttgcatgtttctatatgactccaagttgcacattatgtacctgaaagagcctctgggcatcatccagacctgctccaccaatctgtggtgctcacgtcttccaagacattttgaaatagaagtcagtggtggaggtgaattcttcagcctcctgcaggacctgcatccttcactctggggagaggtaaagccacacgcttcttgctgatggtcctactcttggagaaggtcctgtccttggagaagagctcactctggctggcatctctggagtagaccactcagtctttctcctcctcagccctagcttcatgagatcttttaaaactttctattaatttttgtttttaccacccttaacatcttcttagttttccacgttttagttttaaaaaagaagagaaaaattctagtaaagctctgatcagtatcaactgcagacacgaggctgttttatagcttttataagttatgaatattgttataacaggaggaacaatgatttatttagtgcctattacgaaacaggcactttccatatatgaattccaactaatatattaatttttgaagaaggaacatttcatgggtctgagcttataacagttataagacttataatgcggtctgagcttataatagtttccaagtcttttactgtacacctggctggatcattttccttctgcctcattttgtttattttttcctccgaggagttcaacactctctgtttatttctgatttatgtaggtcatttcaaatctttttttttttttttgagatggagtctcactgtgtcacccaggctggagtgcagtggtgtgatttcagctcactgcaagctccgcctcccaggttcacgccgttcttctgcctcagcctcccgagtagctgggactacaggtacatgccaccatgcccggctaatttttttgtatttttagtagagacagggtttcaccgtgttagccaggatggtctcgatctcctgacctcgtgatccgcctgcctcggcctcccaaagtgctgggattacaggtgtgagccactgcgctcagcctcaaatcttcatttattctttaaggctacagttactttgtacgattgagggttatctacaaatgtagaaggatatgctcttgggatctgtctacaagcctgtgtaattgacccttgacttgagagtggattttcagtggtggtaaatgtggattgagcaagcacagtgatcctgccaaattgtggccttcatggaatcttggaaatcttcatctgctcattattcctagaatttttctagtataggcaacagtctagcaggatgttgacctactgcttttcaggcattatttcaattacttgatcttcttgagatggttattgtctctagagaaacaatataagagctctgggatagtagcagaatgggacagtggttaagagcttggcttctaggatctgaatcttgggttcaaatcttggctttgccactttaagttaataaacacagggacattagttcgcctctttctactggtaaaacaggagtattactggattgctgtaagggttagagaggataacacatgtcaagtgccaagagttgtaccttgttaaggtaagtgttcaaaacaggttaattattatcaggtaaaaaagctgtcacataactatatatatatatatataggctgggtgtggtggctcatgtctgtaatcccagcactttgggaggccaaggtgggcggatcactagatcaggagttcgagaccagcctggccaacatggtgaaaccccatctctactaaaaatacaaaaattatctgggcgttgtggtgcttccctgtaatcgcagctactttgggggggctgaggcaggagaatcgtttgaacccaggaggcagaggctgcagtgagctgagatcacaccactgcactccagcctgggtgacagagtgagactccgtctcaaaaaaaaaatatatatatatatatcccatcatggcaactcccaatcaatccccagcctctcacagcaacccctgttgcctttttcttgaacttcacataaagcaaattttacagtatacactcttatgtgtctggcttctttcatttaacataagcttctgtgattgatccatgctatagcgtgagcagtttgttgctatttgattagaagtattccattgtatgaatataccacaactgtttattcacgagttgatggacattggggttcagttttgcacagttatgaatcaagtagctacgaatattcttgcacgaatctttttaatgaatatgtttttcatttttcttgtactaatgcctacaaatgcaatggctaggtcatgcaataaatgtgtgttcatttataagaaacaaacagttttcaaaaattgttaggccattttacactcctactagcaacgcatgagagtttaaattgctccatacacttaccatgatttagtggtattggtatttttaatttgagccattctagtgggtgtatactggtatctcattgtggctttaatttgtatttccctaaaataaacgttattagtgaaaagcaccttttcatctgcttattggccaatttgtgtatcttcttttgtctgttcaaagcttttgtccatttaagaaatttataattttgtcattgaattgtcagaatatcttatatattctagacacaaattatttgtcagatacacgtattgcgaatatattctcccggttcgcagcttgacttttcattttgatgagcagttatctttaaattttgatgaagtccaatccattagaactttctttcatgttgtgtggttttgtgacctctgtaagacatctctgtctgttcctagttgtaaagatactgtcttctgttttcctctagaaactttgttgttttagcgtttatattgagatctgtgctccctctcaattgtgtgtggtatgagattcatttttcccctgagaagttgctctggcatcatttgttgaaaagacccggctttccccactggactgctttggtgtctctgaggaaaatcaaatgaccatatccatatggatccacttctagactattttttctattgatttatttgtctgcccttatatcagtgccacactgtcttaaattactttagttttacagtaagtcttgaagtcaggtactgtaaggcctctaactctgttgttcttaaagactgttttggctacctcttttggttttctataaagattttagaatctgtaaaaccattttctataaaaatgtcctgcaggtcttttgatcaagattgtgttgaatctatagatcaagatgagaaaaatcgagatgtcaacactatcaagttttccaattcatgaacgtctctccatttagttaggttttaaatttctctcaaagatgttttgtaattttcattatacaagtcttacacttctttggctacatttactcagtttttatgttttttatgtcagtttaaatggaattgctttttaaatctcattttccaattgtttattgttgataaatggaaacacaatagatttttggttattgacctttataagtttacttactgattctagtacttgtttagtagtagtccttagattcttaggactttgtccataaacagtaattattttcaatctttatgtctactacttcctttccttgccttattgcctgaccaaaacctccaggacaatgttgaatagaggtgataagggtagatatcattgctgtattcctgatcttaggaagaagtgcttggaaattcactattgaatatgaatttagcagtaggtttttcaatttttttttttttttcagaaggagtctcactctgttggccaggctggactgcagtggcacgatctcagcccactgcaagctctgcctcccgggttcatgccattctcctgcctcagcctcccgagtagctgggactacaggtgcccgccaccatgcccggctaattttttgtatttttagtagagacgggttttcaccgtgttaagccaggatggtcttgatctcctgacctcatgatccacccgccttggcctcccaaagtgctgggattataggtgtgagccaacgcgcccggccttttttttttttttttttttcctgatggccatcattagaataaataagtttccttctagtcctagttggctgggagtgttttttttttctttttaaatcatgaatggatgctccattttgccagaagctttttctgcatctatttagatgaccatgtggtttttcttccttattctattcatatagtggaatacattaagtgattttctaatggtaaaccaaccatgcactcctgtgataaatcctgcttagtcatagtgaattacattattttcatgcgtcactgaatcagatatgctaatatgttgtgaataatttttgcatcagtgtttgtgcaaacattgatgggatattgtatgatatttttcttttcttatcaagtttatgtcaggttttggtatcagggttgtactgaccttatacaataaattgggtagttttccttctccctttattttctgaaagtttgtataagagtgttagttcatttgttggtgttccattgatataaatatatcttaaagttttcatagaatttaccagtgaccttttgagtattataaaatgtccttttttgcctcttatactctttgtcttgaagtctatgtggtagcattaatatggtcacgaatcagctttcttatgcttattatttacatagtttatcttttctgtcttctggcttcaacctacttgtgttttatttaaagtacgtattggccgggcacggtggctcacgccttaatcccagcactttgtgaggccgaggagggtggatcacaaggtcaggagatggagaccacggtgaaaccccatctctactaaaaatacaaaaaattagccgggcatggtggcgggcgcctgtagtcccagctactcaggaggctgaggcaggagaatggcgtgaacccgggaggcggagcttgcagtgagctgagatcgcgccaatgcactccagcctgggtgacagagcgagactccgtatcaaaaataaataaataaacaaacaaacaaataaataaagtacgtatcatgtagaccgcaggcagtcttaattttgtagctggtctgacaatcttttccttttaattggagttttttcagtccatgctatagtttggatatggtttgtctgtctccatcaaatctcatgttggaatttgatccccagtgtggtggtattgggagctggggcccagagggtggtgtctgggtcatgggcatggatgcctcataaacagattaatgtcctccctgaaggtgagtgagttctcactcttgagataataaattagctctagaggagatgaaagagttcctggaagagtaggttgttataaagccagaccatctcttaggtttccctcttcgcacctgcccatttcccctttgcccttctctatcatgttttgatgcagcatagaagtcctcaccagaagccaagcagatgctgatgccctgcttcccatacagcctgcagaaccgcgagctaaggatgcctcttttcttcataaaccacccaggatcaggtattctgtaatagcaacactaaatggactatgacagtccatttgtatttaatgcagttactaatatgactgggttcaggtttactatttttcaatttgttttctattgataccttctgtttttcatttctggtctttctttcccgccatcttttatgttaatctattttttagtattttattttaattcctacaatgacttcttagctctgctgcttttggatatttgtttttagtggtttctctgggtattataccacacatctttatcttatccccagtctatttagatttaatgtcatatcacttcacataaaatgtaaaaactttgcagttgtgtagaattccacttgccttcccttattgtttgtgctattttgttatatattttacatctgcatacatcacaaatcccacaaaataatattttgattcttacattaattaaaaaaagatttacccacatatttattatttcctataaatattttcttcttgtaggtttgagcttccatctcatattattaccctgtggcctgacaaattttctttgtcaatttattgtagtgtaggcctactggaaatgaattctctcatattttgtacatcccaacatgtctttattttactgtcaattctgaaggatatttttgattatttagaattctgggttgggtgtggtggctcatgcctgtaaccccagcactttcggaggccaaggtgggcggatcatgagatcaggagattgagatcatcctggccaacatggtgaaatcctgtctctactaaaaatacaaaaattagctgggcatggtggcacgcacctgtagtcccagctactcaggaagctgaggcaggacaatcgcttgaacctgggaggcagaggttgcagtgagctgagatagcaccactacactccagcctggggacagagtgagactctgtctcaaaaaaaaaaagaaaaaaaaaaagaattctggcttgacagttcttcctttttctcttttgtctttcagcaccttaaagatgcctttgcactgtattacatatttgtgatgagaattcttcagttaattgtatctgtgttcccctgtgtataagatattatttttctctggctgtcttaaagattttctttttctgtttagtttcccataatgttccacggtgtagttttatttgtgtttatcttgcttgcagcttgctgagcttcttgaatctataaattaatgttttcatccaatttgggaagttttcagctattattccttcagatattttttcaggtctattttgtctctcctctcctcctggcatcacaatgcatgtatatcagactacttgatattatcctacaattcactgaggctctgttgattgttttttaatctttattctgtttttcacattgaacaattcttactgatatgagtttaagtttactgattattttttcatttctatgcttcatttatttcaaatgttacatttttcagttccagagttttcatttggttattcttattggtttccattatcctgctgagattctccttcttttcagtcatgatgactatgttttcctttacatccttggacatattatagtagttgctttataattcttgtctgaaaattctaatatctaggtcacctcaagatctattacagtggctattttttctcttgattatgggtcacattttcccactcatatgtcttttaagttttggttagataatgaacactgtaaattttgttttagagattccaaactctcttcttttaaacaatgttgattgttttttgttctatcaggcaataaaatctctagctgattagcttgagcttttgggtacttagtgttatactttgttaggaaggatctgtttcggttttgcccttaatgttacggtgactcctttacactgaaagcacacaccccttctggggtttcaatagaaaatctgaggcatttaccaagcccctctaacttgggtgggattcagattctgaactttgtaggcagtagctgtaggcagtaggcagcagctgaaaagagtctctgctcagcatttttggctttctagttattgttttccactacgctcattggcatattccccacacatatgcagtttaggggttattcaaggattgatggaaatttatatacagaatggagggctctcttctttatggctcttttctttctgtgacttactcaattcccagccactctggcagccctaaactctatcccctgacacctcaagccattacagctgtggctttctccttgagttctaattgttctttgtggactggggcatgccttcatgggagaagctatataaacatagttctcactctttcaaggatcaaatgaccctctttcaaggatcaaatttcctacattctctgccttcttttagttagactatgaatagtttttttaacaaaagtattttgtccagagtttgtaacagctatctgcaggagagttagtctaagataggttcttccatcattaatataactggaagtctgtcacagacattttaatttgtgcttttgtgtgtgcacgcatgttaagattaaatcgctcctttcattgccctgaatgctcataggatcactaaataatatatattgaaggattactcgggtgttgtccagactgtgtcatactgccaagcattgaccatctgaaaccaatcatgatcgatctcccgtttttaaaggaggccatgaagaaagatgcttccttaggaaataagctcttctgtttggagactcccaaccttgtattacaatttaagtccatataatggctttaatgactcagggtcatagagttatacagacagagggatgtataggccttactgaagccacactggttccaccacaccatgaatatgagagaggcatctttcccagtgccccatgcttgctagccctgttttcttcgctctgctccactcctgcagctgccatggagcctattatgtttcatgttttacttaggctgtctccccttttcccattttcagaaatctgtgtacccctggttctgtttacctgacttctgaatcactctgattactctgccccttaatgttacaggccaaactacttcttcccaaaatttatatgttgaaatcctaacttccagtgcctcagaatgtgactttatttagtgacagggtctttacagaggtaatcaagttaaaatgacgtcattagggtgggccctaatccaatatgactgctgactatataaacagacacagagatagacatgcacagagagacgatgacgtgaggacacgttgggaggagacggtcacctacaagcgaaggagagaggccggggataactcctctctttacatctcccagaagcaaccaaccctgctgacaccctgactgggacttccagcctccagaaccatgagaaaataaatttctgttactttcgccacctacttgctggtactttgctctggcagccctaccagatcagtatgcttgccacttaacaaatcctctgctcccaattttcctacttgattgtgactcatggctttagtttgtctcttgagacccacaccccctcttggtatggaaaatgggcaaaaatcagaaggtttatgctctaactcctcacttcagtggaatgacctttctttttttttttttttttttgagacacagtctcatgctgttgcccaggctggagtgcagtggtgcaatcttggctcactgcaaccttcgcctcctaggttcaagcaattctcctgcctcagcctccccagtagctgggattacaggcgcatgccaccacactcagctaatttttgtgtttttagtagaggtggggtttcgccatgttggccaggctggtttcaaacttctgacttcaggtgatccacccacctgggcctcccaaagtgctgggattacaagtgtgagacaccgcacctggcctggagtgacctttctgatcctcagattccttatccataatatggggatattgtttctatcctacctacctaaaaaagctcagatagatgctgcacataagaatgtaaaatactacacaaatcaaaggcatcctgaatctcactctttatccgtaatgtactgtacctcatacccaattataacagaacctctgttagaggtctcttgagcggtttcaagttcagaattctccattcataggagagatgcttgcaacctgttatttctagtttaagaggcaggtgcctaagaaaccgttttgctcaaagaggcaggaatatggggtgatgcttcaagctcccattgtttttatatttccagagggtttaaaagtaattcctcagacaacttacctattttttttcttttttttttctgagatagaatctccctctgtcacccaggctggagtgcagtggtgcgatctctgctcactgcaacctccgcctcccgggttcaagtgattctcctgactcagccacctgagtagctgagattacaggcacgcgccaccatgcccagctaatttttttttgtatttttggtagagatggggtttcagcatgatggtcaggctagtttcgaactcctgacctcgtgatccgccccccttggcctcccaaagtgctgggattacaggtgtgagccaccgtgcctggccaacttacctattttcatagatgttataagaaataaggtacagagtaaagcaaaccagtgcttttaggcaataaactttttatttttttatttattatttttgagacagtcttactttgtcacccaggctggagcacagtggcatgatcctgggtttaagctattcttgtgcctcagcctcccgtgtagctgggattacaggtgtctgccaccacacccagctaatttttgtatttttagtagagacgaggttttgccattttggccaggctggtctcaaattcctggtctcaagtgatctgcctgcctcggcctcccaaagtgttgggattacaagcgtgagccactgagcctggctgggaacggacattttagaaatacgtaagggaaggagaactttagaagcacatccaactgccttaaccaaatgggtgcctactgaatgtgatttttaactatgtaaaattaaatgtaggatgctagtcactttccaacatactttgtatattctttgtcagtctttaaaataatttcattattgagaatttgaaaaaattgtttctacaattaaaacttttataaaataatttattaaaaaatacaacttcccccaaatagcttacattctggttgcatgaatttttatgcagtttctactgttactcaaaagaactgaattttcaatgattctacccttttcagttctctagaatgcctccagatggcattaaaagcctttcccattatattttacaacacaaaaaaattaaaaattagtaacattttaaccatttaagaccagtcacattcattataacatctgaaagcaggacaatggaactatttaaacttttagggaagtatcttaagaaagacaaacatataatcatatctcttatgaaatacacagctctcctattcaagccaaaggatctttctagacaaagaaacagattttggacaaaataagacactcagtattttaccacaaactgatttccaatcaacagcacttaaaaaatgctgttttttaaaatcctgatccccatacagataaattcacaaagcctatcttataataagaaaacacatgccactgctcataagtgataaaaataaagatttttaaggagcaaacctgttattgactcttatggaactaaaataaagtcacttgttagctcatgaattttttaatttaaatgttggtatatcaatttggcatcaaattaatcagtaaaaatatatttggattccttgaatattgagaagaaacagacaaaacatagagtgaggagcacatgttttataagggccttttcttatgtttttaaaactgcttttgttaattcaaaaaagaaactcttgagattccagagatatcgataattgtgcttttcacataattccaaggtgaggttgcagatggcaagcttctgaaatgaccttgttactgcacagctgtgtgggacagcatacctcccagtttaagtgtgaaaagttctgcaattcttaagatgatgctgaaagtctccaaccaaatccccccagcatacatgctcaaatctcattacatttctacttcataaagagaagcatttgcatttttcaagattcctcttactctgctaaagcataaaaaatgcatctgcacccaaagcatttagaaagacattatcatgagaaaagagaaccatgggcttccttccatcatcattattactattacaagatacttgcactatctcattttatgaggcatatttaagaacaggcatctctgatagaaaatgaaagaaacttacgatgtattcgatgtgccactgtctggactctctggctctgcatcacctttctcttaaaaaggaagcagaaaaaaataccgacatatgagtcttacagtctttaagatttaagagagattaaatatatttccatgctcctattaacaatctttcaaaatgtgtagcaggaggcttttaaaacatcttttattgtctgagaaccggatttgcaaaataatttcttttctgcaatgcaactgcccaggcacaaatctgtgagtaggtactgaggagctatttgcaaacaaccagaggcttggagtggagactttgccagaagatgaatatcttacagatggaacctgtttccttccacttcactttacagaaaatttcaggaaataaatccattggcattctatatccaaggcactttgaactttgattgcttctgctaacataagccaaaccaggtcaggctgaatcagaacttggaggaaagaattttttttttttttttttttgaggcagagtctcactctgtcacccaggctggagtgcagtggcacaatctcggctcactgcaacctccacctcccgggttcaagcaattctccagtctcagcctcccgagtagctgggactacaggtgcctgccaccacacctggctgatttttatattttttgtagagacagggtttcaccatgttggccaggctggtctcgaactcctgacctcaagtgatctgcccgcctcggcctctcaaagtgttggaattacaggcgtgaaccaccacgtccggccaggaggagagaatttttactgaacactgaggttgcactgtaggtcccaagatccccctattttataccccatagagagccctggtggcaggttttggggcccctagcttaaagcagaatgagatgtaaaccagaaatcctttctgaccatctgaaaggctagttaaggaaatgcttctgtgggctgtgatcactgaggaattaacgagttgtacgtagttgggggagcttggaaccagttcacttcttgtagtttacagtaggcttaatgtaattcctaatccttaatcaattggtggtttgaaccatgcatcctcattctgtaaggagtttctttgtatttccttgaggcttggagatggaagaagtcactgataactgagagcgtgggctcgtgtgtttcctgatggttgtgcagagccaatacaccccagagaaggctgtgagttgcaagaaataggactgtggtagtaacttggtttgctatgctctttcaagtcaggcctggagatctctagaatcccttggtctactgctcacgtccttgggcccacacattgtaccataccccttttgtcagctgtcaacattagcttgtcgtcacctagtcccaggaatgactccctaaattacataatgaacatatcccaaaggtattgcccaaactgaactcaaaagcaaactttatatgtccttctctttttcttataggaataaacagttgtgagaaaaagaagacacagtttctacagttcgtacatctatctcagacatttatccagtgccagaacagctatgagggactttggctaaaagctggtcagatgagggggaaaaacaaaaaagccacaaaatctattttaactgccttgataacaaacattgattaggcagggcctcaatacatataaaaccatgttggaataaaggctaaagtagcaaattaataaatttgctttaaagctcattcttgtatattttcttttgtcttccaggcaaggtctgtggtgcactcatttaggaggcaaataaggcctgttcaactggtttcagtgctggaaaataatttagtactttgcagaaacattttttccatggactaaccacaatccctcttgtaatcctaaaatagagagttataacacctgcattatataagacaaaactaaatggaagtatattttttttctcaaatatatggatcctttcccccaacctgctttaatttggtgaaactggttactttccccagtctctagcctgcagtagttaccacattccatcttaatgaagaatgtaaaacagcaggcttggaagcagcaggcaatggtaaaattcccaaacaatttatgtcagaaaacaggaaattgaaaataaaaacgaaggcattgtttggatgtttgaagaaatatgttttgccttgaccaatcatgctgcccaagtcttcagcatggggacagatgcgcagctgattatctttgctcttagcagcacttatgttgtggcaacagggcaaacagaataggttctggcaaataggaaggatatagtggggccaaacaggacatggtgaacagtctgagagggagtgttctcagcaaattcagtgctgataatgaatttgcctttctggggggaaaagtaagctggtcaggaacgagatgggattaaaactatttttgtccttcagaaagaataaaacacaaagcttcccccacatcttgaaattttaggtgatgaaatttctgaagttaacttgaaatgtttaagtgtatacaccactgagaattatggtctctttattaggacccaagggaaaatgatgaatgtaatggaacattctagaacattagtacaaatttttttttttttagttgggtgtgcaggagatgtttcccaccccgccccctgcccgccccaccatccaaagacagctgtctccagggtcctcctgtttgtgtcagctgttttcatgatggatatttcatgatggaccaatgtttcacactggtctctttgggagggaatctgcattggtcattaataagctgggtgcagggaagccattttacatgcggaaatacaattacagagaggaagaggggaaaaaatgagccacggaaagaactatatatgcaaatatatatgcatatatgtaaatatatgtaaaatctatgtatctatgtgtattatacactttcaatttgacagtccatatttgtctggctgggccttccacattgcctaacatacactaggtgctcagtatgtgtcttctgttctgatgccctgtcactaatacagaattccatgctgcagtgggaaaagatgcttaaggtaccctcgccagtgagacgaaatatacagtttgagatatgaaacagcttgctgactccaataggtcacttaaaaaattataacagttacctttttaacgcaatgtacagaggacttctatgttgggtgctcttgtgagcataaagataaataatgtggaattcatgctctttaaacatttaaatggactgcactgctggagtatcttactttccatcaatagtgtcatatagggactaaatatgttttttgaaaagaaaatcaaaataatcctgcattaaactgaattctgcacagggaagttttgctatactgcaactttttttttttttttttgagatggggtctcactctgttgcccaggctggagtgcagtggtgcactctcttcactgcaacctctgcctcctgggttcaaagcgattctcctgcctcagcctcccgagtagctgggactacaggtgcctgccaccatgcccggctaatgtttttatttttagtagagacgaggtttcaccatattggccaggctggtctccaactcctgaccttgtgatctgcctgacttagcctcccaaagtgctgagattacaggtgtgagccaccgtgctcggccatatactgccacatttctacacagttatatcaaaagcaatccatgtttatggttttaaaaaaatgaacagaaaagaaaaggtaatgactttgcttacttttattttaaattctgttagcccttcaatgattagtctaagtgatgtgtttttctttgcttgagatggagtcccagtctgttgcccagactggagtgcagtggtgcaatcttggcttactgcaatctctgcctcccgggtaatctcaagtgattctcctgcctcagcctcctgagcagctgggattacagctgcatgccaaaacacctggctaatttttatatttttagtagagatggggtttcaccatgttggccaggctgctctcgaaatcctggcctcaagtaatctgccctccttggcttcccaaagtgctgggattacaggtgtaagctaccgtgcccagccaatgcgtttttatttctagatgtaccaactttagacagtgcctaatgatttctgatatgaaagacaagaggcaaggtatttaatagtctcccctcccttataatttttattagttctgttattatttttagtgcctctagtgggcatttgtaactttaaatatatttaatcttatttctcttgattaatcaccttctgacagtatcttttctttcataccatgtaaaatgaggaaactcacccatctatccttccctcccacctccccgctcacagctatgtctttccttttatatcaccaagatttaaaatattcatactctgttcagtaattattgagtcatcctccttaatactaatttagttaataatttaatttttggtcttgcctataggtcaagtaaaaaatcataaaccaataatgagaatttgcaatattgtgacaatataaatattagtcactaaagaagaaagcagcttgagtagacctgaacaggaggcaatgtcactaaggtagaatgagtgcaaatgttcccgacatttatgtcaaatgaattctcattgttatgttctaccacgtcacaggtttgtctcaagctaaggttatgttctccctaaaatactgttaaatagagcacgcatttagtgaacataaaatgtatatttacatgaaatgtatatagacactttcaaagcattaaaatgaatgaactgtgaaaacaccttccaggccagggatggaacatcatcgaaagtgccttcactggctcccatctcttcccacccttcccaccagctattggtaaaagaattgtggctgggcacagtggctcacgcctgtaatcccagcactttgggaggctgaggcaggcagatcacgaggtcaggagattgagaccatcctggctaacatggtgaaaccccgtctctactaaaaatacaaaaaaattagccaggcgtggtggtgggcgcctgtagtcctagctactcgggaggctgaggcaggagaatggcatgaacctggagcttgcagtgagccgagattgtgccactgcactccagcctgggcaacagagcgagactctgtctcaaaaaaaaaaaaaaaaagaattgtgtgttaatcattctctttgttttctggagagttttttttttctttttaaccgcctatgtatgtattaataaattaactctgttttggtagttgttgtttctaaacttcatacgactctaatcatacctaggcattcttctgagactcacttctatcatgcagtgttatgaattttagatttagccatcatcctgcatgtagctacagtttgttcatcctcactgctgtgcaatactttattgtataaatataccagtttcttatttgttcttctcctgatggacatttagatttttgccatcatgaacaatagaactgcaaacattcatgaacacccttcctcatgcacatgttaggagttctgggccttaagacttccatatggccaactttagcagggaatccaaaactgatttccaaattaacactccccagacagtatatgagacttcaaactgattcacatccataccaacacttgttatgatcaaggttttaaagttttttctaatttaataatgtagaatataattttgttgtggtgtctgcatttctctgagcactaatgaggtaaatattttgtacttgctcttctgtgtcatttcttaaaaattattttttagtattaatttcttattcatagaaacattttattgtctcaataagagtcatacatatagtcgtgtgtgtgtgcgtgtataacttttcaatacatatataaaacttggccgggcgcggtagttcatgcctgtaatcctagcactttgggaggccgaggcaggcggatcatgaggtcaggagattgagaccatcctggctaacacagtgaaaccctgtttctactaaaaatataaaaaattagccgggtgtggtggcgggcgccttgtagtcccagctactagaaaggctgaggcaggagaattgcttgaacctgggaggtggaggttgcagtgagccaagatcgcgccactgcactccagcctgggcgacagagcgagactccgtccaaaaaaaaaaaaaaccaaaacaacaacaacaacaacaacaaaacttttcccagtgttagcctttttattttttctattatctttggataatgttaagttcttaattttaatgtactcaaatttatagataattttctttatttgacactttttgtgatttaagaaaaacatcagaaaaatgttttatactgtcttctaaaagtatatacttttactgatttttaaaaaatacctggattggtttttgtatatggcgtggggtaggagttaagtttcgtttttctccctagaaataaccagttattatggtacttgaagtccattctttctctattaatctatatcatcatctctgccatgagtccagttttcatacgcctgtggatctgcttctgggtctctactcactcactttcattgctcaatttgtctattactgccctcattacttagctttaatatatatttaaaaatattcgtaaggcaaagctccaaccttgctatttaggaacatcttggctattcttagccctttgatctattgtataaatttgagtatcatcagtttgtcaatttccacatacccaaaagttggaaatttgattggagctgtattaaatctatagatatctgaagagaacttgtatctttacaacactgcatcttccaattcatgtacttggtattaggcgtctccatttattttgatatttcttaacgtatttcaatagtttgttaattttctccatagaggtcttaacacatctcttgacagggttattgcttagtaacttatatttttatactaatattaaaagttttaaactataattttcagttgttagtgtagggaaatgaaattaattgtgtatacagcaatcttgctaaattttcttattaatcctaataatctgtagattcttttgagttttctgcataaacaatataatttgagaaaatgaatgttcttctcctttctaacaggtacttttttttcttaatttattgcctcgaccaaggatgtccatccagtataatgttgcataaaagtggaactcatgtcttgttcctcatcttgaggggaacgctgcaaatgtttcaacactaaataggattcttgttttgagtttttttggcagatactgttattgtgttaatgaagtgggcttctattcctgatttgctatttttcctttaaatcatgtatagtgaattttatcaaatgctttttcttaatttattgaaacaatcctatttttcttttaatattttaatataattaatcatgttaatattataaaaaggatccaattttgaattcctaaaataagtacagtttcttaattatgagttatattttaaaatatattttgtacttggctggatggaatttacaaatatttgacctagaatttttacatttatgatcatgaatgatacctgtgaattctttttcttgtactggcttgtcaagttttgatatcaaggttatactgccttgatataatgagttgagaactgctggctttttctaattctctgaagaagggtgtaggtttggaattacctcttcctgtgagtttggtagaattcttagtaaaaatgtctagccttgaaattgtgtggtggaatgatttttaaaaaattactgggccaattgttaaaacggctataggattattcaggttatatttatatgtaaatttcatataaaacatatacatatatacatgtaatacctgaaaaatcattttaatcatagtcatttcgtctagttttgaaaaaattttggtataattttgcacataacatatttttgttcttgatctgcatcacagtttattccctttttgattcctaatattatttatttgtgccttttctctttttgtcctgatcaatctctctgcaaagtttgtcaactgtattataacttcattgaataaacttttggctccattgacatttaaaattttatctctgctattttattaatttctgcttttgttttttttttgtaaatctcttttccatttgttttgggtttattttctcttctttcagctcttaagatagatgcttagttcattaattttttgtttgctagtatgagtcatttccttatttatttagagacggagtctcactctgtcatccaggctggagtgcagaggtgagatctcggctcacagcaacctccgcctcccaggctcaagcgattctcctgcctcagtctcccgagtagctgggactacaggcgcctgccaccacacccagctaaattttgtatttttagtagagatggggtttcaccacgttggccagactggtctcgaattcctgacctcaatggatccgcccacctcagcctcctaaagcactgggattacaggcgtgagccactgcacccagcttctagtatgagtatttcagatgcaaagctgcaactttccctctaatttagtttcttcctccagttttaatattaggtatttctattacctttcagtcccaaatatttactaatatctagagtgattcttaatttctaaacatgtgttttccctcctagtcatattttcattatcaatttctaatttaatcatactgtggttggagaccatggtaaatataatatttatcttttaaaatctgttgaaacttgctttatggtccagtagttgtcaattttcataactgttccctgtctgcttgaaaataatgcatattctgcagctgttgggtaatgtactcttgctcattgtgttgtttaaatcttatgtatccttactaatttttctgtttgcattatacaacagttacgaatttctgtttacatcttccattaagataatacatttccccttgtaatttgtgacttttacttttaaaaatttgaagctttgctatttggaatttacatatatcaaattattttgtccatatggtaagttgtatctttccttgggtagtgaccctttttaactgtagtaatgctttttgcttaaagtttatttttctggtatcagaataaacatatcatgcttttttatcaccagtatttggctggcatatattttcctaacctttttcctttcaaattttctgaatctttaatttctaaatgtgtcattgtaaatagcacagagctagagttttattttttaaatcaatttggtcaatatttgttattgaatcattgcatctaatccatttgtttaaattactgatttttttttttttttttttgagacggagtctcactctgttgcccaggctggagtgcagtggcacaatcttggctcactgcaacctccacctcccaggttcaagcgattctcctgcctcagcctcctgagtagctaggactacaggcatacgccaccacgcccggctaatttttgtatttttagtagagatggggtttcaccatgttggccaggcttgtctcgaactcctggcctcaagtgatctgcccacctcggtctcccaaactgctgggattacaggcgtgagccaccacgcccggcctttaaattactgatttaatttatgctaccatatttttccatatactctgtttcattttctcttcttcaattcttttggattaactaataatattcatattctatttttagcttggtttgtaagatgttctccacatttagtttgtaggttaaataccttttagtatagtttagtgggtaccctacaaattgcaaatatttacttaatttatcaaagcccaaagttaaaatttttatccttctccaaaataattacaggaacttagaagattttaattccacattctcatcttattttatgctattgttttgtggattccaattgtatttattttgattacttaacaatatattattactggtgcatgcaatcaacattgtttaaattttccccatatttactttcactgcatttaatctttctcgcacctcacattccttctgaacaaagtatgtcttttaaaatttcttttgtgaggatttactggtggcatactttcccagcttttgtctgaaaatgtcttgactcattaaattttttttttgcaagatacacaatcctaagctgatagttattttttcccaactcagtgatgcttcagcttctctgtttgcaggctcccactgatgctgttgtgaagtcaggtgtaagttggttgagttgttgaagatattaaagggtattttaatttttatgtgcactttagctataatgtgtgtagtgtggacttttttttttttcatttatccttggtattcactgggtttcttgactctgtggattaatgtctttcaagtctggaaaattctcagccatcaatcatcttcagtactgtctcgcttccctttccctttctgaaattctagttagatgcatgttagacttccccactttatctccatgtctcttaactaatttcctgttttccatttctgtctctctaggctgcattctagataatttcttaaattcaactttccaattcattaattctttctcagctatgtctaatgtgctgttacatctgcccatggaaattctaattcctattatattattttattcctagaattctgtttaacactcctccaagttttcttgctctttaccacatttccaatcctctcttttatttccagaaattaaagcaagggctctaatttcacattctaggcttgataaccccagtttctgaattaggagtctgattctccgctgtcctgtttgttcttgctcttgctcgtggtctcgtttccttttttgtaaggggttcttttctgattgtaagttgctcatttcccttagtgctctatttctgttattattcattcctctccattttctttttctgccaccttgactggctgtgtatcttcaatccctttcatattttccatctgtgttttgctttatactcagaaaaaaaaagttttcaactttatattcaacgtttcagacttcagctattatcatcccttctattgtttgtcaatcatatttttaattctcaagtgttcatttgttctgtaattacctctttttcataccaatctgttctctttttatttaacacaaataatttcaaatctttctaaggactgcaattatacttgaaacttttttcttctttaccttgaattagatttcctagatttcctttgggactagtctttctttttggcgtcactggttatatattcatatttttaaataaaaaattggttaacaaaggtagttggcgtggctttcctgtatcagtattccgatcaatttttctaacacacctatcctttgtagggaagagctgatttatggctctttgtaagtgggcagggtatgctgatgtgaaggattcatttagggctcaagagaagagaagcctccaggcaagctgtaagcccaagcccttcctccacccactcctctaagaaaaatataaagcactgtactttaggtgtatagaatttttgtttatttcccttgagaaatagttgactcttctgccattactccatgtcatctatttttaaggtctggtactatcttagaatgtattctgtttctctctttggtattagttctcagtgaggagtgaactgttcaattttttttttttttagcaaatattatggtactttttgtttttgggggtttttgagaaaaaatcatcctgaaagctctgtgtgggaatccgtgaggatgggggtggaggggtaatggttgaaggatggccaggtgttcccatcactgcaagcaattcgcacttgttctctcttggggtccagtggaaatgtggtctttcctggggctcctgggggctgttcccaccaccactaaaacttgttcctgtctgattcttcctttgctgtgtcacgaccttccctgttcaggggtatttttcagtagggttttattactttcggctttccagaacacaactaaatttctggtttgctgatggcacttattctgatggtgctattttggatttatttccatttctacagcttcatggctattaggtggggattctgaaggaaggggaaggattgcttaaatgcagtcactcaactgaacaggacgttctcataatttttaaaaatgtagacataaatcatccatgttaatattcaagtatctcaatgcttaataagcttccattttataatatcaagttcaattgatcagtaattcagcaaacgatctaccttttaaaagatttgtattgaaagtcattttctgtttatacaatctttcctttagtatctataatacagtctttctcacttcaaagagaatagaagcactggcctaaaataatgagttagtaatcaatccacacagatattttgtttttggtttctctgaagctcagtatttctctatttcttttttttaatttttattttattattattatactttaagttttagggtacatgtgcacaatgtgcaggttagttacatatgtatacatgtgccatgctggtgtgctgcacccattaactcatcatttaacattaggtatatctcctaaagctatccctcccccctccccccaccccacaacagtccccagagtgtaatgttccccttcctgtgtccatgtgttctcattgttcaattcccatctatgagtgagaatatgcggtgtttggttttttgttcttgcgatagtttactgagaatgatgagttccaatttcatctatgtccctacaaaggacgtgaactcatcattttttatggctgcatagtattccatggtgtatatgtgccacattttcttaatccagtctgtcattgttggacatttgggttggttccaagtctttgctattgtgaatagtgccgcaataaacatacgtgtgcatgtgtctttatagcagcatgatttatagtcctttgggtatatacccagtaatgggatggctgcgtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgctcactttttgatggggttgtttgttttttttcttgtaaatttgtttgagttcattgtaggttctggatattagccctttgtcagatgagtaggttgtgaaaattttctcccattttgtaggttgcctgttcactctgatggtagtttcttttgctgtgcagaagctctttagtttaattagatgccatttgtcaattttggcttttgttgccattttgacatgaagtccttgccaatgcctatgtcctgaatagtaatgcctaggttttcttctagggtttttatggttttaggtctaacgtttaagtctttaatccatcttgaattaatttttgtataaggtgtaaggaaggcatccagtttcagctttctacatatggttagccagttttcccagcaccatttattaaatagggaatcctttccccattgcttgtttttctcaggtttgtcaaagatcagatagttgtagacatgcggcgttatttctggaagcattccctttgaaaactggcacaagacagggatgccctctctcatcactcctattcaacatagtgttggaagttctggccagggcaattaggcaggagaaggaaacaaagggtattcaattaggaaaagaggaagtcaaattgtctctgtttgcagatgacatgattgtatatctagaaaaccccattgtctcagcccaaaatctccttaagctgagaggcaacttcagcaaagtctcaggatacaaaatcaacgtacaaaaatcacaagcattcttatacaccaacaacagacaaacagagagccaaatcatgagtgaactcccattcacaattgcttgaaagagaataaaatacctaggaatccaacttacaagggacgtgaaggacctcttcaaggagaactacaagccactgctcaatgaaataaaagaagatacaaacaaacggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctgtaggcatcacactacctgacttcaaactatactacaaggctacagtaaccaaaacagcatggtactggtaccaaaacagagtatttctccatttcttacatgtttactggaatcatgattcctaaccatatacaaaaacagcaagggaaatgctggtggggtcagttctcctaaagtttcaaatgtgctgtaaattgcagagaattctcagacttaataggaatattatttttgtatacatgtgctggggttttggagaaagatttatttaaaaatgaaaaaaggccaggtgtggtggctcacacctataatctcagcacttttggaggccaaggcaagaggaccgcttgaggccaggagttcaagaccagcctgtgcaacatagtgaaatgctgtctataagaaaaattttaaaaagtggtatgtgcctgtagtcctggctacttgggaagctaatgtgggaggattgcttgagcccaggaattcaaggttatagtgagctataattgtgtcactgtactctagcctgggcaacagagcaagaccttgtctcaagaaaatgaaattaaaaaaaaaatccccttactcctagaaaagaaaaagccaatcaaaaacctttcttggacaatgaaatgccagagggttttataccacacagggatagtgccacatcatgtcttgtagaagaagcatccgtttttatagaatctaaattgcagtgaatattatagcatgccataaaaatatgccgggtgcacacagaaatcacagcagacagtccttggacaataattcaatctcacggtgaagtgatagcagcagctttctgggaatcaacagagtgggatgaaaagctcgtgtctttggggcagagagccctgaattcaaattctagctgtcatttttttagccaggtgattaaaaaatgactcgttattagcctcagaaactcatcttcttcatgtgaacactgagatcatgcagctcatgcagctattgtaaagattaagtgaaatactgtaagtcaggacgctagcgcagaatagacactcaacaagaatttcctttgctcttctgtctgtcaaaaatgccaagctggcagaaggtgcatttattcatctgtgggattccccctttaccctgaacatttaaattcaatggtgagacacagggaggaaagcaagggtaactcttcaagacactctagtctgtggtgtgcgatgctgacgtctgtataccacgacgtggacttaaccaagtgtttcttctgatctcttttcttaggactaaattcatcattttcttcagatttcatgtcttttgtcattttgcctcatcgctggtgcctgtacccacagcaaatcccaacagagggtgggataattaagtgatattgcctccgcaccactgtgccatcaccccctccaccggcctttctctagctgcgcatgaaaattctgctgcttcccagtgcatttgccaggacatcttttctctccggcccatttgcctcacagatgcccagtggttgagcctcagttccacagacagatctacagctcagaggatgttcagtcttcaaatgcagctttgtaattggcaaggggtgctcttagcttgctggctggtcgtgaaactaacaaagcccagtctttgtgagtgtgcttttaggacacgagcagggtagcttatgaatttttaatgctcaagccaacgttaataccaattagtagtgccaaagaagagaattaaaacactacttcatggaatgatagcatcctctctttgacaaaaaagcccatgtgttttaatagccaccaattcaataaggaaactgcttcttagatagttgagtctgtctatttctggaagagggcacagtacatatacccagccggttgtgacttttcttcatggattctaaggtcaattatcttaaggtctactgattgattttctttgcccactcattttcctttaatttagacaaccaattatgtgccttttaagtttttttctccctccacatatactaggaacagccataataaagcatgaagttcctttctcttgggatggctttgaaattcaccattttctgttttggccttcctttccttgaatatgcacacttaaggtcatcataaatcttattcatttgggcagcacttgaacaaatggcccctttccccagttttttagtgaatttctttgaaacctactgtccaatgtgtgctcatcctccctccccttctgccctctgcccccaccccctgctccccagatgaaactccagagcgaagtctttcttacttggattattgtgtccagaggatacaagctgagagtcctgaaagaacaagaaatatcaattaattttcttattttgactttcaaaatccaagttaaacatgagatcatgtttaaaactggtcattcagaaccgattcattgctctcaatctctatcagctactttaatgagaaacatatacatgaaggtggacacatacatgttaagcagttctgggaatatacttcacaatcatttttcttttgtattaatgactttctgttttgtttattgaggtgaagttcacataacattaaaattaaccattttaaagtgaacaattcagtggcatttggtactttcataaggttgtgcaaccactacctctatctagttacaaaatatttccatcactctgaagtcaaatcccttacccattaagcagggtctcccatacccctgccctcccaatgccccagcccctcacaaccaccaatttccatctgtctcttggatttatctattctggatatttcatataaatggaatcatacaatatgtgacctttgtgactggctttttacttaacataatgtttttgaggttcatccactctgtagcatgtatcggttcttcattctttttatggctgaataatattgcgtcacatggatatacaacaatgtgtttatccattcatctgttaatgggtatttgggctgtttctaccttttggatattgtaaataatactgccacgaatatgcaggtatgtacactagttcgagtccatgttttcaatccttttgtgtatatacttaggagcagaatttctgggttatataactctatgttaaactttttaaggaactgccaaacgattttccacagcagtgaaaccattttgcaatccaacaatgtttgagggttccaatttatctacacccttgtcaatgcttgttattttccattaaaaaatgatagctatccttgtgtgtatgaagtggtatctcactgcagttttgatttgtatttccctaataactaatgatgttgagcatcttttcatgtgtttgttggccatttgtacatctttggagaaatatctattcaagtcctttgccattttttaattggtttgtctttttgttgttgagttgaatgagttcttgatatagtttggatactagactgttaccacatttatgatttgcagtatttcctcccatcctgtcaattgtcttttcattttatcagtaatgttctttgatgcacaaaagttctaaattttctaaatttaaagttctaaaaatttttaataaagtttagtttacctaatttttcttttgttgctcatgcttttggtgtcatcgctaagaatccattgccaaatccaaggtcatgaagatttaaacctatgttttcctccctgatacttatggtttgggttcttatactcatgccactgacctattatcatattgacttttaatctaacttttctttgaatgaacctttactgccacccatttcctgtagatgggtttggcaatcatcccaccagtaacactctattaaacaactgttgtcaatctcacgatggtggataaaaagattagtatggtatctacttatctgcaatggaataaagccagtactacacagtattttaagtttagttattgctcaggtaaatagagattgaatttgattttacttgcattaaaacaaaatgttaaaatctgttttgaggatttacatcctctttctttgcaaaattctcatttaatagaaagtaaaccacataccatatgttcttataagtgggagttaagctatgggtatgcaaaggcacatagagtgatatgatgaactatggagactcagaagtgggaggataggagtgggacatgagataaaaaaactacatactgggtacaatgtacactactcaggtgatgggtacactaaactctcagacttcaccactatataatttatccatgtaaccaaaaaccacttgtaccccaaaagctattaaaataaaaaaaatttaaatatgaaagacttacacaagaatgcgtgaataggaatgtaaaaaaaaaaaaaggtagcaggacataaaatccagcaaaactcctttaaaattttggcacatggaacaaaaatccattgaaattgaatgaacttctattacgtggcttaatgtattttaccagaattttgttccacgagtatagctgttatggggtaaagggtgtcatttgatgtgacttgtgttatattcaaatccaagtactaatgtctgctttaaaaagaaattctactgaaacagtataaaatgagccagtcggtgggcagaggttgggtaggaaaattgagacgggaagggattcccactctattaaacagcctgagtcatatgcagatgcctaataaacctctttcaattatggtaataatgagctattcaactgaagaaaaagaacaagctcaactctcaccctgagattcagtttttggaaatgattatatgaagatgaaatatcgttcctgaaatggactaaaatatcatctgtaagaatgattttggcctattttggatagatgctgtcactaagaagacatccacaattaaatcccccatgtagattggtacgttttccttctcttcaagggaattcaagagtttatatctggacataagttagttttaactttggcacgtgaaaatactttgagtcccatttagttaactctgctgtctgtagatctgggccatttggtggcatctgtactagggaggggaaatacacaccatcaaatggacaagaatggtaattgacatagtttccagcattaagcttatttaaaaaaaaaaaaagaaaggaaaaaaagaacagaattttttctaagactgttaacacaaaatataattattttatttacttatttatttatttagagatggagttttgctcttgttgcctagtctggagtgcaacggcacgatctcagctcactgcagcctccgcctcccaggttcaagcaattcttttgcctcagcatcccgagtagctgggattacaggcacctgccaccaggccctgctaactttttgtatttttagtagagatggggtttcaccatgttggccaggctggtctcaaactcctggcctcaagtgatccacctgcctcggcctcccaaagtgctgggattacaggcttgagccactgcgcccggcctatcttatttattttttagagacagggccacattctgttacccagtctggagtgcagtggcacgatcatggctcactgcagcctcaaactcctaggctcaagcgatcctcctgccttcgtagctggtactacaggcacgcgccgccatgcctagctgaaattgttaatttcttggtatgtcctaaaacccacaggatgattgttgatcacaagcagagaaccagagatgagcttacagatgacctgaattaggattacaaaccataagatcatgtatcccatagatagtaaactttaaattttaactaaaacacctgtgtgattaataaccattattatttctgttttgtgtgatagggagtgaagagagacttcaaaatggttgaaataattggtataaaaaaaatctctgtggaagtcttctgtaggagaggcaagaataaaatcaaagactttgtccctaatatatactctcatgttgctagctgatgttttcttggtggtacattgaaacaacaactgctagtgccaaagtaattggctataaacccagtgttctaaactgtgccactctgcgggtacaaataatgtcccattatcattcttaccggcatttggccagcctgcttgtggaggggtcagctaccttaccaggccactcccacattttaggtcctcttatcagacaccctgataaggtgtctgctggcaaacctcgggtcctggggctgcagcttttgaaggaggactgttcttcccagccagctgcaaaaccccaggggccccacaggctatgcagctctcttattcttcacagagccagagcaaggctgggtccagaacagagggagaccaaagttcctttctccaaagggaccacacactgaagtcctttccacttttgtgtctcctgccaccccatccagatacctacatatgtgtagcttctgtctcaccagccttctctccccttgcaaatgtcttctgtaggtaggtgcctggggaggtccagccccatctgtgcattggtattgtccccctctgggagcactctactaggcctgcaagattctctactaggctttttaagggttacagaagtgagtccagcaagttagcggtggaggtgacatgtgtacaaatcattagagcccaaggctgaaagtgatgtggtgactgccactcccaatacttccagctgtgtatcctgttctgatcccctccccctggaatgctcatcctgctgctttctgtttcctgcctggcaaatttcattcttccttcgaggctctgcacaggtaaactcaagggttaccctgtgctttgaaaccttcttgactctaatgtttttgctacactgtgtcatacttccattacagtaattattttttcaacaatgactttaaaaaaaagtataagtgacaataacacaaaccgtacatatttaaagttaacaatttgataacaagtctcacatgaggaaggctaccattattactttcttgacccaaggatggctctgtaacacctattcattgacgaaaaatcagcaaaagtgttagctgccagcccctggaaaccacgattctcctcactgcttctgtgtgtcgattttagattctacatataggtaatgacatctagtacttggctttctgtgtctggcttagttcacgcagtacaatgtctatgctgtgtgtgtgtgtacacatatgtgtgtgtatgaataatatatgatgtatcagaaatgtgactatagttaacaatgagggtagatctttagaaatttattaggaggtaatgttctcatcaccaaaaagagaaaagaaaatggtaactatgtgatatataacttggtaactattgatatattaattagcttgattgtggtgattatttcacaatatcaaaacatcaagttgtttaccttaaatacatacaatttttgtcaattacacctcaatagagctaaaaaatgaaatttttgtactaatgatttaaagtcttaattttacctcagaagtcaagtcattacttgcacttaagcatctacatgaaacaaaacagaacaaactggtacaatatttttggaaaagtcgtaataaactgtgctttggtatgtgcccagttatatcaaaagttgtacttataccatgatacctacacataacaaaaatgtctatgattctattttgggtctggattatcttggctagattacgtgcaaagattctaagcattgtgcattttattctaaggatggcagggtgccactggaagtacacactgaataaactgttcagttaaattcccctgtactcaatggaagggctagaagcctgggaacttcacatgggttctgatgtcaattccaccaatgagatgccacatttcattcactgaggtgttgcctacaaagccttaactatttactatatgatccttcactgaaaaagcttcttgacctctgattcgaacaatgaattcttgggaaagaattagataaacatgtcgaaaaacagaatagacagtccggagacaaatccatgtatttatgagaagctcaactattgacatagggtatttcaaaccagtgatggggtgaatgggctattacactgatagtattataataacttactgaccattgaaaagaagaaaacaagaatcctacatcgtaacatccacaactaaaacaaagtataagagaattagaataaaatagaggacacttagaatattggagcaggaaagatcttttttctctgacataaaaattaaacactttgctagtgtaaaagcacataaaaaaggtttgcaagaaagtagttgtatcatatataatagataaatgaataagagttaaggagttcctacaaattagtttttaaaaagtggtaatgggtaatgaacaggcaatttgcaaaggaaaaacagtcaatgctcaagcttagaagtaactgggaaaatgcaaatgaaaacaacaagatatcaacttttcattcatcatacagacacactgataaaaaacccagatgataataatcattggcaaagatatgtaaaaagtactttttttttttcttttcttttttttttttttgagacagcgtcgtgctctgtcacccaggcgagagtgcagtggcgtgatcatagctcactgtagcctcgacctcctgggcttaagtgatcctcctgctacctcagcgtcccaagtagctgggactacaggtgtgccaccatgcctggctaattttttcatatttttgttgagatggtgtctcactatgttgcccaagctggtcttgaactccagacctcaagcaatcctcctgccttggcctcccaaaatgctaggattacaggtttgggccaacacgcctggccaaaagtactcttgaaacacaatccaaagtaactgtggcttctgatgcccagaaccacaattcctactcaaggtatccttattagaggcattcaaagaggcatttgatctaacagtgtttgtaataataacaagccatacataatctcagtgtccactgaaaggaatctgattaaattatggtaaatttatacaaaatattttgctgctgttttgaagaatgaagaaaatctctatatattcacttgaaaaggtcttcaaatacgttttattgtaagaaaaatcaactcttagaatggaatttatctttgtgataacagcatgaacaattctttcaataattcaccttagaaagcggtgatattgacagttatttacttttttgttttgtttgtttttgaaacagtctccatctgtcacccaggctggagtgcagtggcacaatctcagcttactgcaagctccacctctcaggttcaagtgatcctcctgcctcagcctctcaagtagctgggattacatgcatgcaccaccatgcctggctaattttgtatttttagtagagattgggtttcagcatgttggccaggctggtcttcaactcttgacctcaactgagccacctgctttggcctcccaaagtgctgggattacaggaatgagtcatcatgcctgaccagaaagctgtgatattgatatttagtaacgatacatattgttgaaaaaaatcaacttttggaaaaaatgctcttactatacaacttaggaattggaaaaatatacatattttctatatataatgcacagggaaaatgaaatggcacataaactcctgatagtaatctctgggtagggaaataatctctggcttggagtgccagggatgttgagattttggtctcttcccatttgtataatttgatccttcataatgagtatgtagtatgtgtcagttattcaaatcaaagaaagcctattagactcatgtatatagtcatttattttgtggccaattttttggtgtgcttttccttagaaaatatagatatctttttttaagtcctagaaaatatcttaagctttaaaaaagatattcagggaaattaaataccacacgtcttcaatactaagacattgattttaagatacatcattaatttaataatagcttttcagaaaaatccaggacatacaattttatacatcacattgaatgtttaaaatgattataagatgcatttcaacttcatgaatgttttttagacaaaatgataattacagtagtatcacattttgcagagaagtgtaggtaagtaagattggaggcttgattctccccctttcataaatgaataagtatgcgcttgcaaattgtgaaggatcagattcacgtgcctctggcaggaatatttacagaagaaaagacaatcacgggtaaagcccactgcccactagaaatgcctgcatgagtgaaacatattcctcctgagggatgcaagatctcaccttatttggaaatggaaatttggttggttccactttgccaggtgcttgaatagcagaaagtggtggaagccaggtcatctcctgaaggacgggataaaaacaaacaatattgtgatacagacagtatttaaaatcagcggtatgtaaagcagctgtacaagtgggccttcataaggcagggaagggttaaaaaatgtacaaaggctgaaagaattttaaaaaaagatgtgaaatccacttttatgatttcatttcctaattttaccaattcttgactccttggctctccccatgctccctttataccttaaaaaagtttgcaaggctgtcctattttcacttcatttaaggtcctgagtaaagggacaatctagtagcaaaagttctatggaaaatgccacatgaaggggactcggacttgatcccacagaattcacagggtgtctccaaagaaatgcataaggtacttttaactttatgaatctttattagaggagttatttatacaattagaaataaagtatcagttctcaataaggcccacacatcactttggtcttcataaaatgtcattcacggagagtgaaaaaacaaatcacgcctatgaaatacagagacagaatgatgtcatttcttataacacagtattaagaacacaacatgagcttaacatggaataatttctcatccactttttgacacactttctctaagccttgggaaagggagagaggggttgttttattcacttccagtattcaccttcagtttcatctctggaagggagttccaatcaataaatgattacagaattacattgatttctgatgaccaggacgccaacttggagtttacgaattagatgtgaaccctattattattattattattattttttgagatggagtctcactctgttgctcaggttggagtgcagtggcgtgatctggctcactgcaacctctgcctcccaggttcaagtgattctcctgcctcagcctcctgtatagctgggattacaggtgcgtgccaccatgcctggctaatttttgtattttcagtagagatggggtttcaccatgttggccaggctggtctcaaactcctgacctcgggtgacccgcccaccttgggctcccaaagtgctgggattacaggcataagctactgcgcctggccgaaccctatttcttgatttgcctgcacttccaaacctaagcaagcacagaagcagtggtcgatccattttcagaaaagtgagaaattctctcgctcgaggtgaggacatttccttacctccctttggcgggtgggtgttgaaaagcgattctgtcaggcttttggaaggaaagagctcttgggaatggtcgggcaccttcttttcttgggtcattcacctcccccagcacctcagatagtgcagaacccacacaggaagccgtgggagggcgagtgtgttcaaagccatgtgggaaggatttactgaccccatatcatctctcccacaccacgacacgtgacacagacagtaggtgggttaggcacatacgcattctaggtgtcccttctccattctggtgttaccaaccaattgtatacaattttatacatcacaaagcaaagcaaaggtggatccagtgaccctttaaactgtccctctctcctcccatctctgccctgctggtgccttggtctccctttgaggaggctgataagcaggactgtcaagtttgcgtccacagtggcatctttgtccatggagtcaaggaactattcgtcattctcagagttgggccaccttgtctaggacctggtcagctcttacccagagtgttactacccgattaagaaagccatgaagacacaagtgggttttccataccttggctcccccatagggccatctctcctctacaaggtttctgattttatccttccattttcattactggagaggatatgtgattttgctataagtggcttcaaatcttctgtagagaaattattcatcaattacaaactattaaaccaattgtccttttcctcttttgttgactgtctgatgtgtccctgagtccatcccactgctaatcagccactcaatagcttcctttgcaatcactctttcgcttacacaatttacattgtctgatcctcaggggacaacattgcgaagtacaaactaattactcatgattaaacatcagacttacacataccaccccggtatgtctatgttaactttgcatacagactccctctgtgtatcagaatgcctcacatttgtgcaatttttctctgactgtagctaaaatccaaaaagataaactattatttcagcgtgtcctccagcaactcaagaataaataaaatgaaaagtccataaaaaatgagtaacagtactttcaaaagaacacttcctagaccaacagcttcttacaactgacactttcaggttcaaatctgtttaatacaccgtttatccaagagtggaatagcagacaaactttgagataccactaagctgtgattcttaagggtggaaactgtcctcctgatcttcgtaccttaatcagggtccatccctgagcacccactcatcccctgaacatttcctgaaaacttaccattggcaggcactgtaactgtgtcttatgtacacgaagtgctcagttcagcatctactgaatttgaaagttagggtatcggctctggctgtgtctattatcagtctttcttctctaattccagctatgcttgtaatcaatctttccatttctttctttcttccttccctccaactcacctattcattaatccaataaccacccaacctcaaaagcaatatccacagaaggcagatgacacattctcttagcttgctgtcctcatgcaaataccccttctcctttgaagctcttgccaggtggttttggaccctcactaaagatgagctgcatctttttctgtccactccactcctttaaatcagactaacggctccctccaaaattgcctcctgccctccctaccttcatgatattttcctatttttttttttttttgagctggagttttgctcttgttgcctaggctggagtgcaatggcgcgatctcagctcaccgcgacctctgccttccagttcaagcaattctcctgcctcagcctcccgagtagctgggattacaggcatgcgtcaccacacctggctaattctgtatttttagtagagatggggtttctccatgttggtcaggctggtctcgaacttccgacctcaggtgatccgcctgccttggcctgccaaagtgctgggattacaggagtgagtcaccgcgcccggcccctattggttttttaaaggcaactgggcaatcttatgggcacccccaagcatttcttttcaccttcttgacatgttcttcttctgagtccatctctgctcccctcaaatttttggcttcacaaccctgactttaactctgatctttggacttcgtcttgaagattcggaatcttggcttttcccagtctactctgagccagctcattccagggaatcgccaggccctatttctcatccggtaaaaatcggcatatcaaattgctcttgaaattcaacacccaacactagccaccttgcagacatcttagctggcttctcctacacaaggggagaatcaatggtaggtccatacaaatctggatcaagccctcatgtctccatttttggaccaagctctcattctggcttctctgattctatacttgggctccttaggaaaggtaactgtgcacaatggtgggatacagaagtaggacacggacttctctaaacttgggccctcctttccttctcctttgaggctcttgccaggtggttctggatcctcattaaagatgatctgcatctttctctgtccactccacccctttaaatcagcctaatggctccctccaaaatcgcctcctgccctccctaccttcatgtctttctattggtttttaaaggcaattgggcaatctggtggtggcttgggccatgtggcttgggcaatccttgaattcattcctagtctgttcctttttctgagttcctcaaacattctttccacattggtgatttttcttgagcctcactttgatccctgctttctcacaacaggtgaccctgcctcctatggcactgaataaacaaaggctcttaagtgtaaatgtttcccaaggacagacctgtgggtgttcatgcctgaccccgttgccttccttctggtctgactggaagaggcatgagttccaagctaatacctgcctgcaccctctgtctgttactctgtccttggggatccagttccatcagtatctcactggtattggtttaacatcaatctttccttctccactggctttttcccccaagactgacaaatgatctcaggcctcagcccttcctgacactgtattcctcctccagctgatcttcatttctctatttctcttgatagctaacactctcaaagaagtctttatacttgctgttttgacatcctcacctaccatttctatttttgacttaagattttttgttgcagattatacacataagagtccatataatattgtgcatgtgtgtgtgtaagcttaagattaatgaaacgaatacctgtgaactcatgacccaccttcacatttccaagaccttagcaaccactttcaatagaagcagccctgacataactccttctgttgtcaagggcattggatttccttgaatgctcatttccccctgactctcttcccccgtggctcccacgctgtcctcctggcccagctccactctcggagatctcatgctcattcttttttgctgaaacttcttttctctcactgttccttgggtgttttgtgttcagccttcctctcactacccttctttccctggctgatcttgctactgtggctttaaaaaccatgtggtatgctggtgatgcctaaaagcacatccaggtctaacgtgcccactctagatgtctactgagccactcaacctgggtgctcatgagcgattcaaactcaccatgtttaaagctaaacttacacgccacacaaacttttcttcttcttgtactttatatgctggttaatggcagcaacatctattaactcttcaagtcagcatacctggagttatgccagattccttctctttcactccctctctcataataataacaataattctcatttattaagcatttaaaatatattatgcacgattttaaacgctttatgtgatttgcttaattctcatacccaccctgaaaggtaggctttattattttcttactttatagatgaggaaactaagtcactaaaaggttaagtgatttgctgaagttcacccagcagctggacttaaccatatcctgggctacctctaagtggatccaagaccttgtatattctagccaactcctaactccagcctctcaagctgagatcccctgaatataccacgctttgcacatgctggtagcacctcccaacctcctattgtttgctgggttgtttactcatcagtcaagacccagctccatttcctcctttgctatgaagtcttctttggccaaaccaagccaccgttgactcaaccttcctttgtgccacatttcccacgtacaggtctcttttagaacacttgtcccctctattgtggttacttgtttatacatcagtgcctcccctctaacctgtgatgaacccctcaaggctgtgtattttttgtctggtggcccagcacctaatacagagcctggagcagaatgggtgctcacttcatttctgaacaaatactgaattgaacattcagcagtgaatctctgcagtgtgtctacctttctctcctttctgttacctgaactgccatcctaatcacaccttcattatctttaacctgaagtactcttatagcatcctgattggttctctgtcttctgttagcagtccaccctccacactgctgcaaactcaattttcgtaattcagaaaaacttcactgctctaaaaatcttcacatgcggtcgggcagagtggctcatgcctgtaatcccagcactatgggaggccaaggcgggagggaggatcacctgaagttaggagttgggagaccagcttggccaacatagtgaaaccctgtttctactaaaaatacgaaattagccaggcgtgatggcgcgcgcctgtaatcacagctactcgggcagctgaggcacaagaatcgcttgaacctgggaggcagaggttgcagtgagccgaaatcatgccactgcactccaggctgggtgacagagcgagactccatctcaaaaaaaaaaaaaaaaaagcttcatatgcatcatcacatcacaatgatgatgatgatggcaatggtgacgctgaagatgatgatggctcctattaagttttagttttcaaaatacttccccatgcattttgtcacttatgcccaatctttaacgcaacaattgccatctccatagtacagcaaggaagttaaagctcaaaaagattaactgattagtccaaggtcactcagtttctaggtttggccagataactctttactcccagtccagtatttgttttccaatctattgaatttaccctcagaatcctcaccctagtactcaagaccttctacaataaggtcccagtcttcagcttcatgcctttttattgctctacaaatactctacctacaagaaaaactagcctctgcttttacttacaccatccccttagtgtgtgaatacccttcctcatatgtctctgagtctctttttatccattaaggctcatctcaaacatcatttgtgtcttgaggcttttgcagatttcccttctatgccaatataataggatagttctctgctcatgctcctccaaagcacttatttctttttctcttacattctgttttgtgttatagttttatgaatatgtacttcaatctacacccaaccatttatctctctttgaatgctctttctccaatgtgaaataaaagcaatacttaggaatcctaataatctcttttaagagcattcagttttactaggcataatccccaaataggaattctaataatccctttcaagagcatttggatttactaaacataatcgcctaaagaagtaatataaatttcctctgagagggatatttacttatctttgtggagactggaacatcttacatagtaagtgctctatataaacttgttgaattgaactgaacatccacatttcaatgcaaacttgcttgctaattttgctttaattatagctaagtatttccgtgtgatttttccatctaacaaattctactaactacatgaaggaatagtaaagaaaatatggttacttaaagcattcaggtctgtaagaatttccaaaacctaagaattatttctatgattttaatacatttataatgtaatgcaaatacaaaatatgtaatatacatacaaaatgtaatttatgaggtacaatgcttttataagattgattatccattacattaaaatttcacactagaattgcatgggaaaatcaagggcgaatggactatcctgatttcctcttctatcacttgctagcctcctgagcttaggtaagtcacatgctcagtaaactaccgtgatttcaagctgtggactttacgatcaatcagatctcagtttgtggtaccttacaaccagaggaaatggggatataactatcccatggtttagtcataaagattaaatgagatcatacatacatacatatataaagaaactagtatagttcccctcccatttaagcattcaataaaagacagtactgattaatatcaagctgagtttctgaattgtctctaaaatgagaaatataacttcactctgagctttagttgttgggagtctgagatgagagaatatatggggaagagttttttaaataaaagaataagtatcatgcaaatgtagcctgtaattaagctaggattattaatgcaaactatgtattactaaaacagaaagatatttaaagagattattattattcctaagtatgatctgtactttttattggagaaaatgtccctaagttttttcatagaaacagatttctgacaaaataatagtcagtgggataatacgatttgataaaaatgtatttcatttgcacctcatttctggtaatgatttaaaatataagcaaaggtaaaatttatcattcctgctaaaattgcacttagcttgctccacattattttatcactgagaaacaatgctatttcattacaaggacactgatcccacgtcactgtagccatggtcctcacccctgcctgtgttccccacttcacccccaaccaccctttcattgctgctttgcctctattgacctactttggccatcctttaaccacttcccagaccatatgtaagacaggaagagaaatgtaatgtttaaagccacttactccaaagtctagctggcgaccttcggatcttataaactcccctgccctttctttgctttgtctgccttctctcctttttcattttcttgtcactcaggaataagcctgtaccctattcccctactcttgagaggtcctcagttttgcccttggggtttcttagtcacctgcccttttttttcctttttttttttgagataaagtctcactaagttgcccgggctggcctcaaactccggggctcatatgatcctcctgctttggcctcccgagtagctggaacacaggtgcaggctgccatgtcccactccttagccttttagatactccaggtgatggaactgagaatccacgtatctgcctcaacacagcatcgccagtcccttctccctacacagatgtctagttactcaagggatacgttcaggtgacttcttttttttttttttgtataggcttataatgccaagactctttatattaaatatactcacttttctcctaaaatgaaagaatagatggttaaatgataaggacacagaatattgctcttcataactggctaacgttttctctatcctccatatcccaattttcaggaggtcatgggcacatgggccagtttccattttcacgtctactctacagcaagactgacgccagtctccaagaacccacacactgatggtgcatagactttcatgtgctccatctgcacaatgccctccatgtagctgaccactcttctgatgccagctgcctctgcctgttttaggacaagtgacaggaggccttgggcatccccacctcacgtagcagctctttgttaccaaaggagagaagaaacaaaaatagaattttagcctcaagttaaatcttcgagttcagagtgtgcagctatgaagacctgcaaagtctgtttagcttacaataggttcaactagaaaaaatttaagccatgttttcatttccctattaaaacaagtgaggagaaaaacacttttcctggtctctctcccttgtctgtcactgccacaggagagttccatctcgaacacttactatgtcacctttgttccaaagtttccagtgaccccggtccaattgttcaagatgctctgtcacatggcaccatcaaggaccactgtggcattaccgcctgctgcttttctatacactgtcttccccaagcctgatgtcttacttcttgtcctgccccaggctttcctgcccccatcttgtttctcttttcctttcacgttattccatctcacttacctctgcattctttctcatcctggcctgtctgtgaaggtgacctgtgctaccctgagcgagccctctctaccctccacttatatataatcaatgccactttttttttttttttttcagatggagtctcgctctgtcacccaggctagaatgcaatggcgtgatctcagctcactgcaacctctgcctcccctgttcaagcgattctcccgcctcagcctcctgagtcctgggactacaggcacatgctaccatgcccagctaatttttgtattttttagtagagacggggtttcaccatgttggccaggctggtctcaaactcctgacctcaggcgatccacctgccttggcctcccaaagtgctgggattacaggtatcagccaccgtgcccggccaatgccacttatttagcaactacatgctactcagtgctgtgagctttcttgtcatgtgttaccactatcagaatatttttaaaatccctactagattacaaactcttcgagggaagggatcatgtctaataatgctcttgtaactcctcaaaggcctagcacaatggtcagaataataggaattaattgaacttctctgtaagtctcttttcttgcctgtgaaataatggtagcaagaaattacactggtttcaccaagcgtatgtgactgttgccaggattgaaggatctgcctggcagatgaccgcagttaactccagaattctttgtgctcagaaacttactgttttctaaacaagacacgggatgaattctgcgacttgggaataaaaatgcaagatgctcacgttgatgtttatgtgtggcagtggctgctgatcacagtgtgatttcattttcagtttctgtatcagaataatcattcagcttttcagttcttctcacacgtattattcgtgttatgacactcttatcagataagtgctgccaacaacagacatggtgatttttacaacactgcatctcatctaaatgctggcagctaatgccactgtacctggtgaagaggaaaacacccctacgggcctgtacctgggacaccaggcagtagccctggagtaagatcaagtgggagacacatattcctcccctaatgggactgcagtgtgcattctgcctgtcaatccattcctagcatttgtgggcaaagacccaacatccccctttaaacacagattccagggtcaggctggaaggctcagaactaggaagtcacacttaaaacctttaagttggcctctaaatcaacaaaaattcacaaacaaccttattttaccactctacagtaaaaaacaaacaaacctgtatagtttgaaaaataataaatataatgcattcatatcgattaatattaacaggccaggaacagtagctcacgcctgtaatcccagcactttgggatgctgaggtgggaggatctcttgagcctaggaattctaggtttccgtgaactatgattgcaccactgcactccagccggggtgacagagggagaccctgtctttaatcacaacaacaacaacaataattagcattttgatggaaatactactgattgaaaacttttaggaaaatggtagctgctgaaaaaagtgcctttaaaaaatatctatttctcatagtatagcataggctgctaaaatgccagaaaccaaaattgcaactgattcaaacacagatacaaaccagcaaataaccaaaaagactgcaaaaaagagggttaacaaaaatcgtagcaaaatcttgtttcttcaatctgaaaacccaggaatatgtccagtttgaactgaaacaggcctgagaaggggattcctgggagctgtacacgtgttttctggtcttataccgacccactggatgacaggatctcagaatgggacgctgattaatctacttcattgcagtgcctgagcttctgaactctgcccctgcctgcgatgaggttaatcatcaaaggataaaatgggggtaacaatcaatagaatcagtttgagaggcagctttcagttcaggttttgcagactgacaagtacgaaagtagccattcaaactggaaacactgagggtaactcagacctgtgcatcccacttgctccttggtctgtagattctcacttatctaaaagcagaggccacagggcatctggcctttcattacttcctttgcatcatcaaaagcactccttattgcagggaagtcaattccatgccactggagaccctacctttcacctccttgacttcagcttccctggaaactgaactctccacagagaggattagaacattgagaaaagtcaagatacagtcttcaccttaaaagtttgtttcatgctagatcccttaattttggacctttctggagaattcttgttctcgttttgcatttttccagctttcttttggggcagaggatgagagtcacctgtcttattatctctctgtgtcaagtacattcctgttctatttatttacttgaaacttttttgaacaataaaaatgaaacattaaaaaaatttattcttcgatccacctggttttcaatgttcattttattacttgtgtttaaaaaataatatgattctcattctttaacttgcagattgttcttagaactgagcattgcattaaaatattcaaagtagtaacatttagattgggtcttcagaattttaggaagatggttttgctgctgagtatacagctgcatggactgagtgactcttgttaaacccaggtgactccaacttcaccacggagtccctgctgcaatatacagacacctgctagtttctggcactccttcaaatctcgtgctcatgatgagaagcaataattggcctgattttaaattttaaaaatgctttttttgacaagcaaaaaaaaaattaaaacatttgaggggcactgagagaatttcccaaattctgaatctggggctgacacatcactgcgtcatttctgagccaaatcttgtcaaatcgtgttaactcgaggtttataaaaagtgagccaaatttctgatcagctcaggagaaaatgcacgttactaactatgccactgacactttatttctgactcacataatactttttagtggtagcacaaacacccagaagtgagccttcctaacagacaaatagatgatcgttgaactaactgtggcttgcaacaatcaaaccactctttcatatatacttaaaggaaaaaatggcattatttgggacagactggaagactgtggaggctggaaggagaagggggtgaaaattacattcttggccacgttttccacacaacccattcctgaacccctttccacagacaatttggaaatgtgcattcaataaaacccctgtcgcaattgcagagaagcagagggtagaagagatcgggcttggagtcagcatctgggaaaccttgtataattttggccttgccataaaccagcagaatgacctcgggcaagtttacttttccgattattagtgtccttatctgtaaattggtatcaatcattctatcttgcaggattacctgagtggttagtgataaatatacaaagaacctagcgtaatagctggcacatagtaggtgctcataaaaaataattattgctgtattgctacctttataactagtgttgacagcttctggattcgacctggtgaggaaaggggataaatatagaagacgtttatgaatttgttttttaatctattttactctttaattatttaatatttaactggttaattattcatagtcaaacagaaggcttaataaaaatgtgcttattaaacaataatttgcttccttaactcccttcaccactaaagcagcatgtccataaagggaaggaagaatgctatctcagggtctggaatttttcttcaaagggatagttactagaaatcagcatacatcctctttctagtttggggctctacagattagaagctttgccctcatgctatagactacccttgcaggcaccagcttgggtagtataggaggtgttaggcaagctgggagtgtagcgggaggctacctggctatgatgacagggcagtgattactgtccaggcaggtggctgagcaaggtgacaagcctgggcaagaataaaccctggaaactactggggccaggatcaaagttcccggtcaggtgggacttctggtttaccagagggaaggttaggacaatcctgccgaaggcacatgcctttctccctttcaaatgtttcccagctaaaccacttccaaatgagcaggcttctactaactttatgcaagtatttttctcagttttgagaggtgatttataaatcactgaatggcattgccctaggacagcagggatgtctctgggtcttaaggatgaatgtgaaggcaggatgactttataggaaacagaaaatgtctactaacatgctccagatattgacagtaaaatccagaggctggaggaaagctggttagccttggaaaaaccatcttttctttttcttttctttctcctttttcagaaataaggttaaactatccttaagaataagaaggaaaatattaaaacattcccccccaaaagttcatagatcttcaagaaaagagaagttaggaccaaaatataaacaggatgacaactgcttttatttgaagaaaatagagttttctagaagactgaatcagtatagcctgataaagtgcttatccattgggaaaagatattctatgggagcaaacaaataaagataaaagaggaagacattaaattaataatggctaaagaaggtgagagcctgaactcacttgctaaatgtgtctttaaagagggagccaacatgatctcacaagagtctctatgagaaggtgagaaggaaggttcttagtactcaagggcgaataggcaatctacaaatttcagaccaatgtttttatcccttgatgttcactgacaacacagacacagttccctgttttgaaaagaggtctaacaatcatgctgaacagtctgagacttaatagagccaatcagttcagtttctattagtgcacctgtacactcaggcatgcgttcaaccaaacacacatttagacactcagactactctaggtcttgggaaacaaagcagaatacaacagacatggcccctgctctcaggaggtgtaagcaccatgagaggagagaagcaataaacaatgaacaaatacatgtaaacgcaacagatctatattcgaacagttgctgcatggttctgatgggtctaattagcattttggcaaagaagaagcatgagaagggcatggattctgtgtcagacatttgaggggctggcttgtggaaatgacattatgtgtggtttaaagctacagggaagattttggttttaataaacttcctaacaatttctgtcactaaacattccacaggtgttttgtgctaagcactgttccaggtggctacattctggtaaaatgaggtagacagtaaacatgtatatgacactatgtaacatcacacgttgtaacccaaagcagcataatttggcataatgtaatataacatagtaaccattaaagctgtgcatcagtaaactggccatcaccatcagtgaaatggtgagctgcagctgggtgcggtggctcacgcctgtcatctcagcactttgggaggccgaggcgggcggatcacgaggtcaggagattgagaccacggtgaaaccccatctctactaaaaatacaaaaaattagctgggtgcggtggcaggcacctgtagtcccagctactcaggaggctgaggcaggagaatagcatgaacccgggaggcggagcttgcagtgagctgagattgcgccattgcactcctcgaggcatttgggatcacaagcagagtgggatgtctctgggaatccccagcctggagcagcttcctctgactttggtggagccacatgcagggctcagggcaacttctgctctctattcttaaccttccttaattgttgtgtctcaatattttcagtctcaattcctgactcaatgaagttcttaatttcatatgtgatccctggtgggtttgggacacatgatttcattttagtttttaattgaaaaagtatttattgaaaaagtatttccataatattttctgcttaaataacatatgcttctggttaaaaagttaaacattgcaaaaaaaatagcaaatgcaggagagtgaaaccccccaggatcctaacacctgcagataatgtcaatggtgaccagtgttaagcactgggtacttatctgatttttatatacatgcactaagatggggattatattaatatatgtatatttaatgaggtcatactgtttggtgatatactctttttcactgagcatctttcccaacacaacatacaaatgggtcttcttttttgcagttattattttggattggttcatcttaaaagtctttctacctaagaatagtttacacaccatagttacagtgttgcaatattctgtttttctgtgtacttactgttaccagtgagttttatgccttcagttgatttctggctcattaatgtctttttctttcagattaaatatctcccttcagcatttcttatacgacaggtctggtgttgaggaaattcctcagcttttgtttgtcttagaaagttttaatttcttcttcctgtttgaaggatattttcaccagatacactattctggggtaaaagttttttttcctttagcactttaaatatgtcacgccactctctcctggcctgcaaggtttccgctgaaaagtctgcggccagatgtactggagcaccatagtatgttacttgtttcttttctcttgttgcttttaggattttgtatctatccttgacctttgggagtttgattattaaatttcttgaggtagccttctttgggttaaatctccttggtggtctctaaccttcttgtccttggatattgatacctttctctaggttccgttattatacctttgaatacactttctccctatctatttctctctctgcctcctctttaaggccaacaattcttagacttgccctttagaggctattttctacatcttatacctgtgcctcactgttttttattctttttttcttttgtctttgccgatcatacattttcaaacagcctgtcttcaagctcactaattcattctcctgcttgatctgtttggctattaagagactctgatgcattcttcagtatgtcagctgcatttttcaactccagaatttctgcttgattctgtttaattatttcaatctctttgttaaatttatctgatagaattctgaattccttttctgtgttaccttgaatttctttgagtttcctcagaacagccattttgaattctctgtcacatacctctgtttctccagaattagtccctgacaccttatgccttatctagttcatttggtgaggctgttttcctggatgatgttgatgcttgcagatgtcaccggtgtttgggcactgaataattaggtccttattgtagtctttgcagtctgggcttgtttgtagctgtccttcttgggaaggctttccaggtatttgaaatgacttgggtgttgtgactgacactgtatctgcattagggggcaccccaagtccagtaacattgtagttcatgcagactcacagaagtactgccttggtggtctcggataagatcaggaagaattctctggaataccagacagaaactcttgttctcttcccttactttctcccaaacaaatggagtctctctttctccctgtgctgagcagcctggggctgggggtggggtgacataagcacccctgtggctaccacgactgggactgtgctgggtcacacctgaagccagcacaacactaagtcttacccaaggccactccctggctacagcctgtatttgctcaaggccctagggctctatgatcggcagacggtgaagccagctgggtttgtgtctttcccttcagggcagcgagttcccccagctgggtccagagatgctgtctaggagccagggactgaagataaaaaccttagaaatctacgtggccttctattccactctggctgagctggcactccaactgtaagccacagtccttcccatggtcccctctcctttccacaggcagaagagcctcatcccaaggccacgaccacgacaggcccacagggattactgccaggccactgccgatgttaacttaatgcccaaaggcccctcagtcaagtcgtggtgagtgctgcctggcctgggactcacccttcagggcagtagactcccctctggcccagggaaggcccagagatggtatccaacagccaaggcctggaatcagggacaccaagagcctgcttagtgctctaccctgctgtggccaagctggtacctaaggtgcaagaccaagtcccttttacttttccttctgcttttctaagcagaaggagtctctcactatagccaccacagttgggaatgtggtgggtctcacctgcagccagcagtctcagagtctcaccaaggcccatggcatatgacctgggtatcactgctggttattcagggaccaagggctctttaagtcagcaagagatggatcttgccaggacttggtccttcccttcaaggcagtgtctccttctggcccagggtgtctctctagaaatgttttctgagaggtacggcctgaaaatggggcctcacagctctgactggtaccctatccctctgtggctgagctgataaccaagatgcaagacaaagtcctctttactcttgcccctcctgtccttaagcagaaggaaggggtctcttttgaagctgggagctttgttgcctgggtttggaggaggggtagtgtaagcactccctattcacaatagcaaagacatgagatcaacccaaaggaccatcagtggtagactggataaagaaaatgtgtacatatataccacagaatactacgcaaccataaaaaggaacaagatcacgtcctttgcaggagcatggatggaactggaagctgttctcctcagcaaactaatgcaggaacagaaaaccaaacactgcatgttttcacttataagtgggagttgaacaatgagaacacatggacacatggatggtggggaaaaacacatactgaggcctgccatgggggatcatcaggaagaacagctaatggatactgggcttaatatctgggtgatgagttgatctgtgcagcaaaccaccgaggtacacgttacctatgtaataagcctgcatatcctgcatatgtatcccagaacttaaaaaatgaagaagaaaaaaaaaaaaaaaccagagcaattcacactcaacagcatgccagggaagatgtctcagccctggtgtcctgacaagagcagtttctgaataggaagaaggctggcacaaatggatacagcaacacattctagagatgcaaagttccaacaaaagcattttaaaggtcaccttgtttatataatatttatgttttaagaccttatgattcccccaatatttcaaagctctcagagacaaaagaataacatggtataaagaagtggaactcggaatgaggagacgtggactctggtttcagagccacaggaaactgtggaatctggaggtgaagacaaccccaggaagtgacgtatttctaaattttctgatgaggacacccggccccaagaagttctgtgagctgcccaaggcctctcagtcacttgtgatacagccagaatgcagggcaggggccactgtgtccttctatgttccttcagtctgcaaaacagcgataagaatagctaattggggttttctgagaagttactgtattggaaaccataaatatgtcatttaatgaagaacaatgagcttcggcaggatttcttaagtgtgaatgcaatcgacatgcggtattcctgccttcttggttctctcgtctcatactcaactctggtcccctttcccatcctccacctcagaaaacaagaagtgggacaaaataggaaaggagagaagaggaagaataaacaagaagtgggacaaaatagggaaggagagaagaggaagaaaagagtgacgatgagccccgggcgaggtggcaggggcctgagaggcagggaaggcaaatggggagctttgttctgaccaggccgtgtgcttggtctgtggggcctctggcttcccatgggtgagtcctgtgagaagaactgtgatagtctaagtgtctgccaaaagaagggagtgaattagatgcaacccattccaccctgcctcaggaacaatgtacacacaaatacatgtcaggattctctctgaactttacacagaaattgcctggctatgttcagctcttctcagggagagaaacagaaagtatttgctctggaaatcttgtatcaatatataaccaagatcttaatgttttcagacttgccccttcctttttctagcatttgttttttcttctgtatctcctcaggaagatatggtggcaattaaaagaaaaattattctgaacagcctgaagtgatatggctaagcctagcaccacttttatttcagagttaaacaaccatgacttaattctcaaattgcttcccaaccctgggaagttaaggtcctagtctccggctaattctagaaccatctatcattaaatgaagttgaacacaaagaaggggcgactgcagctaagggaaaggccgtcaatcctgacaccagattaatcttccccaaatgcctttcctgcctgagagggtttgtggctgcttgttagactagatccaagttctcagccttgtctcaggcctgcctggccattgagtgtctcacatgcttcccaccattcctcatgggagcctgggttcagaccggccaggttcccactcccgttcacaggaaggaggctctgcgactttcacctgcaggctctgctcacccgttgtcacttccccatccacatcctacccttctatcacatcttccttcaagaagactcacactgttcaggaaacacctgctcactgcctccttaagttcctttctctaaatgtctacagtgttaatagtttatagcactcagcccactgattgagaccacagctaagtttctgagggcagagaccccctctgtttagttcactgctccttccccagtgtcaagcttagccaggtgctcattaaagaattacaaaatgagcaaatggttacttgactcgtgaggtaggataagacaatgagactgattcttaaactacttgctgtaatataaactcatataattttttttgttgctacaaagctgtcatctaggcaggtgagtcttttattactaaaatgcttggagtgctcaaacgttttgggaattcttctttggaaactgtgctacgtcaattcctggggttggggttgaggtggtgggggtggaggttggtgtgatgggggtggggaatctcagagttaagactggatatgaattaacaaagagacaaaagtcactcagggccaagccttaactgaagtggctgattaagctagtgagagcagttctggatcaaaactgatcaaaagtcagtcctattcaacatagtattggaagttctggccagggcaatcaggcaagagaaagaattaaagggtattcaaataggaaaagaggaagtcaaattatctttgtttgcagatgacatgatcctatatctagaaaaccccatcgtctcagcccaaaagcttcttaagctgataagcaatttcagcaaagtctcagcatataaaatcaatgtgcagaaatcacaaggattcctatacaccaacaacaggcaagctgagaaccaaatcatgaaagaattcccattcccattcacaactgccacaaagagaataaaatacctaggaatatagctaacaggggaagtgaaggacctcttcaagaagaactacaaaccactgttcaaagaaatcagagatgacacaaacaaatggaaaaacattccatgctcatgcacaggaagaatcgatatcatgaaaatggccacactgcccaaagcaatttatagattcaatgctattcccattaaactaccattgacattcttcacagaattagaaaaaactattttaaaattcatatggaaccaaaaaagagcccaaatagccaaggcaatcctaatcctaagcaaaaagaataaagctggaggcatcacactgcccaactttaaactataatacaagactacagtaaccaaaacagcatggtactggtacaagaacagacatacagaccaatggaacagaatagagaacccagaaataagaccacacacccacaatcatctgatctttgacaaacctgacaaaaacaagcaacggagaaaggattccctatttaataaattgtgctgagagaactgactagcgatatgcagaaaactgaaactggaccccttccttacaccatatacaaaaaatcaactcaagatggattaaagacttaaatgcaaaacccaaaactaaaaaagctctagaaaaaaacctaagcaataccattcaggacataggcatgagcaaaaatttcatgacaaagatgccaaaagcaattgcaacaaaagcaaaaattgacaaacgggatctaattaaactaaaaagcttctgtacagcaaaagaaactaccaacagagtaaacagacaacctacagaatgggagaaaatttttgcaatctatgcctctgacaaaggtttaacatccagcatctataaagaacttaaacaaatttacaagaaaaaaaataaaccgctccatgaaaaagtaggcaaaggacatgaacagacacttctcaaaagacatacatgcagccaacaaacacatgaaaaaagctcaacatcattgatcattagagaaatgcaaatcaaaaccacaatgagatatcatctcacgtcagtcagaatggctattattaaaaaatcaaaaaacaacatgctggcaatgtcgtggagaagaaggaatgcttttatactgttggtgggagtgtaaattcaaccatcgtggaagacagtgtggcaattcctcaaagacctagaagcagaaacaccatttgacccagcaatcccattactgggtattacccaaaggaatagaaattgttctattgtagtgctattagcaatagaaaagacatgggatcaacctaaatgcccatcaatgatagactgaataaagaaaatgtggtacatatacaccatggaatactatgcagccatacaaaagaatgagatcatgtcctttgtagggacctggatggagctggaggcctttatccttagcaaactaacacaggaacagaaaaccaaatactgcatgttctcacttataagtgggagctaaatgatgagaacacatggacacatgtgtgggaaagacacacagtggggcctgtcagagggcaggaggaggtaggaggagggaaaaatcagggtgatgggctgataggtgcagcaaaccaccatggcacacatttaactatgtagcaaactcgcacatcctgcacatataccccagaacttaaaataaaagttggaaaaaaaaaaacccaagtcaggatgccattcctcatggctcatcctcgctctcaagaagaaagccattataggaattcctgaaagacgacaacatcattagaatgagtatttagattctcaagatgactatttcaaaggacagtagttccttgcatgcactaaaaataccccgaaacatgaatacttcttttttaaaatgaatctagcaactagcacacagaaggaaacaagtcaatacccactgacctagttgtggtagaacactagtttagttctgggcaaatataaactttaaaataaacccgatgctttaaaaataccaagcttctacagtagaacgataaaataatacaacagtaggagacatgtgaaaatgcatgactatctctcaggaggaaacaaagtgtggggaacttttaaaatacaactctcaaaggggtttcaaatggcatcgggggaaaaaaggaatgcacttgatgttcctggagttccttataattgtgtctctttggctcctaacaaagaaccagcagcagagtcaaaattattttgggcaaatttcaagaaattaaaacaaaggtttaaaaaatcacagaagagtaggggtcagtttgtttacctagcacagacagatggttgtatttctgtagttagaggagcaatgcagaaagacttccaaagttccagatgaggcacatttgccaagaaaatgcttcaggttggcagaaggtagaaaccctgtattggctaaatatttagcaacactgaagaatttttaacactaatatctcatttggagtggaatatgctttatggtctgaattctttccccactctgttttataagtgatgataaaaatcaaaacataatcacctgtcgaggatgaatcctgcacctgtgaaattatatttcaaacaagccaacttcctaattacaatggagagggaactggcatgaggaagcaagttatttccaccattccggcagtgggctccaggctcccagatgaagagctgttggtacaaccacaaaaaaactgctaaaatcatcttttattattcctgtctgcacaacaaatagctccatctggggctcaatggtagactccagccaaaatttgtaagggctcggctctgaggcatctgatagcagccctgcataaggcagaaaatcagaccaccatcagcaccaggatcactgtctacatgagttgatgaagagtttgtggggggcactgggccgagcatgtcaaggggcacagaaaattggaagcatggaccctgctttaaagaagcttacagggcagttggggagataggaatctacaaacacacatatgctaaagcacaacagtccctcagttatgtgtggcaaattccaaatgagggacaggcggtgatgcttggaattgagcaaagtcagagcccgctgtgagtggcagtagccagtgccacacaaagcaggcagggtgtgagcatcttctgagaacttcctacatgtaagtctccacgctgagttcctacccaggtcctctcatttacctgattccttcccaggagcatcctgggagagtgccactaggagaccacagttcttcctgcacagaggaaaccttccatttctccacaacgtttgcttgatcctacttgactccaggcccttcctgctgggctttaagccagttgataccacagtggctggcgcaactctgaagtgtgcatgttcagagtcctgagtccctagaccctgggcatctgcagactgaatgctgctgcatcccagggctcagatgctgagtcatggggagtggtctttgggcttttctcaaaggagtacaccgcactggatatttatgtccttagttgggttgggttaagcattcccatctgcgtgccctggtaagcttctccaatagatgttatgtacaaggctcttcattcataactctttcaaatatctcaggtaaggattgctagctcttcgcctccaacatctggcaggctttctacctggttcctttgctttctgcctctatgaaaatgctctgaagtgctggtcttggccaggcaagctacctgtaggccatgtcttcatgcacacagacaagttggctgccttctaccagctcccggtggtcccacagagcagatgcgccacaggctgtgtcctgtacaccctggccctgggagcgcaggctcagtttgcacagcattactgaagcagaccctggggtacttaaaaaaagcaaaagcaaaaaaaaaaaaaaaaaaaaaaaacaaaatgcaaaaattagttccagcactatcagttcaaatgggcaatgtgcatgtccatatggctgggctcctccaggtctgactgtgcaataaagacaggtttcagttggtttgttccaggcctgagagccagaaggcagagcagtctctgaagcactgaagccagagtgacccctgcacatcgcatcccttctggatcctgcctggagctctgtctgcccggaacacccttctcctcctccttcctctggtctcctcctccttctccttctcatctcttatctccttcaggtctgtggctttccccagcagtttacacagtacctggcactaggtgaagctcaaaaatatttgttcaaaacatgaagtaatgtacaattgatacaaggaagggatgacacaaggtgcctcagacaggcagaaacagaggggattaacagcacgcatagaaagcaatagatgtattcatgcataagcacaccagcaggatgccacccaactcccaccataactggctgggacaatgcttggtagcctgtctctccccactcccatctctagatgctctttcatgtgaatatcaatgtgatctatgtcatcggtctgccaatctatcttaacaatattaagtcttcctatccatgagcacagaacatttttctacttttttaagttttaatttctttcaacaatgttttatagtgttcagtgtacaagtattgcactttcttggttaactttattgctaagtgttttattctttggatgctattgtaaatgaaatttccttaatttcatttttttgattgctcattgctagtgtatagacacaaaactgatttttgtatattgatcttatattctgcaactttgccaaacttgtttattacctataattttgtgtgtgtgtgtgtgtgtgtgtgcgcgtgtgtgtgtgtgtgtgtgtgtgtgtgtgtgtgtggcggggttggctctttagggttttctatatggaagataatgttatctgtgaattagagatagttttacttcttcctaatttggatgccttttcttttcttgcctaattgctctggctagtacttctaggataatactgactggaagtagtgagcagacacccttgtctagctcccgatcttagggggaaagcatctgctcttttatcattaagcatgatgttagctgtgggttttccatgggtatctgttctagctggaggagggctgcctctgttcctggtttgttgggtgtttttatcatggatggttgttgggattttgtcaaatgctttttctgtatctattgagatggccatgtggctgttatcatttatttatagttagagtatgttatattaatttcaatatataaaatcaactttgaattcttggcataaatccctaagaaataaattcttaaaacaacagcaagatgataaatatgctcataatattacatagcagtgtggtgtttcacatttttcagggaattttcacaaacaaaaaaccctgggtaagtgaccacacagtcacagttattattcttattagtcagttacgtatttttgtgtatttagagggtacaagtccaggtttcttacatgcatatactgcgtagtggtgaagtctgggcatttagtgaccccatcacccgaagcgtaaacactgtacccagtagatagtttttcagccttcactcccctcccacctttcacggtctattattccactttgtatgtccatgtgtacccattgattagcttccacttgtaaatgagaacatgtggtatttgattttctgtttctgagcacacagttattattattagtcttcattttacaaggaaagaaacaaaagctcagaaacttctccaaggatacaacattggcaaatggcagagccacgacctggattcaggtcttctcatttgtggtctaaatagtcacatgcacggagagagtgttacagttatactgaaaagatagccgcacatcattataagaaaagataaagaacacatctcattcaaaactagaatcccagcatctgaaggactactgaagtgtctaatgagcatgtgttcataatccttttctatgggttgttctgatcactgtaggaggagcaggacttatctcccatctccaaacactctcccttgacctcacagcagactagagcaactatcccatttctctgctcctctttatagcaaaactctccatctaaactccctgtcctgattccagtctgtgcttcaagctgacgctggtctggcattcctggggctgattctcagtttcccgcctactgaacctctcagcgctctgtctgagtaaataattctctcctagatggatcactttcctcctggccatcaaaacatctactcttagcttctccttcccaggttcctttgtaagatccttctcaccttcctgatttttatatgactgtgcaacccagggtttggctctacaatcacttcccttttccagatatacttatgttctggatgatctcatcctggccacgtttaccctgccaaactacacctttcgcctgaatgccaaacttgtgcatctaactgcttcccagctacctccactctgatatctgaatagaaccctaagtgtacacatttaaaactcaactctcgagttccaccacaaacctgctttttccattgtcttccccatcttagtgaatggcaacttcattcttccatttgttcagatccaaaccctggactcatcttgacttctctctttctttcaccctgagcatgccatatattactgaatcctgatagcccaaccctcaaaatgtatcctggatctagtcacctgcgacctccaaggctgcccaccttagtatacaacactgtcatctctcatttgacttttcctgaggtctcttgcttccacccttgttccctgacaagcctcttctccctatagcagccagagggatcatttaaaacacaaaacagatcatgtcagtcttctgctgaaaaacttccagtggcttcttatcttatggagaatgaaacccaaggttcttggatctggccctggttccctccatgactcagtactcatcattctccccttacttactctactttagttacaatgattttctccaaacaaaccaaacaggttcctgcctcaggacctttgcacctactgttcccttggcctgtccacccttctccatgtcagcaatgccactccctcccttacttgatagatctctgctcaaccacgacttcagcagagagggcttccccgtctgccctatcttaaataacaccagcccagtcattctctattccctcaccttgccttatttttcttcttagcacttatcactgcctaccatttatatatttattggtttatctgtttattatctccccttgctaacatgtaaacatcatgagaataggaaaccttctctgtttgttcattgctatatcttagggctgggtcagcaaaacaatggctgccaggccaaactggcctgccacattattttaaacgatgttttactggaacacagccacaccacttcactcactgctgttatccatgggtgcttctgtgctacagaagcataattgagttgtcacatcagagactggatggccctcaaagcctaaaatgttgaccatttggtcctttccagaaaacgtttgctggctcgttttggggtctagaagacaatgctggcacacagtagaggcaccaaacacatttgctcgatgaataaatgaatgaatgaatgaaataaaagaagaaaccaagaagcggattaagaaatattataccaaaagggcatttgcatttgttaccagattaaccaagtatagcaaaatattagaaagagtgatttaaacttaacagaaatccaaataaagaaaaaaaaaatcttataattctgttttctataaattaagaattatatgaggtgagggaaatgctggggtgaatactgctagcctgtgtgacattcaagcttatacagaactttattatctgggggacttcagttcaaataaatgaacccacacacactaaaaacgatcgcttcagaaacctgaaagggttttttctttttcttctttacagatcttctttacattcaggccaatgttttgattttccatttccccttgggcatgaagacagttttcttttggagttggggtccccacattgtaataactgttaacagagtgcacctgaaaggcttaaaggtagaccctaccaaaagccctttggcccaaacatctgtaaatgctagtgaacattatcagataaagaagcaggattccctttttatgtttttaaggtaccaattctgccagcatgagagagagtagaaggaacagaactcaaaaagtacaaggtcagagttaaaattttaaaagatggtacaaagtccccagtgaacagttgcaggacacactgcctgagctgtgctgccgccataggaagaggggcctgccatagtcctgcaaagcttttccgcggcaatccatctgaaactgctcctgaaactttgtcaactttgacctgcaacactggttctcaagaaagccagtcaacaagcatttgctcaagtccttctatgctttactttgagtttaacatcaaaggctcaggcctctcttctgatatttgaccactttgactggtaattaggtttgtggatgaacaaacacctccatctcaacacacgtacaaatgcagtgttcatggcaaactcagagacaagacttctgcaggtaacattagtgttctaaaacccacaacaacacacaaagtattttaaactaatggcatttagaaatccagaagcaaaaaagacacaaattcttattttggcacatgagtgtgtagaggatctgttttctcaagcacaaatattttccaaacaaatagttttaaacatccaaaaagtctgtctttccttgctgttttagaaaagttcctagggcttctgagaattttatgagagattaaagacagtcaatggctgcttggtacctggcgcccaggctggacttatcttttcttcgcatatctttggcagaggatagcggtagataaaatccattattgacagaaggaaaacagacaatgagcagagaagtaaatgagaaagcttcattatttacccaactttgaaatggtaataaagcttttgctctatcccaaagtttgacaattgccatgcactgccaacccctacctctcaagtcccctttaatatcctcctccaaacttgaggggttccaactgtggagattctgaaaagctgttgcacaccacctcctcttctagagcctgcctatcccaaggggctgacgcactgtcagtgtctggggacgctgggtagacaatgcaaacgagagggtgtaaatgtaaattctgcatttgggtaccagtggctgtgctgcagtgtgagggaactcatccatctcaggaactctggcctctctcacgagagaagaaagatgccctgtgagagcagaggaatacacggcacaggaggattcacttctgcctcacactgtcctaaggactaagccatgctggccactgacgaaatacgtgttcttttattaaccaaacaacatctttgctcaaatcatctgtagcaaatcatttagcctgactgcttttctggaatccagagctgtctttctaaaatttgtgatgtggaagctgtcatttgcagaaacttccagaaaaagaaagaatggtcaggagaccatactgaaggtatatatccagccacttttctaaaatattttattcttgctgtggtacatgacagggcccccctggaaagggaaagtgattcaagagggtctcctatacctgacttgagcggtaaatcaacaaaccctttcagcacctactatgtgctaaacatagatattgtatttcatcaattatatattgcccgttgcaagtactttttgaagctgcattaactctctttgatcaaaaacttactttttaagcacatccaagtgtttctgaaaagtattcaaagaaaacactaaggtaacctctgcagatgccttgccgagaggccagtctgcattccccttgccagtggctctagcataagtgattagcaggggggttaagacccaaagcccctcagggaatctggatacagcatctgtcaatcagaaccaagcccagatagcccagttaccagaactttgtcctcttggatagtttcccatctagaaacaagatttgggtgagtctccacaagtctgccgttttcagcaccctcgtggatggtctggaggcattctttgggttgttgcggagcatgtgtgtatatttcagtgtagtagtatcctgccaaacctctgcaggctctaaatatgatagagcacggtagtctcgcaaagggaatgtgctgcacagcacagaaaggagatgaaaggtacaaggccttggagttagtccctctagaggcctgaaacaagcccagagcaaagggtgaccggatggcaaataaaagtgcacagctcagtaaattatgcaagttcacattacatgctagtatgatattggaacggcataaagctttgcgcagtattaagacattctgtttctcaactttaaaatcttaggctatcggcatttgagagaagaagctctatcaggcatttcgctgcaagagcaattttattctactgaataatgtggacttactttctcttagccactttttattttaggatatgaagtattaataggtatataccaaatgtaactgtattgtcctatcattcagtccatacctttcaggtgatctctataggctgatcttgaggtgagtacattttaagttattagagtttaaaaactcatgataacctgatcaggaggttgtgttcagcttcctctttgcaaatatgtctttgctaccgtggctggcgtgttccctcactccttaactccagctctgcaattatcctgacttgtttttaaaccattgcatgttgctgagtgtttgcatacagcagcgatgttgcgccctctgaggttttagtcacttatcctcatttatatccctgcttgtgtcccggtagccaggagagaatgcagatgtggaaagagcaggagagtgagttccagttactgcaggtcagcctgaattggcttgtctgttcttaatcgaactctggcaaagccactccaggttctaatctatgtggacctctataacagaaagcaagtgaaatcgagaattacagtcatgcagtccacgacaaatgaaaatctatgttactaccttagtgccacactcacattaaacggccatttccaaatttaaagtaatagcacagaagtggcttctacctgcctttataaggacagcgctagttcgaaaattatatccaaatctccaaaaattacctgtaaaggttacaactaccagagacaggaagattagcttagaaataataaaactttactctctccttattcctcttctctttttacaatgcaatctcatcacaggttctacatgaacaataaaagggggacatttttatttccccttagatttcttttacttaaaagttctaaaaactgttgtagataacaggcttttctgctgtctccttccagtgaatatgtggaagagtttagaactcttcagaaaacttcctacttttcacatacactcaagaaattctgagagtttgaatcagcatgaacctttaagtgatttttttatttttatttttagacagagtcacgccctgtcacccaggctggagtgcaatggcgcaatctcagctcactgcaacctcagcctcccgggttcaagcgattctgctgcctcagcctcccgggtagctgggattacaggcacgtgtcaccatgcctggctaattttttgtatttttagtacagatggggtttcaccatgttggccaggctggtctcgaactcttgacctcaagtgatctgcctgccttgacctcccaaagtgctttaagtgatttaagaagaacttgagttcacttagtgcctgtgccccattgacatagtctctgcctgatgccccatggccattcgttgagtgcggactctcaaatcttgcacaattacgggtgctttctgcaaaaggatggtagggagatgaagggtttgggctttttattctgactgccatttcttctctgtactcttgggaatgttgtttaatccctcaggctcagtttcctcatctgtaaatggggactggagattgataacggtatttgactcatgaggccaatgtgaggctccatgagatattggcactaaagccaccatcagtccgcacacactagctcagtgtacatccgttaatgtcagttgtggctattgcaatgattaaagattaacacggccataaagcgaaaggtagaatattgaatgttcagataaaataaagttcacctttaaaacaacagatgtttaaaaaaatcaagattttccaccttttacttcttgatcttacatggtaataatgcaagtatgacagcgcaatgcagtaagcgtaaggttgataattgtggctctgcccagaaatcaggggtgtgggggccagtaaatagaacagatactgaaaaacatttgtgggttttatgccgtagtgctataaagttgcatagtaaaaaaaaaataaactataacttcaaactaatccttttatgccagcatgctgtaaaatatttagaggattcgggctggctttagtgatggattcaatgtgccgtggagttttgtcctttcccaaactttagctgcaatggctgaattcccaccacaccatctgttcctgacacttggtctcattagtacgagtatttttattgatacacacagtaatgcttctcataccatcttagctaagcattatttattgtatctatatatacaacaatattaacacagtcaagcaccaggatcggtacttgagggcatcattaaaatcagccagtgttcagtgagagacttaatgatggatttaatagtattaaatgggcaaaaatgcccttggcctttacatgctcatttaaaaacatataaaagagcagtaattcaggcagttatacttctctcaaagattttgctctaaatcacagatggcagcgggaggccacggctgtgtgctggctcacaccccactcactccaaccgaagccagaagtgctcgttgggtcataattagcaaaccacccgcaaactcgactctttaaatcagaggccagtgactgccaggctggggcatagacgggagaaaacaagcagaaatggtcaaggtgctctctggagcctgccttcggatagctgtgacccccacgttaggcatcaagacagggttccacacctgcgccgccacccctgcagtgtgagcgctgtattttgctttctgagaaagcctcacggtttggctctttggtgcatgaggctttaaggcgatgtgccccctgcccagctgttgcccagctcccagcccttgccacagacagcatacatctctgttttagaaacaaatcatttagtcacttaatcatgaattcccgatgatgtacgtcctgcagaggtctgagctggggctgctggtctgaaagtctacgtacttctgactggagacttaggctaggctgggtttcaaatttggatgaagacggttttggctgagcagggagaagaaaacaaacaaacgaacaaacaaacaaacaaacaacaatccgggagcctggagtttgctgagaggctcagctttggggagatctggggctggccatccttggagtctgcttccttatcagcaaacgcctcctaaagttgttatgatacttctcagaactagacagcatatatgaaatcagataatgcacagttgtgcactacttggtgacattttggttaatgacagactgcatatatgagggcagtcctgtaagattataatggagctgacgtcctatcacctagtgatgcaatagccattgtaatgtcacagtgtaacacattactcaccattgtggtgatgctggcgtaaataaacctaatgcgatgccagtcatataaaagtatggcacatacaaaattatgtacagtacatactatttcataatgataataaacaatgatgtcacaggtttatgtatttactacattacactatacttttattattttagagtgcactccttctactcattaaaaaaaagttaactgtaaaacagcttcaagcagttcctcatgaggtatccagaagaaggcactgctatcagaggagaggacagctccacgcatgttaccacccctgaagacctcccagtgggacaagatgtggaggtggagggctgtgatgtcgatgatcctgaccctgtgcaggcctacactaatgtgctgtgcctttgattttagcccaaaaaaattaaaaagaaaagcatttttaatgaaaaaagcttacagaataaggatgtaaagaaactatttttgaatagtcgtacagtgttgtttgtgcttaaactaagtgttattacaaaagagtcaaaaattacacaactttaaaaatgtataaagtaaaaaggttacagtaagaataggctaaggttaatttattactgaagaaacagaagttttttaaaaataaatttagtatagtctaagttcacagtgtacagtagtgtacgataatgtcctaggccttcacattcactcagcactcactcactgactcacccagagcaacttccagtcctgtaagctcctttcgtggtaagggtcctatgcaagtatactatttttaaaaaatcttttatgctgtatttttactctaccttttctgtgtttagatacatatatagttatcattgtggcacgattgcctatagcattcagtatagtagcatgctgtgcaggtttctggcctaggagcaacagaccataccatatagcttgagtgtatagtaggctataccatcttagtttgtgaagtgtgatgttcacaaaacaatgaaatggcctaacgacacatttctcagaacatatccatattgttataccatgcatgactgcatatgaaatgcttcatacaaagcttggcattcataattttaataagttgttggccaggtgcggtgccatgcctgtaattccaactctttgggaggccaagttgggaggactgcttgaggccaggagctcgagaccatcctgggcaacacagtgagacctgtctctacaaaaaattatctgggcatggcagtgcatgtagctgggcaaggtggtacatgcctgtagtcaaagctacttgggaggctggggcgggaggattgcttgagttcaagagttcgaggctgcagtgagctaactatgccactgcacttcagactaggtaacagagtgaggccctgtcaccaaaaaaaaaaaaaaaaaaaaaaaagtagttgaggattcaggccactggttctgccttcttttccagacaccctagaaatcatgaaaatggaaccagaatgacagtatggctgccctctcccagaacttccaccaggcctctctgcatcccccctgggattaacctgcatggatggcagcccagcctcttcctgcctctggcctcaggagagactttcattttggaactgctgacaatcacatcaagaacaggtcatgtcaggagaggctgggaatgatattgctcgaggattcggaggctgcttccatgggaagttacagacctaactgagtccttctcacacttcttaaaggctttcaggaaaaataaacatcagtggcataagcgcaagctctgcaaattaaaagatggctacaaaatgatcttctttgcattttaagcaaattacagaatcattcaactaatttcaacaatgaaaggaatgtagatccagtgaaaattacacatgcatggaccctggtgatgatacctaaaattagattgttgatggcagctcctgcaaaaataaatgcaaagtgattgctcatcagaaaatacatactgagttcccatgtgaaactcctgcctgtgataaattcttccaacgaaatgactactcaagcatttaccaacctgccttagaaaatagtgcaagctaatgtttcttgtccaaaaatgtgtatacagcacagataagaaaagaaatgtgacagtaacagcagagtcttgaactggctgaaaagcccatacagtaagtgctataaggacatcaactaggaactgggctaacgtggtaactagtgtctgacagcagcacccacagcaagacaactcaaaatttattaataaaactaccacaggctttcaacatctacatacaatgggcctaaggctttgtaatctttgaatgaaatacactacagagaacctcctagtgaatgaatgaaagatctaagattttcttctctttgcaaaggaaccctgagctgtattcatgcatttgaggataagatgtttcctttatggaggagtttgcttttacaattttattatcaatatccattaagtagcaactgaattttatagcaggtttcaaacaggggcaatgtctggagatatgtttggttgtcataacagagtgggtgctactggcatcaagtgggtagatgccaggggtactgctaaacatcctacagtgcataggagagtcccacaaccaaaaattatctggcctaaaatgtccatagtcctaaggcaaagaaaccctgataaatatacaacaatctacaactctgataaatgtacggtgattgtactctgggtatttactcaagataaatgacaacacacgtccacacaaaaacttgcacacggcatagctttatgtacaacaacccaaaccgaaaactcgaaatatccatggcaaataaacaatggataaagaaattatgatatacccatagaatggaacgcttctcagcaacagaaagaacgaagcgagtacacaaaacatgagtaaatctcaaaaacagtttggtaagtaaaagaaaccaggcacaaagagtatattccatctttttctagacaggtgatgttctagaactggccatgccgaactaggctatacagaccacaggcacttcagtgatcatgttggcctggggataggagagtaagggttgaggttcctcttctttttctttattcaagatggaaatgtgttgaaaattagttggtaacatacagttgtccctcgctacccttggcggattggttctaggacccctgtggataccaaaatctacggatgcttatataaaatgatatacaatggtgtgtttccatgtaattctcctatgtactttaataaataatccctaggttacttacaacacctaatgtcatgtaaataccatgtagatacttgctttattgcactgttcggggaataatgacaagaaagatagtctgtgcctgttcagtacggatgcaccattctttccctggcgcctgaacgtttttgatctgcggttcatttaacctgtgaatgtggaacccacaaatacagagagccgactgtacagtcaaccttcattattcacggattctttatttctgaatttgccccctcattaaatttactgatgccccaaatttcatactcacagtgctttcctggtcattcatggacacgcacagaatggtgaaaaccatgactggcccaatgtgcatgtttccagacaaggctgaaaaaggtgacacgctgtcttcttgtttcagctttcctactgtcctttttgtggtatatttagtgccatattttttgcaattttgtgtttttcttttttttttttttaattttgctgtttaaaatggaccccaggcatcgtgctcagtgctgtctagtgatcccaagtgcaaaaaagttgtgatgtcccttatggaggaaataagtgcatcagatatgcttcatttgggcatgggttatagtgctgttagctgtgagttcagtgttagtgaatcaacaatatatgttaaataaggtgtctttaaacagaaacacacatacaacaaggttatatactgattggctgatgtgtgatcgaaggctcacagcaacttaactttgcattttccctaggttcagtatttgctaattcagtatgactctgtaaaacataataccatgaataatgagaatggacagcatatgtgagtctttttctagacactattacacagaactctgggactgaggctagaggatcactcgaagccaggagttcaagaccagcctgggtaagaagactctgcctctacaaaatataaaaaaattagctgggcgcactagcagtgcatgtgtgtagtcccagctacttggaaggctgaggtgggaggatctcctgagcccaggagattgaggttacagtgagccgtgattgagctgctgcactccaacctgcctgagtgacagagtgagactctgtcttaaaaaacaaaacaaaacaaaaacaaacaaaacaacaaaaactcaaacaaaatgaaattggcaagagtatatctttgccttagcatcttcggagcaaagcaatttgttcctttatcattagttaagctactataggctttttgtggataccctttatcaagctgaggaagtttccatatattcctagtttgttcagagttaaatatatcttaaattttgccaaatgctttttctgcaccgattgaaatattcatataattttatcctttattctgctaatacagaaaattatactgactgatttttgtacgttaaaccttcttggcattcctggaatactttacttattatatatttctgaatttaactagctaagttttgtgaaaggttgatatcagactaatgttagcctcatgaaaaatatatctgggacatgtttcctcctcatttgttttctgagtaattttgtacatggttaatatttcttcctcaaccggtaacatctgagtgacaccatctgatcacggtgatatggtttggatatttgtccccttcaaatctcatgttgaaatgcgatgacccctggtgttggaggtggggcctattgagaggtatttgggtcatgaaggtggatctctcatgaatggcctggtgccctccccatggtaatgggtgagtttctagctctattagttcccgcaagaactggatgttaaaaaaagaaccatggcacttcctttttctccagctccctctcaatgtgacacgcctgctcccctttcgccttccatcctgactataagcttcgtgaggcctcgccagaagcgaatgctagcactgtccttcttaaacagcctgcagaaccccgagcccaaacaaacatcttttctttgtaaatttcccagtctcaggcattcctttacagcaacacaaaacagactaacacacatggaatttgggggaattacaaattcaatttcattaacacagataggactacacagattctattttttggggtagatttggtcatttttatctttaaataaatttgtacatttcccctaagctgttgaatctattggcataaagttgttaacagcagccctttatttattcttctaatgtttgtaatacctgtggtgatgtcctctctttcattgctcatattaatcattcgcgttttctcttttctgttgtttagcccacttagaactttattaattttattgatcttttcaaaggagcagctttagatttcataaattttcagtatctttgtccattttctatttttaatgagttctgctcctatctttattatttcttccttctacttcctttgggtttaatttactctttgtacttgagattcttaaggtggaaactcaaggaacctgacgttcaacctttcttctttttctgttatgaacatttaaagctataagatttccttgaagaactgctctaactacattttacatacacatcttcattagggtcaatatttgttctaatttctctgatgatttcttctttgacacatggatttagaaatatgttgtttcatttccccatattgggggattttccagatatctcttttatttctaaattaattttgttttggccagaaaacatattctgtatttcagtccttctaatttattgagattggttttatacccagaacatggtctattttccttttgctatgggtcacatttgctgcttctttttcttacaattttggaatggatgcttaacattttggatgttggtaaatgtttttcttttctttcttcagagactgatgaagtttgttttgtcgagaaattaggttacttgtgtatcaaagcttatttttaaattgtgttagggtgtagccaatccctttattctagagatactttagctgtattactaagacatagctagtatctctacttaatgctctgggttgttaacagggtctttccattaaggcttgtgagaatttaaatgtatctttgctgtatgtgagttctggggattgttcatctagtagctccatggcaatttttatttgcatagccttgtggaatttcatattatgcatgcaaggattagtattcagctaaagactcaaggggtcccctatgtagatttctggaactcttcctctgagtatctccactttagtattctgtcttgcaaactccagctgcctaggccttttcatagtctattttccctcaactcagtgagacttctagttctgtttaaagctctgtctcttcactacagtctagaaagcagctctgaatataaatctgagatgactacagtagtcacctaatttatttcccttcatgggatcatgattctgtactgactgttttccaatgtctgaaaacagtgatttcatatattttgggtagttttctagttgtttatggcaggagggcaaattctataccatttattacttcataagaagaactagagtaatcactcaaaagtacgaacctgatgatatcactctccagcttaaaacccttccatgctgactatataatttgctgtctatactggtatatttctgaagtgctaaaatgctaaccagaagaagtgctggtgattcacaatagcaatgatatggaatcaacctaagtgcccatcaatggatgattggacagagaaaaagtagtgtgcatataaacacacacacacacaccatggaacactactcagccatgaaaaagaatgaaatcatgtcttttgcagcaacatccctggctgcactggaggccattatcttaagtgaaacaatacagaaagtcaaatactgatagtctcacttataagtgggaactaaataatgtgcacacatggacacagtatgtggaatgacagacactggggactcagaagggcaatggctggggggcaggtgggagggcagtgagggatgcgaaattactaatgggcataatctacattattcagatggtggatacactaaacgcccagattttaccactacacaatatactcccataacaaaacagcacttgtagtccttaaatttatccaagaaaaaggtgtggggataatgagcataaaccaggatgatcacaggaaaactagcacttctgtcactgctaaactcctcggctcggcttctaggctctcattacttcccctcctcatttccctcccaccttcattcctttagcttgaatgcctctacagtgctgtatttcttacgtgtagcaactctcctctcctgttcatctagtaaactcctcttctgccctccaggtggttgaaacattaacttcctctaggtctacacggtgctttgcacctgatttggcttgcacctcatgctattctattaatttatttgcatgttgcctcctcttctagactaggtttttgagaaagtgagagaaaaatcaagaaatctgttttagaaaaattaatccagaaacaatatttgtgaaaaattggataaaggatgaggaacaggggcaatttagaagattgtttagtatctatattcttatttaacagcagccttcagagctaaagaagcccaaaggcctcttaacacctaatcacccatttattcctcttaaactctcacctgcaatcaaaacctattcagaaaaccagaattttaatgtaaagatctcagtatgaaggtttttggtattttatgatctaaacaaaccttccaaagtctggtgaggctcaagttggcaaaccacctgcaatcttcccactaaactatatttagtatcccactgtagcacccactgcaactgacatatgaatacactgtgctaacaaatacattacttaatacaaaactcttcaatttattacattgtgtcataaatttgttttgctttataagaaaatagattttaactcaaaaagtttcttatttggaacaaatgcatgaagcaaaggttttcaagcactggacatcaagcaaccaacaacttaattcccaggaaatgaaaaactgatgaggcaagctgtatgactgccccagcttactgcactaagaacttctgggctatagcacagggaggggaaaccatgagaaagcccagtgaacacactgagctgagagtctggggagaacaagttgacttgagtttgctgctcaggacacaagagcggagattgctgtacagagagaatcttgaatatctgcaggtcttccttgagtattcagcagagttctgagtggcacaagtacatgaaaaaataacctgaggctagggaaagaatcatctgaaaggattacagaaaaaaataccaggtgcttacaaggccaggaacagaaattgtgctcaccagccagactgtaaaaccttataattaacagggcattggatagagcactcaaaagaatcttgcctcagaactaggcaataattagccatagactaaatgatgctctttctcacctgacaaactgtggagacaaaacccaaaacaatcacactatttccaagtaacttaactacatcccagaacaaagcacagggagatctgtagaaacacaaaaaagcaaaactctgtctgggtccaaccaaagattaccagatagacagatcaccatacgtgcaaagaagcaagaaagtgcaacccatagtgagaaaaaaataagacaacccagaaaggccacaggtgtcagacttattggacaaagatattaaacagttactatttgtaatatgtatgtccaaaaagttaagtagagacatagaagatataccaaagacccaaactgagttttcatctagagatgaaaactatatgaaatgcaaatatacattgaatgcaattaatggtagaatagagattgtaaaagaaaacattagtgagcttgaagacataacaacagaaactacacaaaatgaaatacagagagaaaaaagagcataagtaaactgcagaatgacttcatgtgtgatctaatgtacataaaattggagtccctacaggagaaaggggagggtagaaaatatatttaaataaataatgaaggaacaaaactgtaacatttgataaaaaacataaatctacagatgtaagagactcagttatgataggtacagtaaacatgaagaaagctacaaaaggacaaagtataatcaaattgctcaaaaccagtggtaaaagagaaacatttaaaagcagccagagaaagacgaaacagagattaggattacaacagatttactgttggaaacaatgcaagtaagaagacagtggaacaacatctccaaaacatggaaagaaaataaataactccaaaatatatatatgacaaaaatatttgtcaaaaactaaggtaaaatacagacattttcagatatgcaacagctggaaaagttcataaccagcagatccgcactatggaaaatgttaaaggaagcccttgaggcagaaggaaagtgctaacagacggaaatataaatatacccaaagcaataaagagaactgaaaaatggtaagtctattaaacatattttataatttgaatatgtttaaaatataattgattagttaagaaaaaaattatatttttggagttgataacatatacaagtaaaatgtttgacaacaataggaaaaaggtggctggggaaggagtaatgaagaattgcaaggttcttacactgaacatgaagtggtaaaatattacttgacagtaagctaaagatgtctactataattcctaaagcaaccactaaaataacaaagcaaagagtaatagctaataagacaacaaatgagattaaatgaaaacaaaaaaataactcaatgcaaaagaagacaggacaagaggaaagggcaataattattcaattacattaaataattgcattcaatgctaactgcattgaattacattgaatgtaattattgatacggttaggattgtctattttccatcctgtttttatttatccaatcagataaataataaataatatatgtaaacactataaaatcccagttaaaagacagaaatgagcagactgcattaaaagatcaagacccaattatatgctatttataagaaatatactgtaagtataagaaaaaccaaatagattaaaataaaatgatagaaatatatattacatgctaacattaatcaaaagaaagctgaattggctatattaatattaaggtagatcttaacgcagccagggataaagaagtttatatcacattgtctaacggaccaatcaatatgacgtaaaaatctaaatgcttatgtgcctaacagcagagcttcaaaatacacgaagcaaaagtgaatacaacttcaaggagaaatagacagtcccttaattatagtcagagatttcagtatcctgccctagtaattgatagaatacataggaagaaaattagtcagacttttctgactaatgtagccttgaacaacactatgacaccatggtctaggtagaaaatgtaatgaaatctacagaaaaagctactaaaattaataagttagtttcacaaagttgcaggatacaagatcagtaaacaaatataaattacatatctatatgccagcaactagtaaatataacctgaaatttaaagataaatgccatgtatactagtatcaaaaataaaacatacttaggaataaatctgacaaaagatgttcaagtcctgtatattaaaaactataaaacactgcagagagaaattaaagagatctaaatctctaatggtagaacagagattataaaagaagcactagtgagcttcaaggcataataatacaaactacataaaatgaaacacagagagaaaagaatagtgaaaagagaaaaaaagaatataagtgaacggtggaatgactacatgtgtggtctcacataaaattggagttccctaaaggagaagggggagggtagaaaatatacttgaataaataatgaaagaaaaaaagacccttaacatttgatgagaagcaaatagagagacataccatgttcatgatttggaagaatcgatattgttaagatgccaattctttctaaattcatttgtagattcaatgcaatcataataaaaatcctaataggctttttatttgtgtggaaattgacaagttggttctaaaatttacacagaaaaggtgttaaaataaccaaaataacttgaaaaacaagaataaaatcgaaagattatactatttgatagaaaatcatacagctatagtgaccaagacagtgtgataccagtgtaaggactgacaagaaccaaacagagaatccagaaatacaccacatatctacaaacaactgattttcagcaaaagtgcaaaggcaattaagtggagaaaggacagtatttcaacaaatggtactggaataactggatactcatgtgcaaaagttgaatttccatccacacttcacaatgaatcttaaacccaaatgtaaagtctaaaactgcaaagtgttctgaacctaacatagaaaaaaatccattgtgactttagattataccaagatttcttagccacaactccaaaaacaagaaccataaattaaaaaatgtaaaacagaacttcatagaaattaattttttaacaaagtttgaaagacatgtctttacaatctctaaagacaagccccatacttagagaagatatttgcaaagtatgtaaataacttgaatgtagaacatataaaaaagacttttcaaaaatcaacaatgagaacaaaacaacctagtaaaaaaggccaaagttttttgaacacatcaccacagaagatacatggatggaaaataagtgtatgaaaagatgctcaatacaaccaatcatgaaggcaatgcacattaaaaccacaatgagataccactacatacctattagaatgtttaggattaaaaagatcaagtgttggcaaggatgtggagaaacaacaactctcctccattgctggtagagatgtaaaatgatataagcactttggagaacagtttagtgggtttttaagaaaatgttaaacatactcctattatttgatccaaacattccactcctaggtatttaccccagagaagagaaagcacaaagacattttgtgtgttataaacatgtgcacaaatatttataatagcttttatgtataactgcccccaaatggatacaacccaaacgtcctctgacaggttaagggataaacaaattttgttatgtccatacaatggaatacggctcagcaatgaaaagtaatgaacaattgatccatgcaacaacatggataaatttcagaataattacacagagtgacagaagccaaacaagaaagtacatgctatatgattctacatatataaaactctaggaaaatgcagactcacccatagtgacagaaagcagagcagtggtggcctggggatgagtggggtgtgtggagaagggtaggagggatcaattacaaggggtctgagaatgaatttggcaatgatggatacattcattatcttatcaaaacaataataatgcaaattctatagcatgagttacttacatataattatacatatgtgatattttcaccggtatataccaatgtgaaagcttaccaaattatctaaatatgtgcaatttacatgtcgattatatctcaataaagaaatgtgaaaatgatacttcctatttcttcctaattccatgcaatttagacttcatacatgtaatactttctgtaagctcccagcaaggtttctttcatcaacatcagctaaataatttggagaaatttatcagaaatttcaaagtatgtcaacttcaatttcttcttgtaatttcataggttaactttcttctctaaccttagtccaaatgcactacaaaatattttctcatgctttcattaacctggtcttcagtgcttcaacagattttggtgattgtaatatttacagagtcaacaaagtgaagccaatagcactactgattggaaaggcaggggtgggcccctaagcaaggtaacccgcagaccaagcaggagactgtcctgagcagatacttccccactctgaagggagtctcaagttcccactactgaagcacagaacttgtacttcccatttccttcgggacaatctggatgcaggaggctgctgtgctaaaaagttttcaccatgtcactagcttgacatctacttttacgacctctcattcttaattatgtccctgaatcccagctcctgagctcatgtatttatctttgtccagaaaagcggaaattgtaaaaacaaattctatagcatgagttacttatatataattgttatgtggggtctctattatttcaagtcattaatcagccaagttccattattttctgtaagtcaatccttttgccactcttcccataagcacctcccaatagaactatttcctttgttaaatgcatgcatatgcaggtttttacatgtatattatgtatcaattatcatataattacataattactgtaatcggatttaactgtataattagaatgtgtaattacataattaaaacatgtaattaccaagtttaaaaagttatggaaattatttcttttaaatgaataatgcatgtatgggagacaaactttcaaagctcactacttaggccttctaaaagtcattttaactaaaaacacaatttaaaatccactaagccagttatttcacatgacatgttgaataccttaaacttttttaatggatttttatcttaagagaatattagaaaccttcaagggctcagcatctggatgtaggaaaaggagacaaaaaggcagctctcttcaagtgatcatgaagtctgactgcatttttaacctattcccacttacattaaaagttttcttggctgggcgcggtgcctgtaatcccagcactttgggaggctgaggtgggaggactgtttgagcccaggagtttgagacctgcctgggcaagatggtgagaccctgtctctacaaaaaattttgaaaacttagccaggtgcagtggtgtgcgcctgtagtcctagctactcaggaggctgaggcaagagggtcacttgagcccagtagtttgaggtggcagtgagctatgatcatgccactgcactccagcctggccaataaagtgagactctgtctctaaaaaataaaaagtattttcctagggtgtctttttttttttttttttttgcagctattgtaaaagggattcagtttttgatttgactctcagcttggtcactgttggtgtatagcagtgctactgatttgtgtacatgaattttgtaacctaagactttactgaattcatttatcaaatctagaggtcttttggtggagtctttagggttttctaggtgtacaatcatattaccagcaaaaagagatagtttgacttcctcttttccaatttgaatgccctttagttccttctcttgcttgattgccccagctacgacttccagtgctatcctgaatagaagtggtgaaagtgggtatccttgtcttattccagttcttatggggaatgctttcaacttttccccattcagtatgtgtgggtttgtcatatgtggcttttattattttgaggtatgttccttctatgcctagtttgttgagggtttatatgataaagtgttgctggattttatcacatgcttattctgtttctattatcatatggtttttgtttataattatgttggtgtgatgtatcacatttattgatttgtgtatgacgaaccatccctgcatccctagtgatcatggtgaattatctttttgatgtgctgttggattctgtttggtagtatttcattgaggatttttgcacttatgttcatcagggataggaagtgaaagatctctacaaggggagctacaaaacactactgaaagaaataatagatgacacaaagaaatggaaatacatcccatgctcatggattggaagaatcaacatcataaaaatgaccatgtggctcaaagcaatctacagattcaatgcaactcttttcaaaataccaacatcattttcacagaacaataaaaaaaatcctaatattcataaggagccaaaaaagaggctgaagagccaaagcaatcctaagcaaaaagaacaaagccagaggcatcacacgacatgacttcaaactatactataaggttatagtaaccaaaacagcatggtactggtataaatgtagatacacggaccaatggagcagaataaagaacccagaaataaagccaaatacttacaaccaactgatctttgacaaagcacacaaaaacataaattggaaaaaggacaccctattcaataaatggtgctaggaaaactggacagccacatgtagaggaatgaaactggattcttatctctaaccatctacaaaaatcaactccagacggatcaaacacttaaatctaagaactgaaaccagaaaaaaatctagaagaaaacctaggaaaaacactgctggatactggcctaggcaaagaatttatgactaagaacccaaaagcaaatgtaacaaaaacaaacaaacaaaaaataaatgagacctaattaactgagaagcttctgcatagcaaaagaaataatcatcagagcaaacagacaacccacagaatgagagaaatatttgcaaactattcatgtgacaaagaactaatatctagaatctacaaacaactcaaacaagtcagcaagaaaaaccaaataatcccatcaaaacataggcaaatgacatgaatagacatttttcaaaagaagatacacaaatggccaaaaaatatatgaaaaaatgttcaacatcagtaatcatcagggaaatgcaaattacaaccacaatagataccaacttaccacagccagaatggcagttattaaaaagtcaaaaaacaattaatgttagtgtggatgtggtgaaaagagaagacttatacactgctagtgagaatgtaaattagtaccacctgtatggaaaacagtatggtgatttctcaaagaactaaaagtagatcaactgttcaattcagcaatcccactacagggtatctatccaaaggaaaataagtcactatgttaaaaagacatctgcacacatgtttatcgcagcacaattcacaattgcaaatatatggaaccaatctaagtgctcatcaactgatgagtggataaagaaaatgtgatatatacaccacaggatactatttaaccatgaaaaagaatgaaataatgtcttttgtagcaatgtggatggagctgggggccattattctaagtgaagtggctcaggaatggaaaaccaagtaccctatattctcatttagaagtggaggtaagctatggatatgcaaaggtatacagagtgggaaaatggactttggagactcagaggagggaaagatgaaatgcgggcaagggataaaaaacaacacattgggtacaatatacactacttggatgacaagttcactaagatctcagactccatcactacacaatgcatcttgtaaccaaaaaccacttgtaccctaaaagctattaaaataaaatatatgtattttaacaagttttcttagtgtaattgacagcaaataatgagcagtgatgactagtacaaaagtcatcacccagctgatgttttggtaaatccaggaaatggtatatctgattcaatcccatgcttggtttcaaaggcaaaatgttacttaaaaaaataaatgttgactatatacctgcttgataataagaaacattcacctctcttcgtttaagttcaacttaaagaagaaacatttttgaaaagtgagaagtgtgttacattggtggtattatgataataattcaagtgtgcttgatgctggggataaaatgacaaatcagatgtgttctctggccttgcgttgttcagacaaacacatgagccaataaataaaacacaaagagaatatggacagtaatggctttcaaaacttaaaaaaatctaataataaatcattacaatttgttgcctgaggaaataatcctcatcatgtaaaccagaagtcaattattgatttttctgaccacaatcaacaccacagccgagtatgctctgtgcaggaaaatccctactcctcttcagacctgcctgtaacactctatacatatttaatcattaataacataacacttatcctattgcttcacaattatgtatatgtctatttcttcttttgaatgtgagttccaggagggcaaatgcttagcgcaggaaacatctgcctgcaggagtcttacacacacacacacacacacacacacacacacacacacgatgaaggaacatttgcccgctcttttcatggaacaggatgcttttgtttttgtctcttcacatcacaagtaaccagcacatctttgaaaactcaacagtttaacctggaaatgttcataaagatcattctcaaatgacaacttattcttggacaaaataagaaatgcaaatgcaaaataaaagaatgtgtcccacagagatgatagaaaaaaaaaagagcagaacagttatagtaaaccacaggctaaaccctcatattatgcattgcatcagccatgataaataaggttcgcatttgtcagatccgatcaacttggtttctagggtagtccaatttcagcagactgctctagcactaatcatcttgtgaattcatctgtggtaggttaatgttcaattcattaattaattactcccatcaacattcattgagcttctgtctactacatgtgaagcagcatgtggggtatgggatatgcaacacagagcggaaaatagcccctgctctcatggaattcatgttccaggaaaagggcagacacgtaaacaagcctaacactgcaaatgctcagctctgcgatgggagtgtgtgccaggaccccaggagcatggaggaggatgaggacccctgaacaaattcaatgcgatgcaccaggaatctcgctccctatggctccctatttgtttcctctggggaaccactccagacttgatggggggaaatcccagttgaacttgatatgacagagcaagtaacttagaacaacactgattctgcagaacctggactagcagacctactagtcacaggagtcctatcccttcttcatatacctgtctccacgcccccaccctcattcaagataaaacattcaccagcattcctcttaatgcatctttgttgggaagatgactggagcccagcacagtgtatggcaaacagtaggcgctctgtgttgaatgctgaatacttacatgaataccactgagaatccacagtaaaatacatttgtgtgttttggttttgttccaacagattttcatcatttctgaagaaagagacatactcctggaatgtggcacatggaaacttcctggtttatcaggagttgatcatgacctctaagagctcaaagctcagctgaggcttttgcagaactgggaagcatggcattcgtctcagcctaaccccccacattccctgtgttgcttgtgtggtgttactggcgccaccagggctatcccttgcattcatcaacagataccgagagaaagttgctgttcccatgttcatgaattgaacctgtcacccatgaatgcacttttggctcatcagattagctggttgtcacctcataaatgaggaaacagggtcctggatggaagaggatggtgcataggacaaggcagagaaaacggagtggtgggtgggttgctgcatggtctgttggctcccgaagtctaataagatgacagaatctggagtttggaaaggatcctggactcaccatgtacctaatgcatgaattcctaccaacgcacccagtttctgttcttcctgggatggagaactgtcacatcccctaattgaccatttggctttctgatatctcagctggtggaaaggtctttttgatattgagtcccaattcataaattctactccgtggtcctggtttttcactctgaggtcaaaagaaccaatctagtcacctgatgctgtgatcttagtcctgaaattaagagtcaatattacttgctgccttgacatctggtaaaataaggcaggcctcaattggcctaactgcaagttctccccacactgcccctatggataaagtcttgtagcaaaacaccctctttagcagggggaccaggcacagttcctgcttatcgctgagtggcgggtttagctccctgccagcctgtggaattagtcaaacaagccaatcacatcctactgtgagaaccaggggtcaacctaccctcttgttactacaaagctggcctctggcagtccccgctggctcactctgttcctgaatacaacccctctgtgcccctgagccccttcccaggctgtgagtatatgtaattaataagtgcctgtcaatctcatctgttcattgtcaggggctgtgtgttcagccatacccatcaccatagggtaggaatccctccctcgccaatggggtgaaggggaggcaaccaaaatagctacgtcttagaacgaggctctgggaaccttagaagagtgggttaaagagaggccggaagaactctgtttgattagaatttaaaattcccatttcctccctctttccacctttcctaaacaccactctcaaggttttctcaagtgactgtgggtatggaagctgatgtaacacaatggcaggaaacaagaacaagaacaagtgaacaaggcagaatcaagagagccatactttaggaaaaggtatacaaagaaatattctgggatcccaggaccatcaatgacagtaaacttactctagaaaataagtgtcattattcactggattcaccagcacactctattgttcttactgtagttctttggctaccagatgcccaggtaccagaactctatttgtctctgtatgaaaatacagagtgatgaacaagaaaactagtgattacaactaatgcatgtgttctagttacaaacacaaacctgcccctccccctcctctgagctaatggatgaacctcaatcaatacactcaggaaagactgcagaatcaataacaaggcttatttaacagaattaagaagtggctttttaaaaaacaaaagaaaaaaaaacaagaaagtagacacaattgcaataactgcattcttatgttgcctggcaacaagatataaaaatgatgtacaatgtcagtgacttattttcacatagagaagcagccccctgccttggcaatgctataatgtactttcccccaactagaactccacagagactattaatgctaccattttccataatacactgttaaacaatcatgtgtttttgttagtgcattaaaacactgaatttacttaatgactactcagtgaggcagcggctacagaaaagggaggagtttttgtttcctttgcaagcacaggagttcgttccctgggcaggagaatttaacaggtagcaatggatatgaatcaaagcactggaattcacatacctagagaggaaggtgcactcttacgtcttttcaagggaaagcagaaaatgaagtcgaagtgcagtattagtgttccttgactttaaaaaattttctttagaatatgaaagaagtttctggaaggcagaaagcctttgaggttccaagacatatacttggacatgggagtgaaggttcaatagaaaaggaaagtgacagcagagcgctttagctgagaagaagagaagaacaaggagcggctacagaggcacccagctctcagggtctacggggcaagccctcaacgcggggggctggcgctcctactgcagcctgcacctctggcagtggggagggggcacaggtttgcaccctgctgggggtcacacatacattagctcatttcatccttctatgaaagcccattcaatagaagcagaaaatagattcaatgggattaggtgattacccagtgtctgtcggctagtgaattggaaagctggaatttaacactaagcctgtctgtcctcagagccaccacacacctttgcctccattggctgtcactaatttccagctgtaggggatgttctgggattgctgccatttagtgcccatggagcacaagtaaggaggaaagctatttcctccaaagaagcaataaaacaaataaaaaacaagaaaccactttcctgatgagtcccacatcccactgcgctgtatttatgtgcacatttgttaacttgcacacttccatgattttttgcaagcttcttactcattgttcactaactcctttggtacagggccaggtgttatatttttataagaaatagttttaaaacaactgttttctgctgaatagagcattttattcaggagacctccagtaaatactgatggacaacttgtgggtaagggaaaggtcactttgttttacaaaatctttgggaaaaggaatctgtcttattcacagtgctatcttcaacacctgcactggactacagtaagtgctcaataaataggtacaaaatcaacatcatgcactcaggaatttcaaagtcttcctgatatgctgatggaccagtgatttttactcaggatccttgggggcttgaaccaatactggtacctcacagcctaactgaaatgagcaaaaaagatggataacgtgaagtggaatgctgtggttatggaaagggcagacaattataggcaaagacaacttgatgtcagctcagcatcctcccggttgctatgcaaccccagagaagtcccttgtcttacctggccgctttaacctcaccacacctgttcccccatctgagagataattacaacacttactgtgtcaggcagtcaacaagtatttatggaatgcccacagggcacagagcaataaacctattgcttacttaagccaggaaatcaagctacagcaaagcagaggattagtacaaatacctgggcaaacgtgccacccgcagaagcattaggttcttaaatcctccaggtaattgtggtcacacattagtcttggctttagggccttttaaagtagtatctgaaatatcttgtctatccactttagttcaagtgtgtgagtgtgtgtgtgtgtgtgttggctttccatctccgcttaacaaatcacctcaaacttagtggctgaaaacaacacagatatatgatcttagagtttgaccgctaaaagtttaaaatgcatgaaaaccaaggtgctagcaagaccacgttctgttctggaggctctaggggaaactctgttcttgctccttgcaatttctcagggccatcacattctttggtttgtggcccctttttccatcttcaaagccagcgacactggacaagtctttctgatgctctcatctttggaattctctttcctctgtcttcctcccccacatctaagggcctttatgattacattgtacccatccagataatccaggataacctccccaactcaaggtggatgattagcaactttaattccctcttgccatgttacctaacatattcacatggtctgcggattaggacatgggagggacgtgcttttctgcctaccacatgtgtgtctggctgtaattatttatctattgagagcaatgaaaggtcattcattctatgggtacaactcaggaccttatgtaagatcatctattgccttcagaactttatgctctcaggaaggtgataagtatgtaaaatattaacaaccaaaaccaaccctgtagtttgcaaagcactttgacattcatccttttggttagaacctctcagctactttgcaagacaagtaaggaaactattattatctctgaatcacagatgagtaaactgaggcacagaggttttttggtttttttttcccttaaggacagaaaacagcatattcaaaccgaggcatgtgggtttctggtctggtgctctttatcctccccgtactgcaaacacctttacagtatgtgtcatattgacatatgttgccaaaagaagagatcctgctcctatttcatgaaaggaaaacagatgtgaggttgttcagaaactcaataaagtgcataaagtatgccccttgcagagctgaggcaccagattctccctccattaattcagtcttatccctgatccatgcttgcaaagcaagagacaagggaacgaaaggacagaaagaatttctacaggttgagtcaccatttggacgcagaacaacgtggcaatgtgggcacttcatgcacacagttaaaataagtcacacgctttatgtctgcatattttctttgtatgaataaaagaatgcagctgtacgatggccttggccttgtgtggacagtggtagctacgtacctgaacacagacaatgagagaagttgagaactttcattaaaatatttcagtcatgtaagccaatgagcattattttagtctccataaagctgcattgtttcaatagagaatccaaggccagaaatgtgctcattctaggcacaatctcacagtttgtcctgatgtcttaccttgagggggtgtgggcaatgattcttgtgcccaatgcaaagagatgccctgatgattagtgtaaggtggccaatcctgatgaccaggttcagacatccagagcctgccagccagcaaatcaggccctacattttctccctctccattttttcctttcctttccagaagcggtcagcttctagaagccacccacagtggcctctacaaataagatgttacttctgaagtaagatcattgtcttccttccgataccctctgacgaaacctctgaaggtgaaacactagcagaggctgaaaagtcatgatcacctgctggtaatgccccacaaaggcacggaggacacacgtgctgagcagtacctgatgcagcagcctctggagataagactttccccagaatccccaaattctcacgtacacggcatcgtccatgactctgacagtcatattgatgacagatacgaaaaaacatggtcgttggtatcatagaggaaactacataaatgtaaatgcataaagggaagtcgagtgtgactccctttcttaattgtctaacgcaattcccactagatgcataaattgcagttcctattaacggcactatgaataataatcggtttactttctgacttgtatctaaatatactttctatatgatttcatcttttattcagctgtttaaaagcagaacatctaattacagttcctattagtcaacattaattttttttctttttgccatggagcatgtgtgatgactgattttctaaaaacagaattctttagcatatggaacaaatcgtgttattattaatgcattcccagatgactctgcatatcaattctcttaattatttagtcattgctgattatgtctttttataattcattaccctatttctcgcagtgcaggcattttattcattaagtgtcaaaatgaagggcttgacctccaaaaaaaaaaagataatcaggaaataccgacacagttttacaagtctgcgcttcccttctggaacattttcatgctgtgtgataacatgctttaaacaacttttccaaggacatcagtaggtacacatgacagggttgcaggcagaggttggagggacgtcgagcaggggaggctgtggagttgctcacacgaggtttttctaaagatgagacggcaccagttccaactacagctcaatcacactgccatgttctcattctaaacaaaaatgccatttgtgtaatagatttttataccagttttattcaaaagctaacaggatgcttccaaaagagctctttaagtagtagtactgggaagtctaggataagaaacatttactaaattaaaagaggactaggtcttaataagaattcactttgccttcaggctgatcctactgaagttatgaaacctgacctggagtacataacaaggcctgtgtactacgatcctcatgctcatgttggctcattatttcagtgaggtctgtgcaccttgtctgagaccaaattcattacttagaaaaggcaaataaaaaatatgaaaaagaatcaaggaagctgagactgtgaggagattaaaggagaacaaacacacctacttctacctggttagagccttctctgtatctaagatgtcagcttcacacagatggaattttgggaagaatctccccaggcttcctcaacaactctgctttatttgtaacctagatggtagccactacagtagcaaagatcacagtcacatagaacaaaacagttcacctgtttataaagtgcaccttccagctaaacacatggctgctgaccctaccaagttgagtactactgagcaagttgttctaatgaaacccattctgtctgttttctgactaagagcaaacaatagatgccaaatactcaaagaaggggtgtacctaggcacagccaaccttgcaatggaggggtccaagaagagtgttatgaccttcagctcaatacccacctgagggtctacaagggttgaagctgaagaggccaagaaagaaactttcttgggggaaagttgctgtagtatgtggcatttttcctcccctatctgtagtgggtaaggggatgacagatatttctttctcacctctagcctaagtaaaagagcttctaatcacacaaaccaccaccaccaccaccaccaccaccctcaaaggactttatatttgttctgggggcttggggataactaactgaagcctgaaaaagcccacaggggaaaggcaactgaatggcctgagatatagcacagaagggtatactggatgtgaactgcactcccacctacagagagacaaaatatactactgcatgcagaagctgagttggagcacgcatagggaaggaagggcaggtcctggggaagattgaaagggaggcactaccttcatcaagggagctacagcttgacattcacatggggaaaatctttctggaaccatgaaaacatcccacaagaaaaagaaccctccaatctccaatgccagctcacaggaatagccaagtaagattgttccagccccttaccactcttttatcacactagctccggctcctggaggagccagggccccagctaaaaaataaaagaaggagaaatacaaggcagtggaagagagaaggggcaaccatgtccctccacccctcccaggattacagcccaaagaaggcccaaggtggaggaaggaaaaacttgaagtttagagctttgactatgccatatgatttggcattttaattatacttttttttttttttgagatggagtctcactctgtcacccaggatggagtgcagtggcgtgatcttggctcactgcaacctctgtctcccaggttcaagtgattctcatgccttagcctcccaagtagctgggattacaggcgtgtaccatcccccccggctgatttttgtattaaaatgacacatttttgtcactaagagtgactggagaacttttttattatataacaatgtctagaaacaccatggaagctatgagatttcatccaggggcaggggaggaagtagcccacaaaaaaggtctagagagacaatgagaagaaaaatagagttgctttatgatcatgaattgttcagtcttattccttggatgtatcagttgcattttttattatagcaaaatataacaaaattttaccactgtaaccatttctaggtgtacagttcagtttaagtatgttcacactgttgtacgaccagcaccaccatccatctgtagaacttctccatcttcccaaactgaaactccatactcattaaacaatatgtaatgattgcattttaatgagcaaatagaagaattcagcacaagtcccggctcctgcctttggcacttactccatgctgctgctgctgttttacttttacttattcaatttctgatgctcttattttctttgtgtagatctgactttctgactatatcatattccttctgcctaaaaaattgcctccaacattacttgtagagtatgtccactagcaattaattccctcagtttttgtttgagaaagtatttctccttaacgtctgaagcatatttttgctgtgcatagaattctgggttgagagttttttttttttttcctctttcagcatgttaaagatgtcaccccactgttttcttgcttgttagtttctgacaagaagtccgctgtactacttatcctggttccttctctctctctctctctctctgtgtgtgtgtgtgtacatggatatttaccttgcaaggtatcctcttgagtttgagcttctggggtatgtggtttggtgtctgtcactaattttggaaaattcttggcccttatttcttctgccctgctgtctttattttcccctctgtgattccagttacatgaatgttaccatttgatattatccaataggtcttggatgatctgttctttttttttttttttaaatctcattgcatttcagtttgggtaactttggttgacttatcttcatgctcactgattgttcaatgatgtccagtctattgatgaactcattaaatgcattctttatctctgttttccattttaaaaattttttatttggctctctcttgtagtttccatctctttggcgacatggcctatataatcttgcatgctgtttaccttctccataagagccattaacatattgattgtagccatttaaattctttgtctgagagttctaacatctgtgtcaaatctaattctacttctgatgactgctttatcccttcagactgttatttcttgctgttttgtaagtcttgtaattttttgttgaaagccaaacatgtcatctaggacagtggattccaggtaagcacattgcatgcttggagatgaggatgccttcctcctctgttagttcttcagtgtggaggtttctgttaatgtggtcaggagtctagttgtttgtgaagactgctatctgcttggctatgagtgtccctccttggctttgggtctccctttgcatggttctccaagttgtattccactgttattcttctcaaagcttgttagtgtggtggttggagagtggaggagagaagatggtatctgatgttccgattaagcctcagcctcaggtaggcactctgaacaagagtcttggtggtgtgtccttcacaagtgttcctgagctttctccagatataccgtaatgttaggtagcacacattcctgccccttccccatgggtagagttttttgtgttcttcttttctcctcctctgggtacagtgagtttccaccaggaacctcaggatacattttggttgcccttcctcctgtagattagggcatttgtttcttaggaatgacagggaatatgattctgagttgaatattgctagtggttgccattcttcttccccttctctagagggatccaccagtgccctcaggctgcagttctgtatccttcctgaagattaatgttctagtcagtaggagagatgaaggacatgggttcagctagaggttctgcagtggctgctgttcaacttcctcggtcaagaccacaggaaaggcttctcgagattctcccaggtcttcccttggggcacctggcagaggagacgcctacaacaaagtacaaacctccccgggtctgccaccctctcctgcgagcccatgttcagcctttagcaatttgtttaaagtttctagccagatcttcttactggctcatacggtcttgtgtggtgttccccatgtaagcaaatgtccaagtcctgcttcttcctgacacgtctatctctcttcatatttcagactgttgttttccatgctatttcagatctcccaaaggagttttctgtttctttggctttttttcctgttctaagagggggattactgctccttccagattactgcctttagctctgagttgaaatattgctgagtttttattttgttttgtttttagagatggagtcttactatgttgctcaggctggctttgaactcctaggttcaagcaatctttccacctaagcctcccgagtagctgggactacaggtgcatgccacggtgcccagcctgttgctgttttatcagcactttaccaagttgtgtgcaatctttaatctctgagctaaacaactagcctgggtcaagcacatgttgcagcttccattgtcggagaagaaaatgagttagaaaacttattactgtatttactacattgaatatgcatgaccaatccttcattttcaagtaatcacagtgtcattataaactctaaattcactcagaagtgacttcttatcagaagtaaaaaaacaaagtttataattttagatgcctttgccttcttatgaagacatatgcagaattccatctctgactcgtttctggaccctggaaataactggctttttatagcaataactcaagggactgaatataatttaaaagtaatatacccaatacaggttgagcataccaaattccaaatttcaaaatccaaaatctgaaatactccaaaatctgaaagtttttgagcaccaacatgatgctcaaaggaaatgtttattgtagcatttaggattttagatttgggatgttcaactggtataatgcaaatattccaaaatccaaaatctaaaacacttacactcccaagcatttcagataagagatactcaaatcattaaagtacttattgagactattaggtgggtgctacaaaatcatttcccgacagaaatgtagggaatctcattctaatcaaattaaaactgtacatcaatgaaaaatacaacgttgaaaccgacaatccttcatccatggtaaatgaatgtcaatcaatttcccctcctgtgtctttgtttaaacgtctatgtaaagtctggagattttctgagcctatctctttggcaactcccactattttaattcacagtcctttcaagtccaagcaaatttctgagtttcacattgctctcctagttggataaatctttatatagaaagcacttacatttcagtaggagggtttagtcatttgtcaataaatgagatagctggttcaagcaatctaccaagtttatttctatgtgaaaatactgctagaagttagcaggtatacatgatctacatgattttaaattctttgtgaattctcaaaataaatctttagaaatatagtatactagaacatgtattataaaaattactttgcctgggtaatctaattcatcattgggcatacttagtatagccatatatacatacttataaacacaacttacaggtataagttgacataaatgaacataaactgacaatcaactaagaaggcaaagacatttaaataagcacattgtatttaaagagataaaaagctatcaactacctatcaaatgaatgttccaccagggggtgtagtatgcatttattatgtctgcagccaatttacctggcgtatgcacctaaaaacagttgaacaaaaagtatatttttgtagaatgatttatgacgtcccactggctttcatttttattccaaggaagctttgtctgtatattttattgcttttcaattaaatccaaagttatttccaacacttttggttttcaaattaaagctaagttgtaaagaaaactgtaaacaaatatctagattcttcagggaagtctgctattaatgctagattaattctttcctatagccaagaatcttttagcaaagcaattgtttcttagcgttaaatacaatctcacaaatattctacaaatggattttataggttgagatttcctttaagtaaagctcgtcgctaatgaatctggaaatattcagttattttaacaagaataatagcagctaacagtcattagtcccaaaataaagtgtttccttcaatctcagatttacaaaattggtttacctccacaaccacatttgatgaatgaaaacattttattagatatgttgattcactaagatgtgcgtattcacaaatttatccagcaatagatgtaacaagcatatgaaataataaatgagaacagtagcttttttccttgcaaaatgtacactctactgacatctatattgggtcagcatcacccagccactaagcaccaaagctgttgttgaacgcaggagtggctgatgctaaggctcaagctctggtgaaaacccacactgtgtggtcaggggagccggagcttctgccactgggaaactcttggtttctcctgactctccatctttaccttccccctcctggggaagaggacagccttgcctgttgttgctcttactgggggtaatgtgggaaggatgcctccaccaggaggtgccagtcatcatagagctccatggaaggcagcacagcacaggcggatgcaaaaagaatccaacatttcgagatgcattattcagtaactaggttacacatgaatacacactcaagatcaatttgtaaggaactatcaaaggcacagtcatgcatcgcttgacaacagggattcattctgagaaatgcgttgttgggtgaattcgtcgttgtgcaagcatcatagagtgcacttacacaaacctgggtggcacagcctgctacacacctagcctatatggtatggcctattgctcatagcctacaaaactgtgcagcatgttactgtactcaatactgtaggcaactgtaacacccctgcaacacacgggtaagtatgttgtgtatctgaacataccgaaacatagaaaaggtgcagtaaaaatacagcataaaaggttgaaaatggtccatctgtatagggctttttccatgaatggagtttgaaaaactggaaggtgctctgggtgagtcagtgagtgagtgctgagtgaaatgtgaaggcctaggacattaccgtacactactgtagactttataaacactatgcacttaagctacactaaattaataaaaatatttttctttcttcaataataagttaaccttagcttgctgcaccatttttactttatgaacttttaaagtttcttaactttttgactcttttgtaataacacttaaaacacaaacacattgtacaacacattgtacaaaaaagtctatatcctcttctgtgacctttttcctatttttaaggtttttaaatttttttcttacttttaaaacttttttgtcaaaattaagtcacaaacatacatattagcctaggcccacacagggccaggatcatcaatatcactgtcttctcctccacatctttttttttttttttttttttggatagagtctcactccgtcccccagactggagtccagtggcgcaatcttggctcactgcaacctctgcctcccaggttcaagcaattctcctgcctcagcctcctgagtagctgggattacaggtgcacgccaccatgcctgtctgatttttgtatttttagtacagacggcgtttcctcatgttggccaggctggtctccagctcctgatgtcaagtgatctgcccgtcttggcctcccaaagtgctgcaatcacaggcttgagccactacatctggcctcccctacatcttttcccactggaaggtcttcaagggcaattatatgcatgaagttgtcatctcctaggacaacaatgccatcttctggaacacctctggaaggatctgcctgaggctgttttacaggtaactttttaatatataagcagaaggaatatgctctaaaataacaataaaaattatagtatagtccaggggtatccaatgttttggcttccctgggtatactggaagaagaacaaaattgtcttgggtcacatataaaatacactaacactaacaatagctgatgagctaaaaaaaagaaaaaaagaaaaaaagaaaataaaaaggtccgtgcataaaactcatgttttaaaaaagtttacgaatttttgttgggccgcattcaaagccgtcctgggctgcatgcagcccgcagattggaccagcttggtatagtcaatacataaaccagtgacacaatcgctccttgtcattctcaactgttctgtattggacatacctgtatgtgctgggcttttatccgactggaagcacagtaggtttgccgacactaacatcaccacaggcagtgagtaatgccttgtgctatgacctcgtgatgaccaaaacattgttatgcggcacatgactatttctaagctcactagggcccctcgtgtcacacaacaggcatttgagagcctcagtctaacttctcacaagcaatctgcagcttctcaccaatgaagaaacaaaggcagccagggcacaacctttcatttccccaaggctgtgagaaagaggtggtataaacacaagtcttgtgtccccaaaagaagaatttattccttcttacattttggaaatattgatattttaaaaaaattactctgtgtgattttaggaatgtgagctgggctctgggaggcctgagtttaaactccgtctcttactcgctgtgttaacctctctgcatctcagtttccttctctgtaagacaagatgacgtcacaagacgcttcatatccctgcgcctcaaagaaaggcagtcatcacgcaatactgacttaatgggcccttcatcattttttggggataagaggtccaagacacatcttttgtgggaagatgagttttcccagtgatgctaagacactgggggatgggggtggaggtcaggttgggggtgggtttggggtagggaggtggaggcacacattaaaaaaaattgccaaaccaaatttattgctgatctcattttctcagcatttcttctacattcatcaaatattttagccactgccttttcatttcattttcctccagttgcacgtgctttgcttttgatgtggcacacactttgaaaatacattattaaacagatgagcctgtcacccctggagctggcactctgtcccctgcttattcttaacaaatctctctttgtgttcttttgtgctgaagtgattaatcatttccactatccaagggctgctgacaatctttctagatggctccgctgccatgacccctccccgcatccacacagtttgaaacatgctaggaatctgctgctgttcccggggctttattcccatcacagtgggctcctcatccatacggtaactagccaacctccaaaagagctccgcttttatttcttgcctttttccagagttcggggtgggggtgtgcgtgaaggggctcctggcgacttcagcaggaaaacaaggaaactgtaagttaaaaagtcagaatgataaatgcttattttgtagaccagacaggaggtttttatctcactgtctggacagaacctgctgcacctcatttttctgggcagtatcctcctcttcactgcactgtggctgggttttcttctccccttcatgctttccctctggttatctgtaacaaagttttcaaatggctccatattgaaagcccaggctttgactcaccaggctctcaatctgtaatctggtttccagagctgcagcctaggtaggttttgggaagttgatctttttttaataagtgtttacaaacatttttaaactaactttaaaggtactattttaaaagcctatccttccccaaccccccgcccgccccaagcatgcactgttaaactgaattcaaaaacatgttcaaagaactgaccaaaaataccattaggtcacaagttactgccagagaagggaaagctacaatgattcagaaagtattaataaatgtgcagaaataagtattctgataatgttaaggtaattagcatagaatcccagggtgatttttaaaaataatatgtactttacatgtagaaataaatctatatttgagactattgaaaagatatttacaagcacttgaggaatagttttaaattaatacattataagtgtaaaataagcatgctgatcatatgattttaactaggtttcagaaatgtaattactgttcatagaaagatacttaaaaaaatgagtagtcatatgttctttgcagtgctattcacagtagcaaagacatggaatcagtctccatgcccttcaacagtggactggagaaagaaaacgtggcacgtgtacaccatggaatactacgcagccacacaaaagaatgaaattctgtcccttgcggcaacgtggatggagctggaggccattatccttagtgaattaatgcaggaacagaaaataaaataccaggttctcactcataagtaggtgctagacactgactacacagagacatcaggatgggagcgatagacaccggggactaccaaacggcaggggctgaaaaaccaccgatcggatatacccaggctcactacctagatgaggggatcacttgtaccccaaacctcagcatcatgcaatatacccatgtaacaaacatgccatgtaccccccaatctaaaataagattaaaattattaaaaaagaatataaaatccttttttttttttgagatggagtttcactcttgttgcccaggctggagtgcagtggtgcgatctcggctcgccgcaacctccacatccagggttcaagtgattctcctgcctcagcctccccagtagctgggattacaggcatgcaccaccatgcccagctaattttgtgtgtttagtagagacagggtttctccatgttggtcaggctggtcttaaactcccaacctcaggtgatccacctgccttggcctcccaaagtgctgggattacaggtgtgagccacagcacccagcccaaaatccttaatatttttaattccacagaaccacagatctctaattgtttgaagtcacaataaaaaaggcactaaaataaaaacttactaaccaaaaactgcaataataaagaatgaactgcccataggatataacttttataactttctaaggaatccaggggagagagaaatacacacacttgcatacataggtgtaccttattagtgtgtgtatgggagttatgataaataaaatatatcagctagtgctagcatatgataattcctttcaaacctagtatctggagacacatgaagaggtccacctaccctgagctgtcatcagaaactgaagctgcttaggaacgtagtgctggcagagggagggtctctagagtgtggaggtgctgcacacggcacttttctagaatttctgaggtacaagtgggcccaggaatggagttctgggccaatgaaataatggctcatgttcaaaaaacagttaatttaggagtctaaacaaccccagcggtgggttagcgattgtgaaattatgggctgtgtggactgcttccaaaatcagaacaaaacaacatgcaaataaatatgggagcatgctggaagagttctggaaataggtctgagttccaaccctgcattttcccaatacttacattccactgaatccaatgagcataaaaacaaagaatggcacatccacacatcagatttatcagaacgtataaaacgatggataaatgcaatggcaaaggagaaattaggtttctgaggttttttaggttataatgaactaaatgattacaagactataaaaaggtaattatgtcttatttaaaatatatgattattatctagatagatgttctaatttttcaaggcttatattgctttcatcctcaaatgatcattttctaccttagaaattattttctaagatctgtgtgtgtacaatagtaatttgcagcaaatcagtgtaatttcacaacccttaatttgaaaaaataacagaggacactgtatgtgattttcatgataataaatacaaatttaaaatgtatgtttcgagttgatcactttggatagatgtgttttaattgttccaagaactgctttacacagagcatattagcagtggaaacagttttgacttccagcccttgattctaccagcagcaacatggtaattaaccaaattatccctgcaaatgtattagcttgatttcttcaacttgtaaaaattcattacctatcaaaatgaaaggcttagtctcatgaaagatactcaggataaaagtggcagacacaaaaagtctgagttttctgacacacactttagcaggagctgctgcactccctcctgtttctagccctcaggggttagcatgtgaattttcttctctcttgcatttgtgccaattgtacaatgtgttctaatgcttccaggtagcacaacagtcttggcagtccttggagagctcatgttttaggggatggtaccttgaaccatttgcttcaggactagaaggacaaaagggtgaagagcaagaggtcaaaatcattcattcattattcttcatccatttattcacttaaaaaatttttttttaattttttgagatggagtctcactctcttacccaggctgcagtgcagtggtgtgatttcggcttactacaacctctgcctcccaggttcaggtgactctcatgcctcagcctcctgagtagctgggattacagtcccccgccaccatgcccagctaatttttgtatttttagtagtgacggggtttcaccatgttggccaggctggtctcgacctcctgaccacaggtgatccacctgcctcggcctcccaaatgctgggattacaggcgtgagccaccccatctggccatttattcactttttattaaacatcaactaagtgccggtcatcgtgctcacccctggaggtagataacaacagcccaggagaaaataagaaagaccattacatattaagtattgtaataagaataaagtgtaactggcagacatggaagaggaacctctaactcagactttgggaatcacaaaggcttcctggagggagtgacatctctagtgaggcttggaagatatgcaggagtcggtcagctaaatgtgtggtcaggggtaggcagagcatgtgccggggtggggaagagcatgagttgcgcccagaggtgatggtgagagcagtggttacgcctgcagaagtgcagcatggagtgtgaggggcaacgtggtgaaagatgagtctggaagcatacgcacggccacagcatgtgcgactctgcaaaccacgtctgggggtctctggcctgactctatcctgaactcaggggagagccacgaacaggtttccagcaaacctatgctttggaaagtggattctgcctccattgtggagactagtgggaggcagagggctggcaagcaggtctctggagtcatgtaggaaaaggatggtggatgaacaaggagatagctggaggtaaagagaagtggacccaccggagggagacagagctgacaggcttggtgaggaactgaacatggtgagtgtgagggagaagaagaacccaacagcatggacagccggggaatgaagataatccaagctgcaggaaaagccggcagaggtgtgagatgagttaaggtgcaggtgtccatgacacatctaagtggagcaatctggtggccgctgggcaggtgacagaagttcaggaaacagagctgtgtttgagacacacttgagacccatccccacacagatgttaccagacaccatggaagtacagcatctaagtagagaagagtcaggatgggaccctgaggaacaccaacatcaagggggacttacaggaagacaggtccacgtaggagacccaggagaaaggaccacaaagtgggtgaacccaggagggtgtgacagagacaccaagggcatgagcattttcacgtggatcctgcagtcagcaacatcaaatgcctgccagagatcacatggggaaatgctctctgtacttctgataagcaagcctggggtggtaacctcagtaaaagccatttcaggaaggaaggtggtgggagagatggcagttggttgaaggggaaatgaaagtgaagacacagagagactttggtctggagagtctagttaggaaggaagaaagagctgcaagcaatgtagcactgaagatatatatatatatatgtatatatatacacacacatacatatatacacatatatatatgtacacacacatacgatggaaagaatctgtatgtgtttactgagaatgagatgccagcagagaggcagaggttagaagagggcagagagaggaggtgctcactcctgtgctggcttcagtagtgcctgtttcactcacccttgtacccccagcgccgagaacagagcctggaacagtgactgtctgatgccactggcccaggggtgctcattggatggcatccatctctctggggacagagaaggtgaagcgtctgcggagggtgacgaggacagtgacaaggaggtgctggtgtcacaggtgtgcagcaagcagggatggtctaagccaggcattcccaatgggcaccttacaaaattggttcttggggatgagaaaaccttactctgtgtataaagcacagactcacataccatgtacaaacagacatgcggtatctctgtggtattagaatttcatttgggaacaattgggagaaaagtgtcttaaaggttcctgagggggttgataaagtcaatggtaaaatgactgaaggatactcttcaagtcagtaatgctggtgaacattgcattgatggtgagctccagcggggaataagttacccttcaaggaagagagcatagtttggttactgtgatcctgccctggcagtgagatccagcataaagcagacgtcgcaaccggctggctgcctggaggggtccgcgatccagacctccagcactggctgctggagagaagcagcctggactccaacctgtcagtcctggagcaagtcaggagcagtgcagaccagaaagtggacaagcaaggcagcaagcacgaacgtgtagcgagctagcagagaccgccacgagacggacccacttccaaagggggccatgactcagtataacgatcccagccacaggctgaaaccagcaaggcttttggggagaaacactgtagtgcccttagggaatttgatggaggcagtaatgggactgaaaggtctttggtggcttacactcgaggacctgtttgcaagaaccagctgcctgatggaattcctaggtcagagtgaaaagttaaaaatgttgggtagagctgaagttcacagagcccttcatgctagggattttatggcacaagaattacacacacacatcacacacgtacacacattcacattccaaaaatacttttagtagaatcttatttgccttcatattttaagtactaatatcacttcagcagatattttggtgtctctacactaagtcctcacttaatgtcatcaatagggtctttgaaactgaggcttctaagtgaaatgctatataataaaaccagttttaccataggctaattttgatataaacaagagttaagttcctacagcacatttctgatcacaaaaacatcaccgaacttctccataaggtccaaacacttttaatattaaacactgaaaaaatgtgagctatgcatacattaagaaagattaataaaaccagaaaaataccattcaggacataggcatgggcaaagacttcatgactaaaacaccaaaagcaattgtaacaaaagccaaaattgacaaatgggatctaattaaactaaaaagcttctgcacagcaaaagaaactatcatcagagtgaacaggcaacctacaaaatgggagaaaatttttgcaagctacccatctgacaaaggtctaacatccagaatctacaaggaactgaaacgtatttacaagaaaaaaacaaccccatcaaaaagtgggcgaaggatatgaacagacacttctcaaaagaagacatttatgcagccaacaaacatatgaaaaaaagctcatcatcactggtcattagagaaatgcaaatcaaaactacaatgtgatatcatcttaggccagttagaatggagatcattaaaaagtcaggcaacagacgctggcaaggctgtggagaaagaggaatgcttttacactgttgctgggagtataaattatttcaaccattgtggaagacattgtggcgattcctcaaggatctagaaccagaaataccatttgacccagcaatcccattacagggtatatactcaaaggattataaatcactctactataaggacacatgcacaagtatgtttactgcagcactatttacaatagcaaagacttggaaccaacccaaatgctcatcaatgatagactggataaagaaaatgtggcatatatacaccatggaatactatgcagccataaaaaggatgagttcatgtcctttgcagggacatagatgaagccaccattctcagcaaactaacacaagaacagaaaaccaaacactgcatgttctcacttataagtgggagttgaacaatgagaacacatggacacaaggaggggaacatcacacaccagggcctatcagagggtggagggcaagggagggagagcattaggacaaatacctagtgcatgcagggctcaaaacctagatgaccagttgattggtgcagcaaaccaacatggtacatgcatacctatgtaacaaacctgcacattctgcacatgtatcccagagcttaaagtaaaaaaaaaataaaaataaaaataaaaaaacaagaaaccaagtaagataattacttacaccattctaggtgaatcagtgagtgactgcagttgcagtggtggtggtttccatcaaagaataaatgtctgcaaagcaaaaattgtaaggagcacctcctcctgccacgaagtttaaagataatcacgggccaggcccggtggctcatgcctgtaatcccagcactttgggaggccgagacaggtggatcatgtgaggtcaggagttcaagaacagcctggccaacatggtgaaaacccttctgtactaaaaatacaaaaattagctgggtgtggtggcgggtgactgtaacccagctactcgggaggctgaggcaggagaattgcttgaaccaaggaggccgagattgtgccactgtacaccagcctgggtgacagagtgagactttgtctcaaaaaagacaaaaacaaaaacaaaaacaaaataaaacaaagacaatcacaacaggacctgctcacctagtgctttcataccatgctgtttattgttgtgcatctgtatgactattgtagacttgaagatttgtatgttagaatcatttctattcattcattcattttcaggccacttatcctagttcagtggggtgggtggctggagaaaggcaggcaccagccctggccaggatgccagacagcccctggcaaggcacgctcacacacacccacactcactgacactaggactgtgaagacatgccagtgaacctaaagggcacatctttgggatgtgagaggaaactggagtcccagagaaaacccgcacagacttggggacaatgtacaggctccacacatggtggccccggatgggaattgggtttttttctcatcaaccttataacaaaacaaagttgaatgaaatgatgttatttgagcatctgctgtatgcttcttaattagcattctaaaaatccttttaaatgccttaaaatacaataactataaaagtaatcttcagttctcatctccagtaagttttcaaagtctgatgaatacgtatggtgatattaagtatgggaacaagaaagaaaaaataaaattgcattggttctcttaaataaagttaacaaatgacataaaccaggttagctggctagtactgaacactagcatttcactgtcggagaagaacactcaaatgaaacccagattgaaaataagttaagtgtttggggaatttacacatttgaaggtactgatagatactatgatttgacatgtattaaccttttcaactctgtacaattaaaaaacactgcaatcgaaaacctcattcatggataaagataagaatttgcacttattgttctatgtgattcacatttaagcccttattttttgaaaatgctcactaaaatataaagaagaaaaaactataaagatgttatgaaaatgtgaacggactatatggatgacaatgtgtagtccaatggcccacacacatacgaggccagtaaggttgttatctctcagctccaatcccacccttctaccctcttgttttgtgttgctggggctggactctctgcaaaccacctttcaaggacatactgctgttgaaagaagcacacctctatttgttttctcctctgcattcctcctgtaactcactaatcccacccgctcagtgccttctgcatgtggcagctgttcaaaggtactgagtacatctacatttgacgtacttgcgtcagtcctctagtgtagtgctgaagttctccaagtatctccaagaaactatgaaacctttgcataaaatattgacaaacgccccgtgaaaagatattgactgcagtatcagaacccgctttttactgttagggcagaagttataatctcacagacttttagatgcttgggctgctaacatgcccttcatcttctaggcatatggttctgcaaacaactttgtgatttctaatgacgtgcatcaaaatgaaacaggtaagtatcaaagggcgaagctgttcattctcaacaggagcttctggacttccagtattcctttacccatcaccccaaagcctccgggctcagaacagattctgaattaaggtggtctcttgtcccacctctgctagaaaatgaacacctccagagtcactgccaagtccacagattgtagtcacagggccctgcaacatagtggcaagctgttggccacagcttgcaggcaccagggtgcccttagcaggtagaagtggagccctttaggaagggcttttggtttcaccccaaaggattagcataatagcatttatgaacaattaatctcacagatataaaatgagatataaaagtgtggtatttctgtccctaaccgttcagatggctaaatgcaaaacgaaaacacaggactaccaagtcaactaacttatcttggctagacttattgtaggtttttctcagtgaatttctctagccctccatcgggctgacttttgttttgagtttattttgctacagcaagtaatgggatatattaatggcgcacctctacagttacacctggattgattttgccattggtgggcttcatttcatcactaatgatgaaatctttgctcttggaaacaaatgaaataacttataaaggaaacagtatgagctagaaaaaaaagcctgcctggtctgaagcagggaagatttgacctaggtccagctctgcaaatgacccaaataggtcactgaaaacaagttatctctttgttctctaccttccagtaggcagagaatggcaagtatgttttcatttgattgacatttgtgagcacaaggcttctcttgtcccaccatccggggtctgtacatgtgaggggctatcatgatgtgcatttcccaagtcagtgccctcaactcacaaatctcccaggaccacaactggaaatcatcccatccaggatgctcctgagtttctggaaaaccaaggaaaaaatgagttccctttatttgcctcaagtttgttccactataatgtcaggaaactggctgaggtctccaaaatttaaacaagtactacttacccccttcagataaacagaaaatgcaactctatgtaaatattccttaagaatattttgcagcacactggaattaaattagtgctaaagatgatgagagcaagaaagtaatctgctcagatgttacactgaaattgtctctaaattcattccttaagtccaaaccagaatctcaaacactgatctcttattacaaaggcactctatgttatgagtgtcttcaacaaatgccatgtaaagctgtcttgcataaaaactgtacatcctagattccagcccagcacccccacccattaagttataaaccaattttatttgctgaacaaatgttaatgccattctacgttaatggataatgctatgaaaagcacctaagtattacagcactggaacatttaaggataaaatagagtgtaacttggaaaactgcctgttacaaacatatgtcagccatgaagccttctagccctgatcgcccatcctcacagaactctgttttaatttctccctcagttaagagaattttgcaataacacacagatttattaggtcccaggaataaaactctcggagtaaggataaaaaataattatatgttagaacacaacgtaatattcaaatgacttgaaaacagtcacctcagcaaaaataaggagagaggaagaagttaaagatgaggttgataacactggctataaaacctctgaatttaagtgcataaatgcatgatctggcacttccgaatcataaacaggtagaaacgggaaacctcccattcacaatgaattgcctgactggtttcgttaatgagccagggggacgtcttcatctagtaagtcagtacaatgttaagagaggttgctgtgcaaggcgtcttcattagaatcccagctctaccacttgctagctgtgtgaccttgggcaagttgtgtttaacttctcttcacttcagtttcctcatctgtaaaatgggaatgttaccaatgcctacctcatgaagcagctgtgagggttaaatcacagcttagaactgtgcctcacacataatgcatcctcagtcaacgtcagctcttcatcacttggtggttgttattgtatgagggacgtattgcaattggaaagggagctgaagggaagttacagcctttcctcccaagaagtctctaaattcactgactgcattttctgttttctcgagtttggcttctgccccctctactccaccaaaagggcacttgcaaaggtcaccagcaacgtttctgtggtctaatccattgtgtggttttagatcctcatctttctcgtcctctcagaaactctgaacaccactgagcttgaatctcattccttggattccatgacttttcactgtcataattttcccttcacttttcttgtcactctctctcacttccacttgccagcggctattccttcccttagtctctaaaagtcagaatttagattctcaatgttcctcggtctccagtctctctccagaaaaatttacctatttctacggtgttattaccaatggcatgctaattaatccaaaatgttggtccaacacctcagacctctgctctgacctcctgacctccaatatgttgttctatgttctctgtgtttacttgaatgtcccaaaggcacgccaaactcaccatgctcaaaaatgaatttatgatttccgcccttcccgcaaaccaggatcttccctaatgtttcccatggccgtaagcgcaccaccaagcatctctgggctggactcctgcaatagcctcccactccctcttgcttctccttttcccggtggatccctctccatagcagccagagtggtgcatttaaactgctaatgtgatcacatcactctgctcaaatgctcagctgatccgcatcttataggatctacgacctagctctgtctgcctctcctgcttagctttatctacctgctcaccaactattctgcctttccctctccttggagccacaatcttggaggaagcctggtgtgtcacagatacacaataaatactatgggcggtaaccaagagtcctggtgcttgcgtttggaggtgaagaggggtagaggatcttggagaatgactaatgtcagtgaggcaggcatagacagaaagccattccaggaaacactgggaacactaatgcgatcccctaggagctccccaaataccaactactactactaacgccttaggctgacaagtagggagagagagtaaaaagctccaggctcaactagcgccaccatcatctctctttcctcctcgtccatcccacctcccctcctgactgctgctcataggctaggaagagtggaatttggagctcagttgcctcctaatccagccaccacctccactgccctctcgcacacacatgcagacttcagccttgcatatggacacaaatctgtgatccggtgggtccacgttctctctttgtttcaggcctcatccaaagagtgttgtggcacaggtgcagcactggcggtgggagggaggggaggactggggcgagaggggcatgaggctctcatcagctctctttagaaaacaataactataaagctgaatgagcttttgattgtgacactcagttttattcaaattgaattttgctttacctaaactctatccttttggtgtgtgaattactcaagtctttattcaaacttcaagccttgtatggagaacagaataggaaggtcaaaggatggatttcttccatatcctcagaagggccaagagagaataagaaggtagactttttctacttagggaaaccaaagaggggattggtgtgttctagtattatccttttgtggacataaacactataaccagttaaaggaagatggcttaaaaatggaatatgtgaactgcaaatatgaaagtatgttgaaagagaaaaataggaaaagttatatcagcatcttaggttgattgttctttaactggaaacaaagccccagaatagagacaatatagatataaaatatactatgtattttatttaacatatacttatataccagaaatgaagctgcctgttttgacaattgctttctctataaatctctgccagaaaaaaaatcattatgaattcaacaaatcacatctcaattagttattctggtcaacttgagacttagatttatttatgaaataatgctttccagaaagaaaaacatctggccttttaaaatagttgttaatgtaaaattttaacccaagtaattgtattactgtaactcactagcaattaaaaaaaagtgtgtaggatatccaaaagaaaggaccatattaaattaaaataaagtgtttttttttttacagtaaaattcataccatctggcctaatttgtcttggtgttttgcccagtgtagtatcagctttttgagaactataaattattaggtaactcccctgaaaaaatatgagtgaagaaaaaatatgggttgatgacgacatcctgattatatgtctgaatatttgggaaaacactgatgtggtggaacagcccaacctaagtcaatctgggcacgaaactggttcagggagggaacccacactagacacaacggtgatgaaaaggacgggctcacagagggtgacagggaaaataacatgtgaaacaatagagaaataacagttccagatcctgaacattacctctttgtcaagtgcttctgattccaattaagtttacaggaaaaataaccaggcaacccctgcctgactcaaaaaaatgtacagactattaaaggatgcttttaaatagcagggtgataaatggggcatccacatgtgagcaccagcatatttttcatctaaattctgttcttctgtcttccagctgatcactttaatagggtgtcacctcagcctgtgcagaggtgcccagagggggtgcagctcctagattgttaacagaagtgttgtttcaaaaacttatgtgactactctcagaaaaggtaaatgtcaaaccacagactatgggctcctttatcatggagccgcaggtttcctttctatttagagtctatgtcccacagattgataagactgtttaaagaataatcttacccggattatttcttcaacacagctgttggtttctccagatctactctcctgaaagcaaagaaaaaaaaattaagcctgatggaatagattgatgaccacacagaagacatgcaaggttccaaattagtcccccccaacaaaaaaattcagcgagttacaggttgaggggatgcctgacctgggactggcagacaggctcctttccctaacagccggctcccattgtggctgctgctcccccttctctggctggagcaccacacacgcaccccagaggctcaactgtggcccctccaaccaccctactttaagtggggtgggctcctaggggtacagaacgtgacctgcaggtatgagctccatccaccttgggtgccattaacgtgtggaaactgtggcctccgctacaacagtggatccaatttatccaccaaatatatgccgtgggcctaccaagtaccacaatggttgctacggcttaagtaaaagtctggtagttccaccgtcctcaaagccttggtttactggtttgataggcagaaaactgaaagaccaaaaagagaaacatcctctggatgttggactggcatgtggggcgtcacgctcaagtcacttgttctgtcactcagcctgccctgtgctgtgcagatgttccgaggtgcagtggcttcaggtcacagccgactctggggagcattttaagttccagagatgctgtgtgggtcctgctggctacacagccaagagtgcaggatgtgggtttgtggggacacagaagcagtggacgctggtgaaagtgcctacctgtggtctcagggagatcacttctcttcgtcctgcaattcaaggatgtcaacctgagagtagatgtcactgtgacatcctggaatgaggcttttctccacagtctcttctccaaggccactctcccttcctcctcactgttctctctctaccaagaatgctatctgcacctttcctggtttttctagttaatttcctagttaattcctagttaagtcatccttcgaacagcagcttatccacagcttcctccgagcagccaccctgaccctagagtgcttgcccccagcagcctccacttcttcaaagccctcaccacgacggcaattcaatagtgaagtctccagcaatatctcctccctctaaaacatcagctccctggattccagggctccctgtcttccagcaccgtgctccacacagcatggggcacccccaataactattggctggtggtaggtgtatgaataaatgaatgagtttacttcctgcagttctgaggggcatgaggctcatcagaatcagcactaggactttaaaaaatattatgaaggctctaccagtgaccgttccatcacactctccatgccctgtgtctgccagctcattccttgtcctggggtagagcatttcctttgaaacactctacccttcacttgagttaggcgccaggctgaaggaaggtatgtgaggcttgaaaaggtcacacacatgattgagaccttctcctacccagaattaggggatttatccaagtctcccacctgaggcccagaaagtttacacaacttgccgaaggccacacagagttaccatatggtaatctctgttttaacttttttttttgagaccgagtttcgctcttgttgcccaggctggagtgcaatggcgcgaccttggattactgcaacctctacctcctgggttcaggcgattcttctgcctcagcctctcgagtagctgggattacaggctcccaccaccatgcccagctaatttttgtatttttagtagagatggggtttcaccatcttggccaggctggtctcaaactcctgacttcaggtgatcccctcgcctcggcctcccaaagtgctgggattacaggcatgagccaccgtgcctggcctgttttaactttttgaggaactgtcaaattgttttccacattggctgtaccattttacattcccaccatcaatgcatgaggattctaatttctccacattttcaccaatacttgctattttactctactttataatagctatcctagtggataagaaatgatgtctcattgtggctttgatctgcattttcttttttttctttctttcttttttttttttgagacggagcctcgctctgtcacccaggctggagtgcagtggcgcgatattggctcactgcaagctccgcctcccaggttcaagtgattctctggcctcagtcacccgagtagctgaaactacaggcatgtatcaccatgcccggctaatttttttatttttagtagagttggggtttcactatgttagccaggctggtcttgaactcctgaccttgtgatctgtccgcctcagcctcccaaagtgctgggattacaggcgtgagccaccagatctgcattttcttaatgactaatgatgctgagcatcttgtgtttactgaacatttgtttatcttctttggagaaatgtttattcaagcactttgcccatgttgtaattgggttgcctttttattgttttattataggagtgctttgtatattctggatatcagaagactcttagcagatatatgatttacaaatattttgttccattctttgggttgttttttcacgctcttggtagtgttcatggatgcacaaaactttaattttgatgaagtccaatttacccgtttttttcttctgctgtttgagcttttgagtatcatatctaagaaaccattgctaaattcaagccatgaaaatttccctttatgtttgttttctttcaagagttttacagacagttttagctcttttgtataggtctttgatacaatcgtctgggaacttttaggtgaagtttattttcttgtggattatttggtgaattttcgttaaaacaggaatgttatctttttgcttcattctagtctcatcattaaaagaccaacaacaaaatgtgcaaggcacagccactgctactagtagtgcatgaagacaacatgcactacttggcttatccttataagccaagaaaaatagtgttcaatatcatgacaccaatgctttcactaatacttcacaccctttcctatactcatccttccttctgttttcccaaaagcttcagttggccacatacttattacaagctttcactcccattcccaattccttaccacaggactgctctggaaacatcaccattctgacactctgatacaactggatcagagagctcttttggaacctgatccttttccagggaagcctgaggtgaccatcacaaaggttatataggaaagtctcagtcgggccggggggcttgatggtcacttggaaggatttcctttggcgttcatggtgggaatgagtggtctgaattagaaaatgtaccgtcaaacctacagaatatcattaatcatgactcttatcctacttctaagtcccaaccatttcctactgcataatatgctggcagggcaaatgctgaattctcaatgtgctttctgttttctaccacaaaacaattaatcaagaaaaacttgacctcaggtcctcctggtggaatcacccagatataacagcacactacaaatactcttaaaattaaacttcgggtttaattccttaaagctaagcttccctgaatatcacactttaatttcctttgatgtagtttatataaatgacaggttgcttttataactatctcccttataatcctatacatttcaactattctactctgataaggaaatgcgctgagagagaaatgcaggatagatgccctattagatacttctctcatcactggagacatagatgtaggatctttacactaagtcatctctaaggcagctccaaccagaagccttgatggtctggacagacatcaggtcattccctactaggaaggccctttgtaaagctaaggaggcggcagaggtgaggccagggtgagggacttctaacaacagtctcaggaagtcctggccttaaattacagcatggacagtctttggcagaggaacctcttgagtcttttcagaacactgagaaatgttctggggactcaagaagagtaccacattggtttgaatctccaggaccccatttagattggagtgaatccatgggccacagtatcgtagaaaatctgaatgggaaagaactttggagctcctttcagcccaagtcaatgactttaacagatggagatgccatggctcagagaagtgaagggctctgtccaaaaatcattctgacagcaagacacagttgaggcagaatccactcacatttcaacaccagctcattgagttctctactatctcatgctgtcttcctgcagctcaatccctagagctggctcatgctgaggtaacttgcatgctcacagtatgaaaataaaagaatgcagatagtattggggtaaatttcctcctccttttccacgtggcacattactcagcgcttgatcattgcctctcactagctaatctccaacactacacgtgtagaccaaagggggaagagaggagaggggaagtagagagaaaaagtcaaatctactaccccttctgtgacattaaaaaataaggggtaagggtttgtgtccttagaagtaggaggatggaattccaccttatcttttccaaattacagaaagcgtaggtagataggtagggttggggttgggggatctggggtacgtttaccttcttgaggtctttctcaaatctggtttcagctgcagttgtgtgcttactttgattatatttacattttgaaaactttccatgtttatcaacaagattaaaatatgcatgtaatttacatctccaaattcgtgtttatatttttcacaataaagttattgctttccttggaaaggtacccactgagaaggaaggctgcacaatgcacattttaattactctgtattttttgacggtttgtagctgttgtttcatgctgagttgctgagctgttgctccgtatttactccaactttgaggaacccacctcattttcctatcattacattttgaaatctgtcataacagtctcacctcattgaacctccaactaaacttcaattaagagctagcaaccccagctgattctcctcttctacagcactgtctagcatgtgatttccctaaatcctaccatttaaatgtacatgccgcacactgccaagaaatgtacagaactatgctgtgggtaagtgtagctcggggaatagccaggagcatcccatccctgatggtggaagtccctaattaccatgccaagcacagaatatggggagaagcagggcttaaggaaaaagagtgtgatcaaatcagtgggaaatggtatttcattgcagagatgggctgcacaagtcctcatttttgaaaatagtttaactctttatcacacacatttcaggtggaacttgcattctaaaatactactactttcaaatcacaatgcctttgtttatcttcaagcactcaaaagaccctcaagcatttagaaattgtgtatcccatgtacactcttaaacactcctgcagaaatatttttaaatcaatctattcttgatttatcacaaacctgacatacaaaaagttaggtatgctgtcaataccacaaaagcattggtgagaatctgagctcagatgcagggaccatcataattccatgggaagtccatccctacaactgtgtctcctgccttatctttaaggatagggccacctgtgaacagaggcagacagccagttctctcccaaattcagcctgtctcacacctaacctgtaccatcccctgtcaggggcttcactctgctcccaatccccaagctagaagcccagctgcctctgagcctcctctgatcctcctgtctccaccatcatctatatatgtagatgaggaaaatgcaaaggaaaaatacacaaacagccagggctttaacagagcatcaaaatgagatatgctaggaaaaaggaagagaaatataattattatagttagaagtatttaatccatccctatttttcctaacagacaaaggatacaaaagctcagcttcaatactcaattttagggtccttttaatgtattgtatcaccaagggaaaataagtcaactgtatttatatcagcttacagagtgtttatcataaatccagaaaaactgaaactcactgttattttaaaatcgttaataattatattagttgactataaactaaacagtcaaatctcaatagctcttctgtgtagcagtaaacaatttaaaaatatttaaaaatcccatccataatttaagaaaaataaataaggataacctcaacaagaaatgtttgagatttgtttttaaaacttcagagttagccaggtgtgatggtgtctgtagtctcagctactctggaggctgaggcaggagaatcacttgaacccgggaggtggaggttgcagtgagccaagagtgcaccactgcactccagcctggatgacacagtgagactccatctcaaaaacaagaacaacaacaaccaaaaagaccaaacaaaaaaaaggaaaataaaaaacttctgcgttttactgaaagatacaaaaaaagacctgaaagggactgagctagacttctcagatacctcccaattctggtatatgatataaagccaaatcaatgtacgaagaggagcaaaccacaaactacattaattttaaaaaaattattgaggcaaaattcaagtaacataaaatctaccattttaaagtaaacaattcaggggcatttcgtacattcacaatgttgtaaaccattatcacctctatttggctctgtaatatttccactgtttcaaagtaaaaccctgtaaccaatgcgtaatttctccccattccccatcaatacgagaactattttttcttttctttttttttttttttttttttgagacagagtcttgctctgtctcccaggctagagcacagtggcgccatctcggctcactgcaacctctgcctcccgggttcaagtgattctcctgcctcagcctcctgagcagttgggattacaggcatgcaccaccacaccctaatttttgtatttttagtagagatgatgtttcaccatgttggccaggctggtctcaaactcctgacctcaggtgatctgcccacctcggcctcccaaagtgctgggattacaggcatgagccagcatgcctggcttactttttacaatgattttactgtattaaaacattttacactgcactgaaaagaagaacatgagaaaatgttcatgggtaccatttgcttgtactggtagattttccagtggatgtgctgcctctcatttacgtgtttctgaccagttcctagcagagaactcagtacaacagagcaggcattcgattatatttgttgaatgaataaattaatgaccaatacactaaaaaaaaaaagactatttacaaaatgaaagtcctaaactttataagaataatgccggttatctacattacaaagaaatgtctttgctttatccaaaaactactacaacagcagcaaaccaccaatgttctaaattcttagaacatcaacatttatttacttcattaaaattaggcttatatccattaagtacagaaaccattaacaagtcatttgacttccctaattcccacattggtacctgtaaattagagagtaagtatcagtcttctattagcagacaatattgttaaagagctaataattttctgtcagatatttagcactaggacaaggtatttcaattatgttattatttttatgaacagaaattagcgatctgaatcagagcctatagttaaaagcatatttggttttcagaaagttaagtggtctgtcagtgtgctgacgatgtcaagaacctattgatggcatgaagagatgggagatgagaagcagacagtgatttcatatcctgatgactaattgatattgagtgcttatccatggggtcatgtctcaaaaaagtaccacagtactgtctactggggtcgtctttcacactgctctgtcaacactgggtgaagaaaccatgttacagggcttcccacttgcaacttgacattgataagaatactttaagatttctgtgttctttcacctaaaaccctacgtcgttaattttaccaagaagaagatcacacaggttcaggcaggagtgacaatgctgaagtcatttaatcctcacattacaggcaaacttcagtgagattttgcaaatgtaccatttcctcttgaacattttcctgaatctttattttaattaaattaattaattaatttctttattttgagacggagtcttgctctgttgcctaggctggagtgcagtggtgcgatctcagctcactgcaagctccacctcctgggttcacaccattctcctgcctcagcctcccgagtagctgggactacaggtgcccaccatcacacccggctaattttttgtatttttagtagagacggggtttcaccacgttagccaggatggtctcgatctcctgacctcgtgatccacctgcctcagcctcccaaagtgctgggattacaggcgtgagccaccatactcagcctatgtatttacttttgagacggagtttggctcttgttgcccaggctggagtgcaacggggtgatcttggctcactgcaacctccaccttccaggttcaagtgattctcctgtcccagcctcccgagtagctgggattataggcacccaccaccatgcctggttagtttttgtatttttagtagagacaaggtttcaccatgttggccaggttggtctcgaactcctgacctcaggtgatctgcccgccttggcctcccaaagtgctgggattataggcgtgagccactgcgcctggccgaacattttcctgaatctttatacaattccatttatatgatctaatattctttttttaagggatggcaggaaatgtacacgaaaacacatctgattatcacttatagtcagttttctaatcataaaattctgaacacaaaagcttgcaagacaaacagagtaatctaatgtggctgaagaaactaaccacttaaagatcctacttagcaccactctaatttgtgtcccacagtaagatggataatcaattcccttttagccatgaatggaaatgaccattgtaaatggcaaaagtgctgctgcgtatttgacgatattctatttggcacattctattaattttatttaagcattttgctaaaagagcagactcacaaatcacccttcctatgtcatgttctttatggatctttctctccattatcatctgaccttccccacggggtctcagctcttcctgaccctcagaacagggttcattctgcatactcaacatcagccatttctatgtatgctctctgaggtgatacgctagaaataaatgctgaataaataaatacagctaaaatcagccagagcacaggagagaaggcttatctgagaggtgggagcaggtagcactggaaaacatgagtgagaaactggcactttttttgttggctgctgaggaatttttcaatactccaagttttatatttttaaatcgatctacctacaacaccctattttaaatttatgaacatttatagcattttcattctttttgagacagagtttcgctcgttggccaggctggagtgcaatggcgctatcttggctcactgcaacctccgcctcctgggttccagcaattctcccgcctcagcctccagagtagctgggattacaggcacctgccaccacgcccagataatttttgtattttcaggagaaacggggtttcgccatgttggccaggctggtctcgaactcctgacctttagttcgtgcctgtaatcccagcactttgggaggctgaggtgggtgcattttcattctttattctactggtgttgctttactgttagtcttggaaaatatttgcaggatatgaagagagctattatagtggcaatctattttatcttttcccttctactcccataaaatgttcagagccttgaaaaacaaggtgcgtgtcccagtaaaaggcagagtgagtccttctgcttgtagaacttggggtatctggggctgaactcagatattaatcctcacatgtgtcccctctcgtttttcagagctggcttcagaacgtctcagcagtgactgctgaccactgaattttcacgtaaaacatcaccagataaagttagccccgggtgatcctgctcagcaactcagaagggaagggagcttcagaactgctttctatcctcattctaaagcctctgggtgggacccaaggtgaagacaatctctctgtatcttgacgcccacactattattataaaactccatggtattgtaatctaaagggagaacaaacagttgtacaaaacaaaagggtcaataagaaatagacatcagaggctgggtgcggtggctcatgcctgtaatcctggcacttcaggaggccaacgtggggggatcacctgaggtcaggagttcaagaccctgtctctactaaaattagcagggcatggtggtgtgtgccggtaatcccagctacttgggaggctgaggtgggagaatcgcttgaacttgggaggcagaggttactgtgagccaaggtcatgccactgcactccagcctgagcaacagagccagactctgcctcaaaaaaataaaaataaaaataaaataaataaatgaaatgaaaatataaaaaaagacatcacatgtaaaatatgctgagattattctggcatgattctatctggacagaatgcagatattcctgcttcaatgccacctaacactgtgtatgagatccgccacgtacagggaaaagctgcaaagaaaaccatgtgcttaggccactttttggcttcacaacctttggcttctctcaagagaatattagagtatagaattgatcataaagcaaatttctgcaccaagaatttacctttccaatggagaaaagtttgtgtttactgaatataaaataaattaattaaaaaggcttgtaatccaactaaaagacatccaagatgatgttggaacaatctaacaaaaaatgatcattttgtgataaacacccataagagcagtcaaattaagtcagtaagtataaacgaaaaattgtcatggttattttctatctaacgccatgacttaaaggcttacagaaaaataaaataaaaaatcattcagttatctctcgaatctcctctccaacataatcacgctaaggaataatatgcttaattatggacttgatttctagcactgggaaagtagatggtttttagaaactacttccattaggctaaaaaaagaggacactcggaaacctagcagtagtaaaggagtaaatgatacagactacttaatgtaacatgcaaccaaatgggggacttggaagatgtgccaggtagtctaaagagtgaatgtaagaaaagactggctactgcttaggtaaatggtgtagtgtgaaatggtacaaaatcaatggatgacagagaaaagcatgattccacttctacctcacttctgcctgcacaccataaaccatcctcaaagttacaagcagaacaaattaagagaggactcaccccagttagatggcaatagtaagagaatgttttaaccactttacatggcagccccagggaaaacagcacccatggcattggagggactggcagatacagtcacagaacaactctctaaaagaaaccacagccagaaaaagcaaatgtcctagctcttccctaagataggatcctcaaattgcagactaatttgttgctgggtcctcaaaatcaccagaggttgtgtggcgcagtaggcaggaacatggacctttgcaaacccaattctgccattagttacatatgtccctgcggtgggggcgtcatctgatttctctagaccatacgtttttcatttgtagaaccgagacagtaacagcacctacgaaatgtgagggctaaaaatgaggcaacgcatataaagcatttacaaggtgcctactacacaacagctgatcagtatataaatacgattattttattttagaattacataaaaagtattttcgtatttagaaaagaaagcaatgattactaggaggcaacaagagttcacaagaaccagatgatgttatctctaccattctcctctggtttttaaatataatgtgtttagatttctgcaagattgatttcccagtgggtagaaggaaatgatggattggttgctcatatagctggacggactggtagctaattgaacagccatgcctaaggagtattgttcaacaaatacttcattgtgcttactatgtgttcagcatgtcctatatgctaaggattcataagtgaataagacagacaaaaattcctgtcctcatggagtttatattgtaatgagatgaggcagtaaaataataaataaattataaagtatagtagaatatggaatgttatagggaaaagttagaccagggtaagggtatgggactgtgggatggggctttatgcttgtaatctgtctgttaaataagcatgctatctgacatccaaaacacagtataagccccaggctgttagcctcctcccctcttcctacttataaacctgtagtattttttccttccactatgagaacttcattactctgagtcataattgtgtgtttaatgtttacctttgtcgctaagctgaaagctccagagtctagggagaatggcaagaccaaggaagggtctcagcatttgaggaatggctgcagaaagtgtcacgggaaggagaatcaaatggaccacactggatgcctcgtgtttttaaaggacattgttattaatgggacagggttcatactcattctgggtcattccagacacgggagtttgaactaatgggggaaagtccagggactagtccagcttcccaaaagttctttttcacagttagaataatctacaaagaaagtaagcatgattgatttcatgttcaatcagaagttaaatgattaagtggaagttacttattaacctacacttctaaaatgtaagattctaactttaagactataattctggtcatttccaacaattttattaataaaacgttgaatggtaaatttctgtattttctgggttagtgtagtagtaagtctatgacttctttgttaagaaaacccatacagagaatacaaagattatttattctaaaagtaccaatctaaaattatgaaataagagtcattatagcagctaacaaattaaatggattaattgggtagagatttgagagattataattaatgataaatcaataaagtattcaacatgaaaatctattacaaccctgtttatgttatttaacttcaagcattcagttctgtatgcttctaattagcaagctataaaagatgccatccataaaaacataatgagaagaactgtttataatgataattaagattcatttgctcagagagaagggttcacacggctacaggttgcagcaaacaaagggttaagctcattattgaggaaaatactacatttaggcagcatttattagacatttaaccctatcaggcagagccttgccttagaaaatacatcataaataatgcttcttacaagacaggcaagattttccaaagtgaggtagcaactactgggagtccatgacattctgtaactttgctgggcttgactcatccaactgtgttagtaataattaaactctagctgatggcttttatgttctctttctggtttctcaagtcttccctgcattgatgttttattaaaaatatattgtgtattgtgaaggccagtggagaaaaaattttacattttccctttccgcctctgggctggagtttgccttctatagcactttgtctcatactccgagcactgtttgaggcttctcatgggcttgccagtggcaaaattgaggctcagaggtgggaaacataaacccataatacaaagaccctcactttttagatccttttgtaattctggctttagaaaaatcaaagttttcattcagcagagaagaagcttcttccccctttcacagaaactctaatatctataaagacccactcagtgaagcccaaaatgctttctagacacataattgtagcaataaaagtgtgtcttcacctcccactgtacctctgagctgatagatacaatttgttactccattgacaacctgccaacacttcacaataattagagccaatggtccttttctagatatagcataatgtaaccttcaatattaacgtttttttcccccatcagtgcaggcctaagacagaacaactctaagactagtcctagcctgaagtcacagagacctttaatgcaggtcacgggcaggacagcaatgatcaagggtaaactctaacacatgaactggtaacccagcagtcagccactgtgtggcctgctacattaaccgccctctgagccaagcaggcaccccagcggtcctcatttaaaaagaaaaaaatataagaatcttaatagagagattggggggcttatttttcatgatcatgtgcctttaaaaggaaagtcctagagtcagccctgatcaatacagcctctcctgcttcctgctttcaatctgttaagcaagaaaatgctttcatgttggcactaatcccactgtgcccccaaagaagagaaaaaaacctcccgagagactatttaatatccacacagtcggtttttagaaaaacaaaacaaaacaaaaaacccaaggaaatgaagactatcaggagaacactcccggaaaaaccctcctgaaaacatgcctgagtaaaagaaaagtcaaaagactagatagagaaatgatgtccagggagctcataatctgcctgtgcaagaattctagtttctagaaagtcactgattaataaattcatgtgctcattcatccattcacagataactgctgggcaccaatgctgtgccagtaccagggataccatagcgagcaaaacccgtagggcctacctctcagggagcttgcacattctacgggggagcaggcaaaaaacaaacataacaattttagatagtgacaagtacttgcaaacaaagtaaatagtgtgatgtaaaaaggctggtctgatcattacgattcctttcagcatgaaacttccctcatatcacaaggtataatgaggacttttagtcctttggatggaagtcctaagatgagagactatattaatcataataggtgtaaaagacaaaaatacaacaacgtaaatttcaaatgaagaagcaatatgcaatctcaatttctaccatatccccaagacccttggaagaacctatttatagctttatcgcagccattttgaaaaggtagagaaaaaaacatcacaggtttttgaaaagaaattttgcaaataacatggcagtattgcaaaatgcaaatggaaatgctgctgagccatctgctcaatattacagcaacattgggaaaaggctctgaaagaaatgatgtttgaaatcattaaaaaaataacatgtcaagtttaaaatactcaagaatcttaaaaccagcatcaacacattcagcaaccatatggccctacagcaggttaaaaaaataatcgccctgcttgcaatttctacttcaacccaatggtttctaaaacatgtttctttttcccatttgagtaccttttctttccattgaattccttggtgtttacagttacttgaattatacctggagcataatttttgtttcaccctttctgaagtagaaataagatagtaaggaagattaaaagtcacctgttcaagaaaaaggaatgtgcagatgactctatataaattgttgaacacatcttgttttaggtttattgatttctccatcctgatctcactgtctcagtaataactgctaatctcatcgagtatcgtaattttccaggcactctgctaagtgctttatagtcattatatcatttaatcaccacaaatttataaagttgatgctgttattatctacattttctagatgcgaaatttcctcaaggtcatacaggtaacatgcggcagagccagagtccaaacaactgtgggagccacgtctgtgctcttaactgctattatatgcaacaattcagtgttcagatgtttgtgctgacttctcaaggttaaaaaatgggcaacatagcaagatcccatctctgcaaaaacattgtaattttttaaattacaaaatttatgaaggcccagagaattacaaatttataatggaaatccttggtgtttcaaatgaattaaaaaagtagtttcattcaacttactagcttcacatagtagcttgtggatacagtaggaactcaatacatgattactgatagcagtattaattcacatataaaaatattacatcaaatgatctgtgtctggtgcatgtattttaaatgctaaagttccttttgtatctggatcataagaagactttttaaaattacaaataatatttaaaggtgatgattagtttagaacggacctgagggaagtcaggcagtaggaatatctgccaaacacttaagttctctaaatgtagagatataaatgaagttataaatgtaacactatctatagcaaaaaaaaaaaaaaaaaggaatagatgagcgttactgatgtgcatggcctcatgcaatggtctcagtgcagaactttatttggtcttatgaaacactttaccaaaactttcacttggcattcctctgtctgttgcttttgcctaatgatcttatctcttcactgattagcaatctcgtctgtctttagcaaccctttaaatctcatgcagccaaaagttataaataaaacaaagcaaataaacaacgtgggtaaaataaatcagtgtgataagcagttgtgaaattacaaacttattacggaaaaatccatgtaaacaaatccactaaacacatagtcattaattacagctcacaacctcccatcacttctgccttctgttctctaacgtggggtgcttggtaaatctctggtctagagtggcattttatttttgcaatccttggctgtaggtagagcttggcctcttttccactcaacaggaagtcttgaaaacaaagatgctaaggtttagagtattataactggaaatatgaaaggcattttgcaatattaccaaaaacttgaaatgaaggttaagaaatagatctgcatataatgatccatttatttttgatgaaaatgatttgtcaaaaggtaactcagtgaggaaaaggtaatggttttaaaaatggttctagaacaactggctacccatatgcaaatagatgaaccttgaaccttgccccatagcacataattaaatcgtcccaaactggatctcagacctaaatataagagccaaaatacaaaatttctagaagagtaaacatcggtgaaaatctcaatgattttggggttacgaaaatatttcctaaataagacacaaaaacacaaactacaaaaaaatcgttaaaattaaatacttttcttcttcaaaaaactgtgaaaaaatgaagatataaagggtaaagggtttcttttgggtgtgatggaaatgtttgaaaattggttgtggtgatggttgcataagtctgaatacagtaaaaactgaattgtacattttgaattagcaaatggtatgatgtgtgagttatgtcttataaagctgttacaaaaaaattaagagaatacacagtctggaagaaaatatttgcaaaacatatatttggcagaaggtttgtaaccagactttacaactcttagagctcactaagaagacaatcacctcaataaaatgagagcaaaaaaaataccttgatggagtatgtcaaaaggacagatagccaatagaaagaacttctaatggctaaagctagaacaagaaaagaattaaacaaagtagcattggattataaggtgaagtattaaaaaaattttcatgatcccatattgatataaatgaatgcccaaataaataaataggataggataaatatcttgcgcataagaattaaaataatttacgtagctactctgccctcaagaaggtggagcgtaactccccagtccttaagtctgagctgccaatggtgacttctttccaaagagtatagcatggaaggagggaaaaaggataattctggagtggagaaacctgtcaaacactgtctctgccaagtgattaaggttaatgtcaactgtgctaagtcatattgatagtatgtagacctgatatgatatgattagactggcactttgcctgtgtggtcttcctccctaaaactcataatcccagtctaaacataagaaaaacatcatacaaatccaaattgaggggtagtctataaatgtcagaccaatatgccttaaaactcaaggtcatcaaaaataagggaagtctgaaaaactgtcacagtctatggaagtctaagaagatatgacaacgaaatgtgtggtattctagatgaaattcaagagtaagaaagacattaagtaaaaactaagcaaatctgaataaaatattgactttacttaataataatgtatcaatatttgttcctttgttgtaataaatatacaatactaatataagatgttaacaatatgatttaaacaagaaccagaattttattacacaatattcaaaatgtccaagatataatccaaaattactaggcatacaaagaaccgggaaaatatgaactcacatggggagagacaacagatgccaacagtgagatcatccagatactgaagttatcaaattcattgaattgtccatttaaaattggtgaattttattacacataattatgcctccaaacaaaaggaacaaaacagcagcaaaagttttaaaaagagtacagataacattgaagcattacattagtattagtttagcttgagagtgagataaattgattcttatggactattctggaaccaaataactactattcacaccattatttcttagataaattacgttttaagtttcaaacaatcagcttacaaaaaaccttctggcgcctaatcctttcttaagtggatggccaagcatttcagaaaatgttgaactccagagaccccatttaaacccaggaacatgagacttctgattatttgggtattaaattatatataagtatgttaatgttattcatatctctcaaaggattttggagacagtttggaagaaaggattttagaaaactctctaaaatgatgactcggctgacatggggcatataggagagaactattaaactttctcccttcctctggcattgaaattactgttagaaatgaatgagttctgcttttatagagtactactcattaagttcctcggtcctttcctagaaagaaccacagagacaaatagtgttctaatttttatctttactttttactaaactatttgcataggtacataggtttcaagaagattgctcaaatgaatatttattttcttacagagaaacatctgtgaaactgatcatctttcactctaaataaataaataatcataattggtatctgtttgagagctcatttgcaaactgttcctataattgtgccactcatttacaggcacaacagagagaatcagaacataatcctgcaccctacttatttgcattaattgtgatcaattgtcacagtttgtttataagactgaataatttttaattctaaaataattatgctgattatcaaatgattctgtatgatttagtttttagaacatgtttaatacaatcattgcattctcagatgtttaactacagggctgtttatttcactgtatttgctttacgtccaagaactgagaggtttttccaagtcattctgtcaagagttcattagaaaaataaactaaagtgaatatatgctgtgctttttaggtgtaataaacattaagatataggaatgtaacattggagctcatacacacacaaatcccagcttgcagcagatcaacttcctgtgtctgatggtgaaggatcccactcatccttcaaccctactcaattcaaccttggtcctaaaaataattaatcattctcttttatattcttccaaagtactttgtgtctccattgtcacatttttccttgactacctttaagttagggaagtccttctcctcaaattgaccttaaacccatggaattcaagatctcattaatgacttttttcccctgacataaactaaagaaaaatagctggtttaccacattatactggattcctgttcagaaaataattcactcccctcctcctcccactgtggatggaatatcctcccctaccccttgagtttggttggtcaactaacttgctttgaccaatgggatggactggacatgacagcagctgaggcttaaaatgtgcttgctcagcagggctcaccagcctgaactcccaccatcatcatgaaaaggacatgccccaggtagcatatggttgaaggaggactgacttgcagatcagatctgaattcaaccttcaacatggagctgggcccaaccagttccagcctgggctggcaggcccacaacggaagcaaagtgaataaataattgctgttttggcagggcgtggtggctcatgcctgtaataccagcactttgggaggctgaggggggcggattgcttgagcccaggagttggagaccagcctgagcaatgtggcgaaaccctgtttctacaaaaaaaaaaaaaaaaaaattagctgggcatggtggcatgcacctgtagttctagctactctggagactgaggtgggaggactgcctaagcccaggaggtcgaggctgcagtgagccacaatctccccactgcactccagcccaggcaacagagtgagaccttgtcttaagaaaaaaaatgcagccacaaaaaagaacgagatcatgttctgtgcagggacatggatggggctggaggccattatccttagcaaactaacacaggaacagaaaaccaaatactgcacgttctcacttataagtgggagctaaatgatgagaacacatggacacatagaggggaaaaacagtcactggggacttttggagagtggagggtgggaggagggagaggatcaggaaaaataactaaagggtataggcttaatacctggttgatgaaataaactgtacaacaaacccccatgacacaagtttgcctgtgtaataaacctgcacttgtacccctgaacttaaaagttaaataaaaaagaaaacaaatgttgttctaagccccagaattttggtgtggtttgatcttcagtaatagctgaccgatacacctgctttataaacatggaactttattctccatgaatatggcttggttaaatcacattttggaagaactgccaaaataaagcagctccgcttctcctgtcataagcacagtgctaaattgagtttggatggctttcctctaatagaattattttacacttgcccacatcaaagctaatgtttctccttgctgcccactcagtctttcaagattttcctgtgagttatcctcagcactctggtgcactactcttcagaatagctggagctatctgcagacatgccactctaccctgccttctagaaccacatcctttttagcatggaatttctttttcttttgagagtggtctgggaaccaccggcggcacaagcatttagaactgctgttaaaattaccaattgctgggcccactccagacctactgagtcagaatccctggggtgggatccaagattttacatttttaaccagctccctaggaaattcttatattacaaccaggtttgcgaaaccctgatttatgaatatgctaactaaccagatcctaagccaatacctaatcctagaggatttcgatgattatccaccatcatctagaaatgcatttgtttattcctaatttttgttttctatgtgttcattttctgtctacttcaacacgttttcttctcttcatttttcatcacatgaaaggtcaattttttaaaaaagtactcttggtacagaatattttcaaagcctttgtctgaacaagagaagaagttgcaaaattctgagcaagcaccaggaaaaatcatctttgatcagttggttgtaacctacaacatgctacagaagggccagacgaaaccgggagcttaggcctgggggtgatcagccaggaacacccagtcctagcagaccaggctcctagaactttcagccaataaagcttatggtcgccccccgcaaaaaaggataacctaaataagttatttcagtggttattctttactaagaaatgcatatattctctcaaaaatgtgatacttgggttagtcaggtattttccatatagaaaccacactctccgttcctcaaagtgttgtccttgcacttttaactttttaaacttattaacaaatttttatattaaaatatttaattgtggctgggcacagtggcttacacctgaaatctcagcactctgggaggctgaggcgggaggatcacctgaggtcaggaattaaagaccagcctggtcaacatggtgaaaccctgtctctactaaaaatacaaaaattagcagctgggcatggtgctcatgcctgtaatcccagcactctgggaggccgaggtgggcagatcacgaggtcaggagattgagaccatcctggctaacatggtgaaaccccgtctctactaaaaatacaaaaaaactagccaggggtggtggcgggtgcctgtagccccagctacttaggaggctgaggcaggagaatagggtgaacctgggaggcagagcttgcagtgagccgagatggtgccactgcactccagccagggcgacagagtgagactctgtctcaaaaaacaaaaaacaaacaaaaaaattagccaggcgtggtggtgtgcgcctgtaatcctagctactcaggaggctgaggtaggagaatggcttgaacccaggaggtagaggttacagtaagctgagaccacatcattgcctagcctgggcaacaagagtaaaactccgtctcaagaaaaaaaaaaaaattaaattgacagataaaagtagtgtatataattcaaggtatacaatgtgatcacctgacatatgtatatattgtgtaaagatgatcacaataaaattaacgtgtctgtcactacccatagttatcatgttctgtgagtttgtatacatgtacagttaagacacttaaaatctgctctctcatcaaatttcaagtaagcagtgcagcattatgaatagtcaccatgctgtacactaggtccccagaacgtatccatcttataactgaaagtttgtacccttaaccaacagctccccctttgaatttagtgattctctcctttgtggagagaatcagagggcttcagatggaagtgactcacaaatccaaattctttaggtttcttatggaaagaaatcatactggtaacagaccagattttcagcaatgttgccagttaaatgatgggttttggtcaacagctccaaaattgatgttgccactgactctgtttcatgtgcagcttccaacattgccaattcaaaagatatgttgatcctttcaatgtaagaactcatgcaaacttacatgtaggctctttctatggtaatacgatatggggagtagagaagtggccaagaacaagggctttagagccaaactacctggatttgatcctggtcactctctgtgtttcagtttcccccactacataaatgagggtaataacctaccacacagacctgtgtataagatgggttatacacttaaaataaatggttaaataatgtctcatgcactagaagaggccaagacttgaaagttgttatcattcttctgaaattctggagtgtattcttggcactgttataaagctttggttgagctgctctgtacttaaccacttcctctttttgttttcttatcttgaaacgcatcatacataacaaaagaatggacataattaatgtatatgtaccttgtagagaataacagtaaaataaatatttgtgtacccaaacagcgtaaggtacaaagttataacaataaatgtccagagccactgtgctcttcaattatctcatcaaacccccttcaccatcctaattggtgtttttgtcattcttttgcttttctttatagttttactatatatttgttcatcactatttttaaagaaactttgcaagttgctcaaaaattctcttatggcctattttcttgtttacactccccatctgccaccttttttaggcttccctgctctcctcaaccagggaactgctgcagatttagaaagatgttttagtctccacattggccaaactgcttttcttcactgattagtttttgaagtcttcccccacacttcccccacccttccccaagacctcatcattgtgatcctgggtagctaatgataaatgattttaaagtttccaggttttcttttaatatctatacttcctattttttttcctaaaagctgaattttactgcattttctcttaaatctgtcaaaacacggggtagagttctctggttttgctgaattcactggaatggtccagcttccggccagggactgtcctctgcagcacactatttcatccatagataatgtccggggtgttttctacttactggggccaaaatgtgctgaactttttgggttctgagtttcatgtttcagaaacaatcatatgacctacgtacatgccttactccagccaagaggacttttctcaaaccctggatcactaaaattccattttcacagccttatctaatttttcaggtgcatttacagataatgccccacatcactaggtctggcccagtgccccacggtgtggtcctgatgttggcccaaattactgaggaaagggaatttccacattcctagcttgttcctttatgctcttcatcctgtgtaagaaccagtgtaaaacaatattttacaaacataaaagggacctttgaaacttatttgatgtgttagcctgccaaaggcaaagtcatcacgaagtggaccgaatgaggttgtggttaaacttcctcaattttctcttctaaattaaaatctagtgccagacaccaaaaggtttcctcttcctgtccctcttttattaagtagttacaatggcaattaaaaagacccctttggtcattccacactactctctactccaaccacttcctataatctaatgatgctatcttggcaaactaatattataaagattttttattaaaataaataggttttagaagaaacactcaatcaagtatctcagtggatgtgtttcctgcaaaggcaatggcagcacagaaattaaaaactaattcatccttctagacagctgcccaccttgctcaataaagactctactattcattccttatggccattgatttttgcaagtaataacagaggttgagaagaaaagcgtaagcttttttacagatggatgtttctatcatttgccaacagcttctgcattgtctatgtaatggggaaaatgtaaaaatttatcttgtgctaaaaggataactatttcagagtaaaagtaatgcttttgggcaataaagataactatttcagtgtattatattttcttttgggctatgaagtcagatgatgactgatttaaaccacacaaatatcaacagttagactattctatttgtctcctctttaagaaaaaaaaaagtttcagagaagagtttgcataatcccaaccctaactcttcagccactatataaagtatcttaaataactatgacttagagatactggaaaaatatttggattcctctgatttatgatttttacatgcaatgttatagagaacacttcaaaaaatcagctgttgatgtatacgtgatgctctgaccccaagatacaatcaatattatttaatggagactaatttacccacacggcagacccttcttaaacagggtatatccagaagttattgggctaagtgcggcaagaatgcatgagtcagctggtggttagcacccaactgagcagccctgggccagattaggatggatacagcagatgaaagaacatgacaggttcatgctcagttttcatttgaaatgcatatgccacaaagatgtcgcttctttcacaatggtggagcaaactctccatgttggaaatgacaaagaagggacaaaagaaagataacatgaggaccttctaagccatcagaatatcaggaaacagaagcagacataaccatctacttggtgcctccattccacagaatcctccaaaaggaagtcaagaaagtccatcgttgccacagagtcctgagcaataattcaccactactggcaacatctgattagatgagctgcttactaatctcagccactgtggtcttgcagaattgcagcttatctagctttcccgtgcttatgtgatccaaggaacctgatgatggctgcataacacaggcaaaaaacagatggggaataagttcaaggtctattctctgggactgtcacctttaccaaaggtgtctgatcccactggtggacctccattctgggtccctgataagtttatctgctgataaaagtccctacatgtaccacctactcttttccttgatgaggaagccaggagtggcaaaaatgactgaaccaacaatgtctccaatgtgcctgcagtagagccccagggtggctctcttgtgttcaatctattttatacaatcatttttaaaaacacaaaaatagacttgtaggctgggagaactatccatctagtcctttgggagagtctctcaagttaacaggctaccattgtcatgaaaaggcctcatgaccagccattcaagggctgcctgcccacaactgctctgaaagacacccatattccagatactagaaacactctgctgcgactggtacccgacaaaccaacaatgagcaatgagaagctgaagtttaacatgttagccaatgccagggaacactgcaagtaaccaaagggcttcatcggggaaagagaactgaaagctttgcctgaattctgcttcacagtccaatgtgttcactgggcataaaatagtaagggctaggtaatatgttctttgggagtgtgataggcagagttcagcatcatgaagacctcacaaaattcaaatcaaacaaaagggcagagtcatgctttcttggcagttggagactgagaggtgacatgaatgtcgcatgttgctcctgaggcattttaatcagtgtcccctatgaacttcctttagcactgaatagaaaggaaagagattctgaaacagagccaatctgacaacactgcaacactcagtgtatttgctgagcccaaactgctgagaacatgtggtggttggatggaaaccagacagttaagcaacggtcgggtgagatgctgaatggaaatgaatataagctgggtgggtggacaaaatcctctaagggcacaatggcacagcttccattgccatggcccagccatcaggtgtgggggaaagcaacagttggacgatcttagccagtggaaatgagacagcttctttgagtggactctttgaagccttcaaggaaaacagcaggcagctttggcccatgagcaataggctctagagacagagagtggtgaaataacaagccaaagaataatttacatgagcatggaaggtcctggctgtcaaattgcttgggtgagccacacagagttcacgtgtttgacgacagaatcagattcagaaagatctcggttaagctggatggaccaacccagcaaaatgaaatgtaatagagataaatgggtattatatgtaggtccaatgatgaaactccaagaacatatatatgagtggcagcttagcagccctgtgtgtctaaaacttagaagttatagttgggagccatcaaagaagcaagttgatgaaaaattaatttgattaataatgtaaaacaaagaaggagacaaccctgtttacagaccaaaggctccagatgtcatccattaggaaggtgttcaaagaagaggaatacaggaagtcactgacagcatttattccgggggtgtgagaactcaaggacataaaggcttacattttaaagggttatgatgtggacaagagattgaagttattctataagcctattatggataaaatgagaagcaatgatggacactacagttcaatcattcattcaacaaatatgttaagctcctacgatgtgtcagccattgtgctaggcagcccgattggcagttaaggaaaactttcgcaatactcaagctttccagaaataaacagggctaccttctggacacaattcacacatggttgctgaagagagtaaggcaaaagttgaaatttcagtcttagactggttggaaatggaatgcatgcatcttaagctccccacctcagagaggtttacaatcatctgtgagttacactatgtacctctctttttcagttcttccacatttcaagagagatgctaaccaactccacatggtgttcagtagaaagcagccaaagccaacattggcaaatttaaattgaaatgaatggcattttaaagagaatactgggtttcccatagactctccaggagacctgcaaaaataggcttgaagacctcatcatcagaaaaaaagcccagccatgcactgcagagctggtctgggacgacgcctctgcagcgaaccatgagctcacatcactgtcaagggacgctggatggtgctacaggaaaacagcagcctggaaaccagaagaaactgccaccatcatcaccctcctcactggaagggattccaatcattctccaggtctttgtgtcaccagcctccacaagaaagtctggtgaggctgaatcagactggaagagtctgggtcacgctgggtcatggctctaagtcctggcttcaaggcgggataaaaaatcaagcactggcggtcgggcgtggtggctcacgcttgtaattccagcactttgggaggccgaggcaggcggatcacctgaggtcaggagttcgagaccagcctggccaacatggtgaaaccctatatctactaaaaatacaaaattagctgggtgtggtggcacgcacctctaatcccagctacttgggaggctgaggcaggagaatcacttgaactggggaggtggaggttgcagtgagctgagatcacaccactgcactccagcctgggtaacacagcataataataataataataataataataataataataataaaaaataaataaaataaaaataaaaaataaaaaaaacaagcactggcattttcagtttctataggtgggccctgcctcacaagaaaggggattctatgagtacactagatgctgagtttcaacaccttaacaaagaccaaaaacattcaacataaggtgtagccattcttctcccactactcatttaacaaagcccaacacttgaagacaaaaggtgagaaaattaaagttagcaacataacttccctaacttgatgaatagcatttgcttcgaaggatccttctttaggaagaattctgatggtcacagtcactcacaaatggggttgacattgactgggaattgtcccagtgggtttgagataaggcggctctcccctgaatggaactgacaggaggacaagctgaggagaaaccaggagtttcagcttgtattacggcagatgagttttcaggtcattctgctgggaaactaagtgaccaggaataacttcctagtatcacaggagtaagagaaacctccagcagtcaagaaatccaccacacagtctccccaaggcctatatttctatattaaaaaaaaaaaaaaaaacatagctggcagccccctttctccaaaagccttgagagaaagtcatttgataagtgagaactgcaggtgttcggaatgttccttgctaatgtcttgttctttctctccatatccccccaatccccgggagtgaaagcagagtggagtggaggggctcaccatctcttccatccatttccctgtggtttccagaagacagtgctgaggtcagagccaggataacctctctggctacacagtgacgcatccactggggcattccagactctgggtgacacttcattacgccagacttcctccaggaagtgtgagcaggctaatcacgcccctgggcgaggcgggcacgtggagggagagattagcgttcccccacagctgtcaagctgggcccctctcattaacacccacgactctctttctttcctttttttttttttttaggtcctttgacggcagctcgtgtacttgaagtatgtcactgaaaaacgcacagatgggatctaccagatcatgagaatgctttcacagcttttgaaagagtgctgggtttctttccttcagaagaaaaaagaaatgctgtattctcaggtctacccattttccactctcttcctgctttagaaataaactattgcagaagccaatgtagtaataaccaacagggcaataactaaaatctagatcttttgatttttttttaatgctaaagtagctaattgtatctgctaatcatgtcttcatagttcacagagagggtacagcatctgaaatatattcaacattagctgcaacctactgaaatccaacatcaggccgggaggggagacagcaggccaggcgagcgagtgtctgacagattgtgccctgagggaagatgtgtcccaaagcaggaggaagttgctcagggaagggatcttttatcttgctataaaagttctggacaagggtctgggtgctttaacatggaagcagtaagacaatgaggcctggaggaagaggaccaagaactgtgagtctgtctcggatgatccagaggctttttgagcattttaaccagtatcatctatgatcctctgaacaatatcaaagaggaaaagaggataaggttactattctctgggtggtcactgtgttctcttttgtatgaagctgtctctttgtgcatagaagaaaaggagctatgccaaggcccaacagtcctattattttctgttttagagatagggtctcgctctgtcacccaggctggagtgcagtggtttgatcacggctcactgcagactcgaccttgtgggctcaagcgatcctctggcctcagcttcctgagtagctgggactactgatgtgcaccactgtgcatggctaacatttttattttttgtagagatggtctcgctttgttgccctggctggtctcgaactcctggcctcaagtgatccctctgcctctgcctctgcctcccaaagtgctaggattacaggtgtgagccaccgtgcccagcaaacagtcctatttttaatataagttcctagttctggacttccaggtggcacctgccacacctactgcacccagtcagcttagggctttcaccaaaaaaatctgacaccaagaaaagcgggtccccaggaagcggtaaactacaagaaatggacgggatttgcaatcttcccagaaaatacccaacagcatttatctgtaaagactttgctgctgataatattacagtacttcttaaatctcagcaaaggccttccataaaaagaaggcattcactcaataaacatttactcagcaccttctatgcccatgtgtcagctgtagagctggagggtgggggtgggaagagaggagggaatctaagatgatttgataggctcgctactgcatagaaccccatcatttaaaatgccactaatacaatcttggaaattatgaagtttggggacttcacaggactttgactgataagtaatattgaaaaataattactcaaacatgcccatttatctccagcccagtacagccactattgtgcgtcctttcaagggacatcagggcagcagcacagcttaccctggggtccccctgggcaccccagcataagcagtgatgtgctagacagccaccaaaaccaaagtataactacaaaaccttgttccaaagggttctgggggagattcagggggaaaagttacatattcttaaaattttgatcactggtggatgcactcaaaatcctgctcttctctgggagcgattttcatgctgttcctgaaagctcagaaagaataggaaaattttatgttcagtgatagatgggctagacaatgggaaacctgcactgaaccagacacaaaggacctagcagaggtgacgcctgccagggctgtgcacctgtgtttccttaacatctgctgggaccccattagtaagtttctatgaaaatgaattagactgtgtgccttctggtcttgcgggtcagtctcttacctcaacaccagtgtctgaactgaacagagcttggcagattctgattccccctccaacctctgccccagccttagcctctgcaccatcttcttggctctgctctggtgtcaggagcagcaaacagtgcagtctgcagttagcaccttgtcactgctcagccataagcccctagacgtgacagaattactcctctgagattgaggctgtagttggctatctggacaacctgcatcaacttcctacacccacaaccctctggacctagatttctaccctgactctgcagccacgtaggccccttccccacagcaggtggaggagagggcaaggtcatgtctgccctcttccatcatgtgtgaaactggctgagaaaagcggggttgtaccctcagcatcctagctctgagaagaacctgcaccagccctgctggatctacccatgcagaccccacccctgtgatctcctggagagctacttcctagataaggaggtaaaactcatggagaagatgggtgcccacctgacaatcctctgcaggccagcaggccccctggcaggctgggcaagttcccccaagaaaataattgaaggcactttgtaaccatcttggacccttctctcttaagctgtggaaaaagtgcagacaatatagctttttgttggaaaaaaacagcaaccataagaaacagaatttgacaatttatcaactacaccaagaagccactctgtggtccctcaaattgatttaaataccataatatgtcatttaaaatgtggactctggaactgggctgcctgagttcaagcctctttgtatctcagtttgttctcctataaaataggcaatataagattattctcctcataggcattttgtaattacagattgcacatccctaatctgaaaatctgaaatccaaaatgctccaaaatctgaaactatttgaacaccaacatgacacacaaggtgaaaattctacacacaagcattaacacaaactttgttttgtgcacaaaactactaaaatattgtataaatcaccttcagactatgtgtacaggcatatatgaaacataaatgaatttcatgtatagactcaggaaccatccccaagatatctcattatgtctatgcaaatattccaaaattcaaaaaatatataaagtcagaaacacttctggtcccaagcatttcgggtaagggatactcaattggtttcggatggacagcaaagtgcctggcatctactgagtgctcatctaaccaagtaaatatgagctatcattatttctattaaatatttatttaaatcacggaactatgcttggttctatttctcacctcaatgaattctctatgatccatcgcgaaaatagattaaaaacccagataaggtgataaaattactgttcacctaaggaaaggctcataaaactggcttattttgcagatgtttcttcaaggctgactcttaacaactaatcgaaggccgtattgtgaacattgttactacacatggaaaatatattttgagaaataaatgataaaagttgtaatgtgaaccctgaaatcataacaattaactttaaaaactctgtcacattaaaatctactggtcttagacactggggactccaaaacatgggaggaatggagggggaaaagggtccaaaaactacctgtcaggtgctatgttcactacctgggtgatgggtttagttgcaacccacacaatacatgacaaagccctcagtatcacacaatacatctatgtaacaaatttgtacatgcatcctgccctcccaaatctaaaataaatataaaaagggaaaagtgggccaggtgcggtggctcatgcctgtaatcccagcactttgggaggctgaggtgggtggatcatgaggtcaggagatcaagaccatcctggtaacatggtaaaaccccatctctactaaaaatacaaaaaattagccagtcgtggtggtgggcgcctgtagtcccagctactcgggaggctgaggcaggagaatggcatgaacccgggaggtggaggttgcagtgagccgagatcgcgccactgcactctccagcctgggcaacacagcgagactccatctcaaaaaaaaaaaaaaaaaaaaaaaaagggaaaacggcacatggcaagaacatctctaattagtgatcaccgtagaaatgccttaagaacttgatccatatatgtgcttttgcctctgagtccaaacctatttgtctaaataccacattttgggagtttgggggaacagatttcaaacgatgtggagacaagcactgagaaagaccaccacagagcgaaggggatctatacacacagacaggcaagcacagtgttgtctctgcctaggaacaatccctccaacccgaggagaaatcctaggtctcattttaaaaatatccttcagaaaagaaatacctcttcaacccacacagttcccaatgaagtcctatgcaaaaatgcttcttacaaaaataaaataaaataaaataaaataaaataaaataaaataaaataaaataaaatttatcggtctatcttgagctctaaatgaatcttttacacatgaataattttttaacatcatgcatcggtcatttagaaaatcttggttcactgagttgtactgattttgcaatataacatcgttcattatacgacatttaaaaagcccacattcattaacattaccactgatctcatcaaaaaaattctttaagtatttaagttaaagtagttgtcaaactcctggtggcagatacaagttttctaagttctaatttttgcttaaaagctcaaattttatcattaacaacaaacactgtcagttgttttccttgaagtgacaagttcactccattcatttctgggaaaaggtctgtcaaatactcaagtttgaaaatcatagtctgtctcttacccattctttaaagtgaaatagtgtttcgtgaataaacgtagcttttctcaagacaaccatcctacctgaacaggcagaagcgccttgcacatatttcatatttatagagtattagaaagcacatactccactgttgagatttaataaaattggtaacgtttgttacttcatcaaggacattcttaagtgaaactggcattttttaaaaactgggtgttcgtggcagaaaagaacaaaatgactgctaatagcgtttggtagcaccgctttgattcctgctaagttgcctgcagtactgtcatccattgtttttacatctatctaatgtattatcaacacagtgaaaaaagacaaacaacatttttgtattattatgaagatagttttgatcttgggtatgcattgtaggcatcactgggctttcaaagactctacctggaaaatcactgccttaggtagactccttcacctctgcatgcctcagtattctcatctgtaaaatggagaggattcgcagtacatgtcctgcagggatgtggtgaggactaactggaataaatcatgtaaacaatgaagaacaaagctggcctatggagatgccatctatggactggctataaggagatcagacatcatttgaggctcttggttaatccaggtgtgacaaaaatcaccatcttagtggttttttttttttttttaaagagcatttatcagctatctccactgcatttatcaattatgtccactgagaacattcctggttattttcctgagattgttagagacaccaacaggtcagagactctttcaaatgccaaaacaactagacttctctttaagaagctgggccgggcgcggtggctcacgcctgtaatctcagtactttgggaggccgaggtgggcagatcacgaggtcaggagatcgagaccatcctggataacaaggtgaaaccccgtctctactaaaaatagaaaaaaaaattagccgggcgtggtggtggacgcctgcagtcccagctactcgggaggctgaggcaggagaatagcgtgaacccgggaggtggagcttacagtgagtcgagatcgcgccactgcactccagcctgggcgatagagctagactccgtctcaaaaaaaacaaaaaactctactcactgtaatttcccctgatgtggcctgagaacattacctagcccacttctgcagacttcagagcatgtcttcttaggggctgtcgctcaaaaacactggaggaaaaaggtggatgtttatattcatgtccttttgtgtgtctgtgttctcaaaatattgtgacaccaagagacagaagagaaattgcctggtccctgaacctgatgtgcaatgtcagttctctttggttcaacgtggttttcaaaaacggacagactctaaacaaaggtatctgtccctttagtcaacgagacagggaactgatttggggggttgttttttcctaatgatactaggttgaatttttaaaaattaaagcagatgtggatatattaggaagtaaaataaaaacttgtgtgatttttttaagacaattttttttttgactaaagaaacagaacttactgaaatgtatgattctggatcacagggcagaaggttggggcatgggaagagctacaagaatcttcattaagaaaactggtgaaatgtgaatatattctgtggattatataatagtattatatcgaagttaaatttcctgaatctgaatgattgtctgtgtttatgtaagagcttgtccttgttcttaggaaatacattgaaatatttagcagtaaaggggcatgatgtctgcaagttactcaaaaatgattaggaaaaaaacattagagtgagacacggagaaaaagaagtaaatatggtaaaatgtttaaaattgtggaatctgaacaaagcgtacataggaattatttgtattatgcttgtaacttttctgtaagtttgaaatcataaaataatcaaaatagaaagttttaaaatgtcatttaaaaaaaggacaagacattcttttgagtttcttgtgtcacttattaatgacagtgctccccaggcaatttgctccctgcttatctgtttggccttgtcctgtaccatctccttgtccagctcagagcactgcaacctctgggcccttgtctctgaccctcaagtgggccccgatctgcccccgaggcctgtggttctgggtgctccctagtcctgaccactctccaggctctcctcctccagggctgcctgttatcaccacctcagaggcctttcctgatcctcctatttaaaggagtcccctcacttccacttctgtcactctttataaccacttctattttatttatctttcaaataatattaccactgcccaaaattgctttatttacagttatctatcttcctccaacggattattctccatctgggtagagaccttgcatttttggtcgctaccacttgtgcttggaacattgtaggcacgcactagatatctgttagctgaatgaatgaacagatgtccccaggatctggcagtgggcattcaagctcttcctccaccaggggtaccgggcatggcaagtactcaatatagatgtgttgattgaatgacaatatgtgaatgagtggataaattagagaaagtttctaattctaaaaaggactagttctggaaggccggtgagctcagggattatacagagaaacccacatgcagcctggctcaatatggtctcccaggcatgcactttgacatttaccctccaaacagccccagtctggcttttgttccattgctccacaaaagccgtccctgcgaaggccattcacgatctgcatgttgctgaatccaacaggcttttccatctttcccttccatgtcactctaagcagcacttgacagagtgggcccctccctcctccttcagtgactattcctcaggcttctatggcactggcgacttccagttttttcctgattctcactctcctctgccagctcctctccaatcacttaagatccctaggggttacaaagaacccagtcctgggcctcctccacttctcactccatgctcattccctaggacatgctatgaatcccggtggctttgaagaccatttgtattctaagttgagtcctgaatgtgcatctccagcccagatttgctggctgacctccaggtacctttatccaaccgcctagctgatacaaccatttggatatctcacagaaatctcaaaatgtctcaagctgaactcttgatctttgctgctaaacttctcctttttccatccttcccgcctcagggaacatccaccttataaaccccctggatctgtccctctcacattcacttcatcagtaagtcaggacaattctgcctccaaaagatatcacacatctacgataccccgatccatctccagtgctgtcactgtatcctaaggtaccatcacctctcccccggcctgtgtcccactttccattctcgctcaactccactctttacatagaacccagaggagtctctgtaaaagaggaatcagatcatgtcattcccctgcttgagattctccaacggctttccatggccagtagaataaaaacaaaaattcttaacatagcctaagtggtcctatacgatctagtgcctccgcaccctcatgccaaaatactttctcttggctcacgaagctctagtaacatggatcttccctcagtttccctaaaatataaagacttctcctaccccaagtcctctgcacatgctgtttctcaacctggaacgtatttcctccagcttttcagctctctaagtcatccacaggctctcattcatattgaaaggttttaagaaggaaaattgcttaaagtcgagttggattttatagtggcaaaagagtagaaactgaattggagtgttgctggacataagggcaggttggtagagtgggtggaggctactaacgctgagggagagaggaagataagaaggtctaacctaacaacatttccaggacagtgaggaatacacagattcttgggaaattcctgtctcccaccattcttgggaaacattccttaaggacaatcatgggaatcagctggacatggtagccagcatggaaatgctgaagatgccctctcagtttctgggttggatgaatgactcgtcaaacagtgaagccactgagaagtgggattgagggggagatgtaatcggtatgaagggcaggaggaagatgatgagctcagtttggggcatgcatttgggatgccagggggccttcaggtacagatgtctaccacctgctgtgatggggacttgggaaaatgctaacaattggaatcaccactatgagaaatgagactgaaagtgattagaagcatgaagaaagaggctgtgaggcccatgggtggtgaaagccattacaactgatggcagcatagacagggaacctcctttatgacgagactgtcactggcactttattaaagaccatcattctatagtcagaagttcagaccatgttcacaaaacacatgaagccaggatgattatttttggaatgcaatgaaaagattaaatgaaaacataaaactattttatgagcataatatactactttgtttagaaaaatatatactgcttgtttgttactagtatgaaggttgctaaatagagactagacactatctagactctaggtgttaatttttttccattccaaaacaaagtaattcacaaaaacgtgcactattcattcatgcaataagtattactaagtcccactgtgggccagatgctattctaggtgctggagagagagtagtaagaagtactgaaggcactaaaaaaatgcatgttggatgaacacatcaaatcaaatcactctattattacatcacaccctcaacactgctccccagttccacagacatgatactatcagtcagcttaccttgattagtaatcattaaatgttgcagaaacacctaacagttaagtcctatgttgaaaaaaaatagacatccaataaaatgcaaatttgtggtaagcagtaggagaaaacaagaagcggaaagaggaaggttgcctaacctcgatggcaatattctctaggtcatccgtgagctttgagttgtgaagaaaaatccaggcaggtcaatttgaccttggaacagaattcttttggttgaatgttaagtggctaaattacaactttggggagaaacagttcttgcaatggaacgctcttccctgcctgattagacttaatcagacttttttgtactttagggtcagggaaaattttcaacctgtaatcatgtacttattgggacacactaagagttcatgatggatttttaaacacccagagccttccaaattaactcaaagtctcatgatttctccctttaatatgttactttataacaagtagattttaataaaaattaagggaaaaaaatttcaggtttctgccaggaggcactgacttgtatttcttccaagtctcatgctctctgggggtatgcatctactgaattcataaaataaaaacatagtaaatggtaaatgtaaatgtaagaagaggtaagacatttccatcaattccctaagaaaactatcaccaaactcttgatttggaaataatgaagtctcccaagtaaaagtaaaaggagggttggctaggggattcccaatgcctgccaacaaaacctggtttagactttctgttttagagcattctggccaataaacttcacagagatttaaacaatagccctttggattcactttggattccttaagtccatggactgtctttcaaatatctaaatgaaactagacagaagttagaaaaaaaacaactagataaccctaaggccacaaaattaggtaacttcagagagaagatgtcagaatttttttatgtgcatcaagtctatactcatgggcagcccaggaatctgcgggtaagaagcactgaagtgataactcatagggttgaaaaaaattccggagctgatcacggtgaaggaaacataaagcacgcagttctaaaactgttttccagattgtattctttaacaaagatacctattatttatgcttttgaaaaaagtcagtgacgtccctacacagttcataatgagttctgcagattcatggaattcctttcttgaaatcatttcctttccctgaacttctatgtttataccatccatagtatcacatccatcttccagcttatttaaattctgactgtgaacagggaccatgtttgtatcttctgggctgtgctcatcaacttcctagtagctccataaacgtgtataacaacaatattaataatattaatgaagcactacattaaaaactacagcgtgtgtatcagtatttcttctatttccttgaggtacagcaagcaacctttgtagaatttctctatcacctcgtgggtaggagaatgaaaagagtttctctgtcaagatgatttggagcttttggatagtttgctccaagtcaacagggtataaaagaatggtccttatactcttgtgtattttgccaaaggcagcaaaataaattagtcatcatttcacacgtggccaagttcacaaaccatcacatcttgccaacgtgcccaaggaccatatctgtgctctgcgacctaaatacagaaaccctagtcttaatgtccaccactttcttgagtattttatgtcctttttgattactattaatgtccatgggaacagataaagtagctacaaactcttttaacaggtatgagtatcagctatcactgtaactttcattaaaatataaaaacagttaaaaaccaaacagagcatcactttttaatattatctaaaataacaataaaggtggtcagatggttacgtgttcatttaattgctaatgaagccagaccaataagtcaaagctggattccctgtagaatatcgatttgaagtattagcagcaaggatcgtttggtaagacagatttaaaataggagtaaagattttactttccaaggattcatctttgaattcttgtgggtggttgttttatttccagcctgctaaaaaccataatatcacctgaagcaagcaggcatgagcctggaacgggagtgaaatgacaacgaaacatttgtacatgttattaaagctaatgaagcaagacacgcactgcctggttttgtgtcacgcgcccctggagagcccaactgtgttctggggctggctgtggcatctccccaggatatggctcaccctgaggcctctgattcagcggcagagctgtttttcccctcgggaaagaccaaacagacacctgaccttttataaaacctctaggatgaatcacaagtaaagttctttggcattctgaggtggtgggtggaaatcaaggcttgacaggcggccatgggatgggcagcgtgggctggcgctatgggctatgccatagcgtggagaatccctcacactaggacccctggcctgcatgtcatctggcatccagaactcccactcaatttccaaaaggtgctacccaccctggaaaaaaatctagcccactgagtagctgggaaaatccacagccagggagacagatggctcaggaagaagcaatctggaataatagtgagggtgtgggagttggagtgtaggctgggcaaggagatcagagaggaaagaacgggcatctgtatgtggcgacagatgacggagtgctgtttgggacgagcagttggaggaggcaaaggaaatggaagtaatgtacttatgcataagggctgtatcataattaggaaaattccccttctgtctaccccgcaagtcccacttggttcagatgggggcagacagcagagagcacttacttcacggaggaagcagaggctacccgctattccaacaggctttctatttctgatagaaacaaatccaaactgagctaatttgtgtacagctgcaggcaatataaacacggctatttagaattctttatagagtataggcctttgtactctatacttcatggaagttaataagtaggtgtcaaactctgaattaaaattcccagaagaggacacagcacaaaggacaataaaaatgatttttaaataatcatagggataaatagcatccacttctgacaaatgtaagtgctggcataaaatgttattaggctacagagattgtcttttgttcaggaagtatattttattctcctgcctcatcattcatcatcctaatgagccctcaaaatgtaaattaaatagcaaagacggattcatttgaaaagcatcttttcaaaaaaaaaaaaaaagctaggtgttaaaccattttttctacttttattctatatattgtttcattttttcattgaaaaaaagccctcagtacttgaacactttatggggtaagttcatgcaattcatattttcagtaaacagttcattcattctccagtactatgggattggtgatttgaaaagaaaaaaaaaatcgcattttaaaatggtatgccctgtaaatgatgtttgatccggaaaatctgagaaacctgtgcacgcattcacttttttgttttattcagaagtgatttggtccagggaaaccctcaatggaaaaggattagtgaaaatttcaaacagctttagtttactgaactgaatgcattaatggctaagcaaacaccagttcaaccattaatgataaaagaagaaggtcatgagccaaattagttgcaatttcttgttatgtattgataagaacattacccgttcctatgatgaatagagaaatcagggttttgtacttgacctgaatttatgcatgagcacacacaacagaagtgactgaacagctctgctggggaggcacccaggaaaaacacgctgggaaaggaaaatagcagcaaatcatgtctcattttggcatgattggtcctcatttgcctgtctctctctctctctctctgtctctctctctctccccctcactctccccaccctctctcactgcaacccataaatcattcttcgcattctttggctgttcctgcttatgtgagagagctcagctcccagctctctgtgggtgaacatatataaaatgaagacacaagtaactgcactgttgaggtttgcctgatgtccagggaacagccattaatctgcacaagggggtttcaaaagccccactctgccgaataaattatcgttaaccaatctaggcattctaaagacactatatttttatgaggtcaaatgttgcagaaatatcccagagggagggtagaaactatccagctgtgaaagaagctagtgacagcactgcacagaagcctggggggtcctgcagtggctacagaccggctgcagccctggctgaagcacatcctcagtctgcctggttcatgaggactgctgcatttgggaagcactcatccctcacagcagtgcccaatgcaggctcacctctagagaaggggcatctctcttggaaggtctggctgatgaaagagcatatcatgacagacaggagctcatggtaaagcctgcataatccactggccatcctgttccagtttacttactcagttatttttaatggagaattttctttttaatgtgacagaactgaactcaatgcaaggctcaaggctgtcgtcatgacagttgcccacataaagaaactgtagtctgggcccaaggcatggccctagcaatttcccagtaatgcacattttgacgggcacatcaattggtttatgatgtaagaacaacactaattagtgaggaagaagccaatgtcctgtgttgatagggcccggtgcagtttaagtgatgaagtgaacgttacttctaacaaaggaaaacaaggtattattctgcacagatatttaactctgaagaagtgttgaacaatgatagatgtattttaaagtggaattgaagcttcatccacagtttaggaagagaactggctaggatatcaataaattgttttatatttgaccccaggcaggaaaaacaacatgcaacccagggaagggatggtgccttgctgtgaaatatgtgcattttaacctttgcaatatgttaataattaatatgaattcacaccaatacgatatcttcataaaaacacagaactctcatgtataaaacctttcaagtataaaagaaataagctaccccctaaaggttttctgaaaaaaattcccattaaagaaggttctcacagtctgaatgtagagacttttaaccagacctaaaattcttgcgaataagccccatgctatatgactgacagcaccattaaaaacgctaaaaaataaaatacacgcttcattagtctcccagctgaactcagaatctctggcccagaataaatcttagcctttaagaataaattctcttctgaattaacatctcagagtcattaatctttggagtgacccttcaatttcatttggagaactactacattcctcaaaggtcttttttcttttggcaagccatgatttcatggagagaaggaaaataacatgatctttcttttatcatttcctcattctcgccctcagggtggcttctcttcccttcccaactgaaacatcctaaatctaaaatcaacagagagccttctactgagtcagcaaggaactaaaatttaactttagggatacgtgaaaataaaaacaagactaggcagaattattattatacatttcaggaagaaaggaagcattatcgtgaacacaattttaccaaattaaaaatggtacagactttattctctatttcaggggccttgtttattaagcagacagaactctgcttgattattccatgaagtcgccaaccattaatcatgcacatttgtttaacaggtcaaatgaagagaggaaatttgtgtgcagtcacggcaaatactgcctcattttacccactgtgatactaaaggtacagacatcatgttgtaactacattaggagagattggtccataaagtaatttgattataattccttcttgagcagacaactatttttgaaaagcaaataactatttattttttgattatttatttttaactgataaaaagtatacgtatttatggggttacgatgtggtgttctgatagatttatacattatggaatgattaaatcaagctatttaacacatccatcacctcacgtactttcgttgtacggcttgaacatttaaaatctgcttagcaattttgatatatacattgctattaactatagttaccacgcttatttgcttatgtatgtatgtatttatttttgagacagactctcaccctgtctcccaggctggagtgcagtggcatgatctcggctcactgcaacctctgcctatggggttcaagagattctcctgccccagcctccccagtagctgggactacaggcacataacaccacacctggctaatttttgtattttttttttggtagagatggggtttcaccatgttggccaggctagtctcaaactcctggcctcaagtgatctgccagccttggcctcccaaagtgctggaattacaggcatgagccactgcacccggcctgcttattaatcaagattttcaaagttagatgtttaattaaaggataatatgtctataccactcatccaacaattttcactgtgaagaccacattagccagctcccagaggagacacattctggtgagggggtggctgggttcaccatattcgcttctaccatcctccaatcccagcctctccctctacctgggggattcactggaaccatccatttgtattcccacattttttgtgttcttaagccagaaatgtctcccatatagcttgccaactgcccaccgcttccaaacacctctatcctctactgccacgtgaatcttaaaatagagcttccactgttcagttctccagactcaccagccgttaatagcccctcatcacctagaggataaatctatagtcctcagagccaaaagcagccctgccctcagccttctcatctggctcatttgggcaatttcttctgaacagtctacaggcgttcctattgggaacatctgctcatccatcccacctgcaatgcctttcaaaatgtgattcaaattcatccactttaccctacctcacacacaaaggcctttccctcattttccccctcaaaacccaatgaccacactgtcttgcttgatatgcattccctcctgtctcacagggctatttaacatttcacttgtttaagtcttatccatgtttccctgagagcaggaattgtgtttggtactcacatgcacacagcctgcatgtaacatcacaccttacccagagtaaagactaaaacaaaaatgtaatcatttaaaacttattttcttgttcctactttcaatcaaggaatcatgagtctcagagatactctaggcccctaaatctatatttgtgcccaggagttgctgatttcagggatgggagtttcaaagagagggtgcagggtcttttttaagtcttgacaattccatccatggccccttgtaagttttagaggttgtgaaagatactgaatccttggggttccatgaacttgtctgtagtgggtctgtgcattcactccatcatactcttggttggcagagaagctcagccacttgggccactggaacaaggtcatttggagggcagaactcagctctggggcagatcatacgcacaggattggttttggaatctatcatgtgatagagcttctccacctaccttctcttactacattaacccataagagaggcttacctgttaccaactagtttcatcacatactgtctggagatatgacaggagatactggaacaaggaacacgcagacagtgaaagtttattgattcagtttacatttaatgattgattggtagaaagagaaacaagtcctgaacaaagtgtgcccctccttcttgatgccccaaaatgcatttaaaaatctctttcaaatatacctcgtatgtaccctctgcctcatacctaacactgatcacattttgtccagttagattgcacctttcctacctcagaaaggtttacctgaccttacttgaccatgctagcgaggtctgatcaccatgttccatgcacatattttaaagttggtggagcacttactttgtccctggccagctcctgctggggaaccttgtctttaaatggactggccttagcctgtcccaacatacacatgccccaagatgctgacagtaaattacaacatactcactcgagtcattacaattttttttttttcaggaataaaggaggtacgcgcaaggtcagagagcctcctaaagcagtttggacacatttccatgatgctctctgcctgagagcagagctaaaatcatccacagtcctctactgcctccccctccatgctacaaaaatgtaaaagatgcacatttgccattaggaaaactcctcattgcattttggacttgaagtccactggagtagggccatttaaaaatggtctatataccacgcttcatgaacaagttttattacccaaactgaaaaaaattagtgatggaaaaaataaggcagatgtatattacatcagaataactgctgcagaaaaaattccaacatcatatttcatttgaagatttcttgaatggccaaagagcagtatttgtgaaaatttttaccatatgtatttaggatactttcttaaagttttattttttaaagacttcaatttaggaaaaccatgtttaaaatgcattgacttcaactcatacctagtgctgtaagaagtaatgcatctcccttaacgaaatgtccagttactcctaatttttaagatttcatcacttctctcttaacttcccttaatgagaaggctgaactagctcgcctagctgaatttatcagtagcccatgcttgaaagagaaatggttctgccctctgttgggggcaacaggtgtgctgatggaagacagatgagctaatctgttcacctgaatcctctctgtcatgttcaatttagcctcagtctttagaaacacaacctaaaaggtctaaggcaaatagcagctgtccaaatcagagaccaaattagagaccctgtccctgagtccagaaagggtaaacatactctattgtttcctcaccatttgtttttggaaacacaaaattataggagggggaaaaccttattgttattagaatcatctttcagcaagaaagacaataaattctaagacccttagccttttgtataactgttcagtcaggggagtgttagcactgtgcttgttaatttagaatctagtttatgaagctgattatctttttaaagcaacacattatccgtgctcacaaaatatcatagtattactaggaatgtagttatcacattatattgtaattatcacttaaatatctgcgctgtttaccaggaaatataagctcttcaatgtcaggagttactcctttttcaaaaaaatcatggttcataacacaacatttgaaacatgtttagcattaaataaatatttattattgctatacttatcattaaactacgctagtagatatcaactattgagttcttattgcaaaaggcatcgtgctcaactctttccatacattgtctaatcctttatggcatccctatgggacaggtattaccaccctctgttcacaggtaagcaaacaaggcttagtaaggtaggtaattgctccagatcattcagctgtgtagggaagagacaggcttccatccagggccacccaactccaaacaggcacgtccctaaatgctacactaaatatccatggacgtccatgattctgagaactagctctctgcactcactatttgtaatcaaaatcagcaagtgttatattaataacttcagaaacgctgtcatagtcaaaaatttgcatcaaatgtcttagaaatgagcctaatagtcacaatacttttcatcatccccaagaaagagacgaaaaagtatattcccaataaaatacttggatggaaaggcacaactcgaaaaataaaacattgtaaaacttcactgtaatatgagaacaaatgaagagagcagatgatgaaggtactggaataaattaaagagagctcatctataaagcatagatatcgaggacaaacttacaacttcaaatgaataaaaactgttaattaaacaggagcttcagtatacatataatgtttgaactttgtcatttaaaaatagcatttcgttttctgcaccactagaaactacattttgaacacattcaggatttcacagctacaatactagaaatgtttattccaattaaatgttacaattactctactgtgtattatcttttcctttatttctccctatttcatcaatttctttttaaaaattgtgtaagtcatgcagtttttgaaactcaccatcttacaatgacttttattcttaagtatgtcagatggacatttaactcgatgtgactttaagaactctttcttttacgtaatcaatcacttgtcctaaaaagactaaagcatgtgcatcaaaactgtatctttttttttttaagcatgcagctgtctttgtcaagcactgcatcttttcaaggaaatgtcagcaatgttattcttgggcctccttctgcccaagaggccaaggagggatgaacaatgacggcaacaagacacttaatcaatagcagtcacagcaccattttttatcctccagaatcttcattttcaatgaggtttacatcattaaagtaagaaaacaggaccgtcaatctccattggcttcaagtggtggacggaagaattaatttgactgccataaaaataatgatgtagctgtatgctttaaacctttaaaaatttatttttaggcttaaaacctaggaggaggacagacatgttgcctagaaataaaagcactgatttatcaattctttctttttcttatattctagacagattttttttttaaattttatagatgtggtctcactgtgctgtccaggctggagtacagtggctattcacaggcgagatcatagctcactgcagcctcaaactcctgggaccaagcaatccttcagtcagtctcctgagcagctgaactacaggcctgtgccatggggactgactccacacagatttctaacagatctgaatcttgtaaagaaaggcaataggtttcaatccaagtccttttaaggtgttatgaataatccatttgaaatatatttattagcagaggtacctgtgccattgtttttgaatcatgttgacacatgccatctccaacatgtgttctcactatgacagatttatatgaaaggagtaaaaacatcacaagcacccgcataacgccttcccaggggcagaggcaggttatctgggcccttaaaagctataatgctatctttaaagaaaaaagcaaaattatgggtttgaaattaagtagagggccttagaagaggacactcaaccccggagccctgaaacttaagctgtttttttgagacagagtctcactctgttgcccaggctggagtgaactggcgtgatctcagctcaccgcaacctctgcctccagggttcaagcaattctcctgcctcagcctcctgagtagctgggattataggcgtgtgccaccacaccaggctaattttttttatttttagtagagatggggtttctccatgttggccaggctggtctcgaactcccgacctcaggtgatccacctgcctcagcctcccaaagtgttgggattacaggcatgagccaccgcatccagcctgaaagttagacttctttaatggtaaatctgcccctgcctcatccaccagaaaacacaggtgcccttttgcgtgtgcacaggcgagttctgaaataggagggctctctgtttggtctttttgttcccacagtgttctcccccgagtgccccagacattctgtgtgaatttggtacatgtaccagcatacgcctggagtggtaatgggacaccagctcagccagcggtgctctgtgaattttctggaaaactacaggtggccacttccacccaatgaggcagcagcaagggaaatggcaggacaggtgaagggttttgattggtacaaaattcagggaacacacaggctctgtcattaggtgtacgttctgggttctcatgcctagctctatacattcaaatactttgcttctaatcctttagttttggtattcacttcaactgaacattcatcagaaatgcaattaaaaatacttttaacaaatgattgagatacatgcattcccagctcattttcaattatgacaaaaacaaaacaagccttgcctggacagtcacgaggcttgaccgggcacactgaatgctcagaggtcagagtgggcaggagccccggagcaggaggaagaagcgggcaacctctctgagttctgcactttctcccaaccagcactctctcacaggctgcacactaactacccctccgtgcccctgtccttcaaagggcaggactgtgggggtgttgggggcaggctttgacgtgcaccacttctgtctgggcacagtgacctctgcatgcccctggcctatcaggtacagatccacagcctgtcagttgcaccctccctgacaccaccaccgggacctgcacagactgggagttcatttccttgctcactggggcctgccttccccaggctggtgtcttctgatagccaaactgaggggtgggaggtattttgaaatgcagatttaattattcatgtgtggtgaggccaacagatcaggagataactgccactgaaatgatagtttgttacacacagttcccaatgggaggggacatgccacacacggtgggggtcacacagggaagcaccaaggtcagctgggaggtagagggagccagggagaaaagtgggcaagagcctttattgttttccatgggagggaacggacaaggatttgagtaagtaggtttaggattggctatttggaataacttcagcgagatctggagcacagaggctgtcctgagttatctggtatgtgtcctggattgattagggcaggagacaggggcccagagtgtgagagcccagaaaaggaggtggggtatgggctttggagcagttgtttgtgggtgaaaggcgtgttcccagcagcaggccaggcttttgctgtctccgggaattagctagcctttcagggtcagtgaggccctaagatgtcaaagcttcaaaatgcagaataaaaagacatgatcagtaaagaagcgaacaaggagcaggcaggtgagcatcacagcctccagcagaggcagccagagtctgcccagcccggcaggatgctgaagctggggaagacagacttctcttacccctgctgcaggtgcgggcaggcgggcgactgagctttccactttggtcctgtgacaaatggaggacagctgcagatggatgtttcacccaacaccaagcaagcagacataacctcactgtgcgaggcgatactgcctcactgtacagatgaagacacagaggttcagaatgtgtggaagggcttttcccagggtcccacagctcatagttggtagagccaggattatctccattttctctctcaggccctgggcttaaagcccaccagcacattttttttttttgagacagagtctcgctctgttgcccaggctggagtgcactggcatgatctcagctcactgcaagctccgcctcccgggttcacgccattctcctgcctcagtctccggagtagctgggactacaggcacccgccaccatgcccggctcattttttgtatttttagtagagacagggtttcaccgtattagccaggatggtctcaatctcctgacctcgtgatccgcccgccttggcctcccaaagtgctgggattacaggcatgagccaccacacccggccaaagcccaccagcttttgaaggtctcgcacaaatgtttcagacctttagaaggaaaatatatgggctccaaaataaaaagagaaagcaataatgtcaaaattaataatgtttaattaaacgtctaaaaacatattaagccatttttattcattgttacatttagttttcattacaaaattcattacacttgaaaataatatgtagcttagattttttcccacattctaagaattcttgagtttgcctaatgataactgagaagccaactataaattaaatgaattactcatagtcagataactccaaaagcaaaattataaaagctctttataaagagctttataataaactttataaagtttaaagaattttttcaactgttgtatttaatatgggatgtgagtctattttaatctgtctcccaggatggggtggggcctctgaaagaaagcaggcctactgtttcggaggtcttcaaagggccctgcctgcatcaacctgctctcaaattccagctccttctactcgcattccctccccagcaacacctgccctggacggcagttccagaggtcccttcagagcaggcccactgctgagaatggctcaggggctctgcttcctgctcaagacagcatccgatctctgtagcactgcaggccctgactgctcccacagagtgttatggcctctacgcacaccaacatcctgagcaccagagggaatcttgggagatcaatataattgtggagaataattctaagattacctcccagctcgtggtggggcccagcattcaactctgggtccttccatcctagaacagcatagagggaaggtgtggacttggggggtgaccaatgccagtgaccaaggagaagctgttccaagggtgggcaaggaagggaatatggttgcttaattctcacctccctggcgctcccacagatcattctgtgcccatgaagaagacatcacagggtgaaccatgaccattaacagctttgctaaaaaaatccacgtaactgtctttgttacccatggcaggacctgcctgctccctggtgctggggccaccttctgctcaggatgtgacaatggtcacaccttctcagaaccttccacaacaggaatatatctgattatatgaatatatgtgaagtatttcacagagtgtgctacacagagcaagcatttaatacgtatgactgactaggagcctgacagtctctatttagacagcactgtggactcaatgcacgtttttcctcaaaattcacaagttgaagccctaaccccagtgtgatgggatttggagatggggcctttgggaggtaattcgggttggatcagatcaggaaggcggagcccttgtgatgagtgtccttgtaagaagagacatcagagacacagcacaaaggtggctgtctgcaagtcaggactggggctctcaccaaacactgaaccctgcccggccctgatcctgagcttttcagcctccagaattcggggaaaataagttccccttgtttaactctacagtctatggcattttgttacggcagcccaataatgctcactgatggttttataaactagagaagaacatcaactaacactatttgattttcataaattgagaggggctagacacagaaacttccaaatacctttatcactatccttaaattctatttgaaatttttatctatcagtatttaagggactcagaaactgagaatctgggttcagactacttgagtttacatcccgttctgccactttctaagttttgaggctccatgtatctgaaccacaatcttcttatctgtaaactggagctaataaccggccttctctcatggaatggttgtggaaattaacccatttatgccagaggttgcaaatttctttttttgtgcaaaatcagacctttgcaatgaccttgagtagtaggatataaataactcccacaagcttagcaataatggaaccagtaatggaacactaggcataaatgggttaaacaggatgttcctcacaaagcccagaaaaatacacattgatatggtgcctggatgcctttttttgaaaaaaaaaaaaggagggaaaataaagataatatttatggctacatgtgcatctgcttaaagaaaactctagaaggacacacaaggtaatactaaatatggttgtggtgggttgaatgttgagggaagggaggagagaaaaaagggaggaggaagggaagaaagggagggagggaaaaaaggaaggaaccagaagcagtgtctggtacttcatcagcattctggttgtttgacgttttttctgatcagcgtcaggaattttttttttttttttgagacggagtctcgctctgtcgcccaggctggagtgcagtggcgcgatctcagctcactgcaagctctgcctcctgggttcacgccattctcctgcctcagcctcccgagtagctgggactacaggcgcccgccaccacgcccggctaatttttttttttttgtatttttagtaaagatgaggtttcaccatgttagccaggatggtctcgatctcctgacctcgtgatccgcctacctcggcctcccaaagtgttgggattacaggcgtgagccactgcacccggccaggaaaatacttttaaaatgcttaaattacataatacataggtgtatgcttttagaaacatcacacagtacaaaagcacacagatttaaaaatgtaagtccctcttctgcttcagtctgtatccaaaattaaccaattactaatagctttgtgtgccattatttaaaaataaaaatggaaccacgctatgtacaggtgtggcagctgcctttcattcagcatttctcgaggccttttcattgccagcacacataggttggctccattttgtgtaactgacacatgagaaaccacaccatgattacaccacgatttactgaacttcttctgtataagaaagcactggggttgttgacagtttttctgtatatgagttgatgcatgagcatggctatttctactggatatgttctgagcaaggaacatcaagctcgaagggctcacactttcaaattgtatagatactgccaaattacattctgcaaagacaatgcctgtgtccaatcccaccaacaaggtgtttcccatactttggaagagatttatgtaaaaatcatgtaaacatttttaaagtgttttttaagttgaaccgcaattcagaaacattgagtagaagtgtgtctttgattttaaaaagatgatatgctgaaatttagatacgctgaagtgcagagacattcttgtggaatagggatcagagccttcccttatatattattgaactgcatccatttacataaccttctgaagtcagttttataaagaggccaccaggctcatggcagacaggatcttacccctgataaaggctgacctctgacactgcaaagcccctcaccaccgtgccagccacagtgagcgtccgggctatgctctccatccttgctgacgaacagacagagcacacagcagggactcggtgggagtgatttaaagtactgaactgaagaagggaataaaccatatttgcacattctccatagctgcttctacacttataaaaagctgtctcggatgggcgtggtggctcacgcctggaatcccaatactctgggaggctgaggtgggtggatcacctgaggtcaggagttcgagaccagcctggccaacatggtgaaaccccatctctactaaaaatacaaaaattagccaggcatggtggcacacgcctgtagtcccagctacttgggaggctaaggcaggagaattgcttgaacccaggaggcggagattgcagtgaggcgagatcgcaccactgcaccccagtctgagtgacagagtgagactccttctcaaaaaaaaaaaaaaaaaaaaaaaagctatctcattttttcttttttcccctaaatttcaatggagaaactggcaatataaaactcaagaaaactctgtccaccttaagtttctggataaataactagggaggcctaagttggttgtataataagtagggcatttatatgaccttgtaaatttgtatgaaactgtgtactatggaatgcaccaaacattctgcattgaggagtttcctactactatcagggacctctgaagcttccccatctaaagactcacctgtgatccccaaattccagaaatatagaaagccatcctgacccactcccatgctgcagccacctgtccataagcccactcctgccacttctgcaggagtctctggttcttggagttatcttcctgggtcagtgcctgatgccttttgcatgaactgtcacccaagaacctgtcagaagtttccagctgaagtgaagcagatttaagtgaaatgactctaaatttctagtcaagatgtttcatttgatcatttacttccctgtcaaaatgcttttttttttttttttttttttttttttttttggagacggagtctcactctgtcacccaggctggagtgccgtggcacgatctcggctcactgtgacctccacctcccaggttcaagcgattctcctccctcagactccccactagctgggactacaggcacgcaccaccatgctcagctaaatttttgtatttttagtagagacggggtttcactgtgttagccaggatggtctcgatctcctgacctcgtgatctgcccgcctcggcctcccaaagtgctgggattacaggcatgagccaccgcgcccggccctgtgcattcttatttcatagttctctctccatcttcccaggtgtacatgaactgttttgcaagtacaccccgtgaattttaaagaaatggtttacttttattagttactacatataatttttttaattgtattgtgaaggctttttaaaaagctgaacaatagttggttactttatctactaaagttaagtgaaatagatatttactacaaaataaatgaaaggtgaattcaactaatttaccataattatgattgctattttgggataacaaagaccaatatttaaactgaatttcaggactttttattcagcagcaagtataagacaaattggatggtaagcatatatactttgaaatttcattttcagtcacatgcaattaatttgaaaataaaacacccccctggctcccattctctccccctaaaacatcattccagcctattttcatagaatcgtaggagtgaaatagagtcacacggactgtggctatcaggccccctcagacttactcaaaatgtctctttggccaggtctgcccatcctttggtggaggcctgctcagacccactcgggtctctctgctcatgttggtcatctctcctcacactgacctcccactgcccacaccagaccaccttttcaaaacccggcttcttatctcaccttgcaaggcctctgctgaggattttagtgcccggttctaacttccttccagttctggagagctcactgtctagaccactcctgttagtcctcattcacttaccgtcttctatcatcatttgacagtcctttctgataagatcctttaggagtgagacacacatatattgttttatttgaccagtaaggtaatgaatatgtagttagcaaatgccaataaacactgaattgaaatacgtagttgaaaaaaagatgtaggcaaatgaattttatgcacttaagagccccagaactctaatgcaaaattataatctgccagtttaataaaaacacattaattgtgaattgataagaagaaacaaagcctctcaagtgattaccttctgaaaaatactggagacctcatctgataagctgggttgacaagtcttaaggcttttcaaagtctagctccctctgtaatttccaccaagtacacgacaatgttatatgagaaccacagaaaaaatgtggctgcttctcttccttcctgttattaacaaaaatgtttgcagagtggaagatgtctgagtgctcattcccttcatttctgctttagcttcttaaagaatggacattttttccctaaaggatcttcaaaataataaccactcccatttactgggcacccaccccgtgtgcagcacaacgtcaaacgccatatgggatcatctcactttaccatcactcaagtcatagaggccagatcctccacaaggacactgaggcaccgagagagagtgggtaccacgatgccatctcgcagccacatccttgccctgctgccaggctagctcttgatgctgaccacagctctccaagcccatcgcctaggagaagctgtgggtgcaaacttcaagaacaagctcttcctcaggaagagtgcttctgtgagccactggatctggggcaacttctccttttccatcatcttctctgccccgggcatggcatcacagtcttgtccacagtcctgcacttgctcacgttgacactgggggctgccatgggtcgcctctggcccacctgctgcacccggatactgaggaagcccattccccaggaagcctcttgcggccacccactctgatcacctcctgccaccagaccaatttttcagtcatacattttcatctcagcataaaattctaagacagtccccactgccttcaggcctgacatcaaaggctccactgcctggggctctctcgctttggccaacgctgactcccactttgccctgccctcacagggcctgtcctgcctcctccccaccagcagcccagtctccttcctgtttcctgtcctccactccttgctcccactcttccctcaaacctctgcttatgctaatctcaccttctaaaccaagaccactgcaaatgccgtatttctgctacagccattgtcacagggctgggcacacagattgtcttaataagtacctgtggatttgacatgtctggattttggcaacacaaatggaatgcaaaatactgaatagataagaaaacaaaaatgcctacttctgaaaaaatacctcttcctactttcacgccacattcacaaatatacacaagttcttccaactctcctaatcttggcaagtttaaactacagttttctgaaacaaaggtcacttgctcagctacagataaataaaaattcacaagcatctccaggaaaatcaatacaggtactaaaaaatctaagttgataataaatttcagttccccttgcacatagctcaggaatgtcactatttactggaatcactgtaatatcagatatttcagaagagtattgatttggccactgaagtgtgactaaagggataaataaactgctcctggggtcaatcgatccatttatcttcactggtattttataaaaagtcaaagtagcataaactttgataaataaatgttatcatgaaagaagtattgctgacataaggatttgaaggaaaaaagaacagacagttccgctacctgaacgccacacaattggcttcacattttagtagttttaatagtagctaccgacatagaaacattctttttctcctgccctacataatccatggggccaggtcaaagtctgagccacatggccaagaaacagaggggccacaagtcaagtcctaatgaaatagaaaggcaaaggaaataacatttgtttctgccttattagaaagtaactgctagggtctccaaggtagacacatgtctttggatattttgaaggcacgtctggaaatggcagaactatttagacttagaaaatcaggatggtgtgcactctgaagtggctttttagggctttattgttaaaccatgctgcaccaataaccacttaactgcactgcaatgatcccataagatttcaatgcaaggccatggagagctcacaacatcgtggctgtaataggatattaaggcttgagaagaattttaattcaaatgtaggaaacgtgggaaccctgtgaagaggctgtaacttaccatgagaaattatactggcaaggttttactgcagttgtagggagacagtattaccatctcatgatgaaacaaagtgatgatgatgaaagtacatgagttgatactgtaatttcagcccaataaagacttcacttaaattaccataccccaggggaacgcacagctttcaggatgcagagactgttatagatcagaaatttggtttgggtcacctctaagagggctctcaagctttaaaacatttccaatccaaatatgtagctctaagactcgggcccacccccactccccttctcagtgaccacccagggctcattcagaagctccttattttaattcttgccttcacacagaccactggaccactgccgccttcaaagacccctgcccatagcgacaacgtttttcagggtcccattggaggaaagcccactcagcatttggtgaggcagctaaaagggctgtacctcctgcgggctggtgcagtgcccagcaggacacagtgggccctggatacaatggcatttactgactggaagtgtctgggtggccagaccaggcctgggattctctgaaggtcacagaatgttggcaatgtggttctagcagctgctagagctactctgggcaagaatagagcggtagccatgggtacagtcaaagggggaaatgcccatgacgaaaggctgtctggcaggtttgatgatctccgcaaaataggtctggctcaattccgtgacggcaggttgctagaaagagtccacagagtgaacaatgctactcattttcctccttctcctaaagagccgcaagtgcaggattagccacaggctcgtaaaaatgcaggtcccctctaacagcaggttgctccatgtcttttgaagaaacagactgtgtgcgtacatgcatgtgtgcatgcctgcatatgcatgtgtgtgcatgcatgcaatctggctatgaacgcattgcaaaaagtctctctgatgtcatgacactaaagaaataaggtgaggttatctttgatgggatgtctcttttctcttttttacccctcaattcttctgaggtgtgctgggatccctgaagatacctccccaaggcattatgtctgcgtattttgagcctgctctttctctaccatggatctcctctacatgtggattatttagtttggctacagaaaatctaaacatcactgcagctttgtctgggtgcttgggctgtgcagcaatctgtgtttctcccgctgtcaagtgggttcttccaaccctgctggcactactaaaccattgccctcctctctcttcacagccgaagggacacctccacttataagaaactcattatcgtgatcccaacctgctactcttcaggtgttcactatttcagagaatggctggcaactccacccttcccactggccaaactgggaatctggggcttagcctctcctccctcctcatttcacccccatccaatgcatcctccagtctttctgaagagccatcttctctggagactcctctccgttgctgcagtactgagtctagctcaagcttccactcattcttatcaaattgttgcagtcacctccctgcatctgctctttctccagtggtttcccttgctgcagtcacagggatgtttctaaaacaccagtctgattatgttgctccctgcttgagacactttgatagctgtgccccccagagcagaaggccaactgcttgtcacagctaagaaggcatttcatgaccggtcccacagtcatctctttcagctcctgtcacaactccacgttccggcctctttccacgctcacccacactttgaggctttgaaaatgtttttccctctgtgcctcctttgcgtctctgcttggatgtaattttctcctacttagaggcagaggtccctcctgggtgctcccacagaacccttgtgtgcgggtgaatactgttcatcaagtatagatgtctgacatatttggaagtatatttgcttatgactgcttaaactgtaggctcatggactttaaaacagtataaactttaataaatagtataaataatttatagccctgtaaattcttaaaatctggaagtcacatgctacaattagtattgacttgttatacatatacaatgaaggaaataattcttttttatggacaaactaagcatttgtttaaaaccaatgagcgataaactctgatttccagtgtgcggctcttctgaacgttttaaatgcataaatacacaaacacacaccgcgcactcactacatgcttgggcatattcagcagaattcaactgtcatctcaactcaatgcaggtgtccctcgtcaaggcaggtgtacctcatcaatgcaggggtacctcattttacatgataggcattcttttaaagtagcatgcaaactcagtttttgtgaatcaaagttgattttaagtgtcccatttgagcaaattctatggtaactgtatgttcaaagggaagaatcacctccaaatttaaccttcttgagtaatccagactttcataattggatttacttaaagcagtattataaagtaattaaattgattttaacgaagaataaaacacaaagaaaaaacagtaagatgtgtggatcacattacacactgccaacatcctacataatgcaaacactgagatgattaagctgtctgaaaggcctcccatgcataatgatggaaaaaatataggaaagtttagagtttatattcttgtgaatcccattttatctactaattcaaatttttctttctcttttactctcaatttacaactaccaaggacacaaagagcattctatattgaagccatttctcctccagaggcataacaatgagtttcatggaagaagaatctcaattttctgaataaatatgaataagtaaatagttgcttaggtacaccagcatatatgtataatattattatgtaattgtaccattacaccctatttcaaggattcttagatgctaccagtataagacactaccacgttgtgtgccatttagagagaaaaactgccaaccaaattatgacacgtaatagattgtaagacacagtccaatttcagagctattaaaatgtgagaaatgtgtatcttttaatcaatgatatatggtaacaaactctcttctgctttatctccagcatttggaaaagtgcttggcaacagtaaacactctatcaatactttttgagtacaggaagaaataataagtgaatattcaaaacaatgaaataggtatgtatcttgcatttaagacaattataaaatgattggcactgatcaaacgttttaaagagcagtagttgctttatataccagattatctcttctttaaaattagagttcaagaaattggaatatcaataataaactatttacagacttccatcacatagataacatcatcaagtttaagataaataaaatcagatatgaatttaatgagatttttaaaaactagatggtgaaaatttctgttatagtttgaaatatatttgtatttgtctcctagttgacttatctctcaggtctggggtatcttaatgttactagacaccctataggcttctgtcttgagtcacatccatttgaatggaaaatgccattttatcattgctaacaacctgctgatgctgccaattacgaaccttcttcctaaatacattacaggaagtccactctatttatcttctctatctgacatccttttaagacattcccagtagacagcccttttctaaatgaagagagaatttaataacatctcattcctgcttaaatttgctaagtttaaagcaactgttttatatatcttctttattaattttatcattcatctgaaaactcttctcttttcttcctcacttgttctgccttcctgggctcatgagtatgaaactggaaactagatacgtcatttctgatagctttaccatctgacgctcagctggaaatggaagctacgatttccccaagccttgatctccatgtataaatgctgggcctgtcaggtctgagataaatctgtgtctcctctgtgcccaatacacaatgcaaaacagggtccacgcccctggagagtagctaggcaaggacatcatgttctatctttaaaataaaatgcacatcctcccattaaatggcaaatccttcatttctaacggttgaataggatggtacttacaaatgaattccacttggttaaatttagagttcggaaaaaaaaaaaaagtcctatccaaaaatacactctgccttggggccctttttgtctgattttgaattaatgtatttacaccctttcctctcagtatcttgtgagacaaacactagttgatataacaatatcagactctgaaatctgaaacttgaatactctgatttagttccttgtacagttatttatttaaagggggctttctttttattaatatgcttttcagggagggcactattgaaagcttgtgtgtttttcattttgtttgtttcttcaataatcaaccttccctttgccgcttccccagacaacccaggagtccctcctttcccacagggagaggggaagataatcccgaatgagaatggcccgttccatagcctgtctccttcaagattctctctgcaaaactaacataggtgggtcctctttttcagggccccttaggtctagagttcgagccgttcccatattgctggtgcttgcagccctccccacagcagtgctgggctgctccaggatggtgcctaggtgcccagtggccccatcatcctgactcccctttcctccaatctccccactgctgctcccaccactggcttcttcctcctcatgccagactttgtggccttctcctctgtggctgtcactccagcttttcctcctcctgctctctctaccacctctgccccaatgctgagacagcccagaaacatgctacccatggcagcatcaagggttgtgttctggctgctcacaactttgtgggaatctgatggcgcacgtctgttctggaggaacttgctgctcttgccctccgtggagcccacgtcttcacagagttgccctggagatgcctgctcaggttcttgctagcctaaccctgcctgtctggggaaaggcttccaacaagaacttgcataagagctatcctggtcatggtgaccatcaacacagaaggccaaggatggtcacccatgagcctgcctcaaattctcagtccgaatactttttgtctgcccctctgccctcccttcctcttgctcaaaaattaagactatatcatcagctacagtttcttctcttgttgtttcagatgctggttattgtaaaatgccaaggaggaaccacactggcttattgtttgttccctttgctctcctgtgtttattcctagcttcctgcatttctgcgtattggcacaaatataaggcttttgtttgaattttatatttcaaaaactataacagatattcatgagtttaatttaactgtctacttactagcagccatgcttgttaagggctgcaataaaccaactgaaaaattaagcactccacttcctcacatcctaagcaatgcattattttaagagtcctgtcattaggaattcagttggtactcataccagcagcagcagatcctaatgactccatttggtattcatacagatgttatcatgtatcacgccctccactgccatcagagaatcattcccattcaatgttttttttttaattccctgtgtttgataaatacgctgataatctttgctctgcacaataaaagaatattaaattcaggcctgactaatgcatggctggaaacataaaagaaactttcataggtcccaacaccaaaatactctgacctattcctactactccagccagctgatttttaggcattcttacatttctggacgccattctaaataatgcgaagataaaactctctaaattgaatcttaaatcttaaaatgtaccaaaccataactacctttgactgtttacttttatcatgccagatattcacttgattgtcttaacagccccatgaagccagcattattaacctcattttatgcaggaggaaagagaagcaaagaggttaggaaacacgcttggccacagagtgaggatgtggcagagctgggcttcagattcaggacttctcaactaccaagtgggtgctttcggacctatgtgtcagccagcaatgtaaccctacccctatctatctgggatggtcagttctatatgtcaatgaggcaagacctcagtccccagtcattcaatcaaacagaaaggttattcaatccaggtctttctgtgaagttattttgtagataagatgaaagtcgataacaataataaaaaaaagtctatcatcagttgactttaaggaagagcatcccagacaacctgggtgggcctgattcaatcagttaaaaggttctaagggcagaaatgaggattccctgaagaagaagaaattctactggtggacttcagcttcagctccggaccacatgtttctttctacactgctcttcctgatggcctgtccacggcttttggacttgcctgctagccccatattcgtataagccaacaccttgcaatcaatcaatcaatcaacctacctatccatattacacacacacacacacacacacacacacaatctatgtacacatccatatatcgcctactgtttctgtttctctgttggagcccatactggtacaccactgaagggcttttactgacgactgaagagctctcaggtgctaatactatgccaggcactctcacctgttaatgtactacaagtctatatgtgtactacatgccaggcaattactgaatgagccacagtctttaaaatcaacctccctcaaccccttaatgacaagcaatttaattctagcaacactcatggctatttctccttttgtaagctgggcctctttttatcctaacggaggtggaaagttacaacccttcctcttcacaatctgaagccactcgtgtttatcatgtcattgataaaaagatgataaaattatgtaaaacctgtaagttgcctaacactgtgccaattctgttcactgtgtgtaattttattattttatataattaacaagttcatgcaaaactcagtcattctatgtgcaagattaaagtgaagtaattcgagtattaccaaaatattattccttagacaccagtttagaaaagcctattcttctcttcaggttaaataacccacgctttcttaatgcttcactgtgaatcatgcacccagacttggaattacctcccttgtctgctgtggagcttttactattctttttttttttttctcattcaaagtagctaacattgcctttggtcttttaataaatgattctgaattgttgaggaattctggtttttttcttcttgttgttgttttgttttttttagatagggtctcaccctgtcacccaggctggagtacaatggcacgatcccagcttactgcaacctccgcctcccaggttcaagcgatcctcccacctcagtctctcgattgcaggtgtgagccactgtgccttgctggaatgctactcttaatataaaacaaatactatgtttactaaccacattcattcttgggttcactgtatcctttttgtcccactagagtctaccttctgattctccccttccaagcaaagagaatcttgatcctttactgtcagtcttgattcgagtgaatgagtactggcctatgaccatgggatgcgtacaaattatctggtctttaacaaaactgtctgcctgatgcttgtttccattcaggtggcttatgcttgcccaactttctcctatttcataaattttaatctgttttggctatgtcacctcctgcctattggtctaaaccaataactggtcacctatttgccactgaacatagttttcaacttttcactcatgtcattgatcaagagatgaataaaaataacctttttttggaataggtggggaaagaattccctatttaataaatggtgctgggaaaactggctagccatatgtagaaagctgaaactggatcccttccttacaccttatacaaaaattaattcaagatggattaaagacttacatgttagacctaaaaccataaaagcgctagaagaaaacctaggcaataccattcaggacataggcatgggcaaggactcatgtctaaaacaccaaaagcaatggcaacaaaagccaaaattgacaaatgggatctaattaaactaaagagcttctgcacagcaaaagaaaccaccatcagagtgaacaggcaacctacagaatgggagaaaatttttgcaacatactcatctgacaaagggaatatccagaacctaaaatgaactcaaacaaatttacaagaaaaaaacaaacaaccccatcaaaaagtggacaaaggatataaacagacacttctcaaaagaagacatttatgcagccaaaaaacacatgaaaaaatgctcatcatcactggccatcagagaaatgcaaatcaaaaccacaatgagataccatctcacaccagttagagtggcgatcattaaaaagtcaggaaacaacaggtgctggagaggatgtggagaaataggaacacttttacactgttggtgggactgtaaactagttcaaccattgtggaagtcggtgtggcgattcctcagggatctagaactagatctagaactaggaataccatttgacccagccatcccattactgggtatatacccaaaggattataaatcatgctgctataaagacacatgcacacgtatgtttactgtggcactattcacaatagcaaagacttggaaccaacccaaatgtccaacaatgatagactggattaagaaaatgtggcacatatacaccatgaaatagtatgcagccataaaaatgatgagttcatgtcctttgtagggacacggatgaagctggaaaccatcattctcagcaaactatcgcaaggacaaaaaaaccaaacaccgcatgttctcactcataggtgggaattgaacaaagagaacacatggacacaggaaggggaacatcacacaccggggactgctgtggggtgaggggaggggggagggatagcattaggagatatacctaatgctaaatgatgagttactggagggaggggggagggatagcattaggagatatacctaatgctaaatgacgagttactggggggagaggagagggatagcattaggagatatacctaatgctaaatgacgagttactgggtgcagcacaccaacatggcacatgtatacatatgtaacaaacccacacgttgtgcacatgcaccctaaaacttaaagtataataataataaaaaaaaaagaaaagaaaaaagaaaaagcgtttctccacagagtggagaagttcttttgggtctcggtataggccatgtcagctgcacagtgaaaaccaagaatgtggcattccttgcaaagaaaggagattcattttgaaattgcttctcaactttcacgtaaattatgcccaatattttaacacattgacaatatgatcagctttctacttcagaatgtgctgagttttttccctatctttatgcagttgtgaagtacctatgaaaccaagtggataaacacagtgttatgggctgaattatattctgccaaaagttcatgtgttgaagtcctaaccccagttcctcacaatgtgacattatttggagatagggtctttacagaggtaataaagttaaaaagagctaaaaataaataaataaataaccttcttatgtatagccgcagtatgttcaatctgaaatgaactttgaaatacaaaatgtactgatttggattgaaaagagcattactacaatgctatcccctgcctcagagactattcgctaaatattaattctattaaaatgaccattcaggagaaaagcactcttaatacctgatttgagaataagcatacttctgtttagacaataatagaaaacaattctcccattatttattcactaagcattggtagttagcatttttattgctcatttgttttcatttccaagcagatttttcaaaactagacttgattaataatatactatattatgtagtagcatttggatattataaaacattaaggaaaggtctagatagaggatacaaatatgttcttcctccactgctactgtacttcattttgatcactgcatgtgcaaaggtatgcatcagaaacttctagatgaaaactgctaattattacaaggatgccataaacaatcttgccttctgcatcactgtgtaatagtgcaaacaggaataacatgtcttggaccaaagtgtaaggaaaactgtgcttctctaagttgctaagttgatatttaaggacaatatgactctcaaagcccttcgagtttctcttttaacttcagctgctaggaagctcaaatcctgtctacaggctacttttacttacaatgtaataattgcatgaattttaacaagtcaccttacattcttttctaaagaaggacataagaatagcattgtagtttggaaggctaagatatatgtgatcatttcgggagctctgaccagcttcgctgtttggctggacaaatcacataattagagctaacattagacacttctccacataggaaattaagactctacaatgccttccctcttatccaagctcactctgatatttggtgaagtttaactgaagaatcttaaaagaaagcttttacataaatgctaaggaaggcataaaaaatgcttctgatttgcgcacacatgccgtataataacccagtgcagtgtctgagtcagagctgctagggtgtgggcttcctggggcggagcaccttagtccatctattctgttagttgtctgatgctttccttttgacaatcgattgacctgttttgtaggaaatgtggcactatgggtcttcatgattttgcatgattagccgggcatggtggcacatgcctgtaatcccagctactcaggaggctgaggcaggagcatcacttgaacccagaaggtggaggttgcagtgggccgagatcgtgccactgcactccagcctgggcaacagagtgagacttcatctctggaaaaaaaaaaaaaaagaaagaaaatgcactttttatgctgagggacaggcagtgcaaaggatgtgagtctggctgctgtcgcaggttctgacccctttgacatggaaaaattccaagtaggaaggttcagtagtcatttggggtttccagtgccctaggactcatactgaactttactgatcaacacttgaactgcacagaaatgcagcttgtaaatgcaggtattatgtattatttgcaaaatggtcctttgaaaaattaagctgctctcctcagcagcagctgccatcatctccctgaaagaaggctcagtggtaaacgaatggcagcccaggggctgcaaggaaagacttgtatcaaaaacatgtgcaccacagacacaaaacccactacctgtgccaggtgttagagaactctgtgttgttatgccataatgtgaagtttcaagaagaggtgagtatctgcaaagcaatttaacattttaaaagctgtaggtggtaaaggttaacctccctggtgattcatcaggactgtcttgttaagagtggcagaatttacaagcacaaaataatagctggcaggagaaagtgcccaaatgaaagaggaatagaatccatctacagccagctcaccaagcctctgaaacaggattccttggcatgtggaagtaattcagagatcaatgggagtaatatattgctctttagcccaaaggagaataaggctacattcacacaactaaggaatagtgagtcctgatttctacaagagattagcctataaaaggaagactgtcctatttattaacataagaacctagcattattagaggcttagggcaaaactccaccttgacccatgcgaaaatatttgcccagaaactaacaatcaattgttttacatttagctaaagttttatgcttgatgacaaacatagtccataaatgccacttggtaatttgcattggtaaaaactagccaaaagtcacacttagggcatatgtgcttccaaataccgcataacttgttataacatgtcctcaaatttacaactatgctgtatgtccccattaaaacccaataaataatttctcttcaccagtgattatgaagatttttcttcattagagtagcttccaatcatgcagtgatttcaaaaggtcctatttttaaccccaataaacatagttgtatttctcaccaaatgggccctcgagatcagaaatcactaggatatgaaagagatagctacatactcaatcaggaaaccataaatttaatgaggcaaaatctcacagggtcatacatacccaatggataacatagggaaacaaattcttagcttactgtttctctattagggattgatttttgccctgccaaaattgcatatccatgagcaaaataaattgttatggctactttaagtcacttaattttgcagtactttgttacacggcaatagctaacccagaaatgtccttaaagagatttcagagatgcatgtgaagggctgtcctctttacagagacacacactaagtaggaccaaaatagacaagagaaaggaaaaacctccatctgcgccccaacacactgttccccactaaccccacactccatcagagcctagactcacaagccctttactgtgttctgataaccactgtgacaaaaccaattcaatttcaccccttcagttcagaggggaaaagaaagaagagaaggaagtaatttaatgacaaagacagtgtcttattcagctatagcccctactgtacctacatacaacaggaaactttatataaagaattattttaaacaaatattgaattctagatagcagccttgattttcacaatgttagcaattttgaatccacttttttgtgtattctgatattgatcaaataagtaagtatactgtggatagtgggaacaagttttcttatagtcagagaagggagttataaatgcagaagcgggaacactagaataaacctgtgaaactggactggaattggagatgtcaatatgaaccctagtttctattagatagattggtagacagataatagatgatcaatactgaagtagatgtggacagatatacgtatgtatatgtatatatgcacatgaaatacatacacagtctagctctgtccaatgaacgggcctagaacacacaacacttaagtagtaatgagcacatgtggtatccggatcttggtttctaaataccatgtccgcaatcaaaggaaccagggctctcttgaaaactggctgattctaggttggggttgtagaatgatgaaatgattctagaacatcttgctatactggaaaaagaaataatgaggaatgatggggatatgtcaaatgaaaacaagccaacttgaaggggatcccattgaccaaatctcagataatttgacaaaaaaaaatgtgaataatcaatcataacctactgaataaaataaaaatccatgagttcatactgattaaatataaataaggtagaagagaaaggtcttccttatagaggaatgccaagtaataaatgtagaaataatgatgcatttctagaaaatcaccatttggcaagcaccactgtattaattgcttctggtaggtaccaccaacgaatgctaaaagtaatgtctgagagcttgatgaaaagatgtctacacggtctcaaaaagatacttattaataacttcagtggagaaacttggcagataccctcttaaccaagtgatggcattcacatcaccagtaatgggacaaatcaatgtcacctgcctcttgacatgatgtgcaacgaactgagaaggaccagcatctctcctgggtattcctgcaaaaaaatgtaaaacttgaatctaatcatgataaaatattaaacaaacctaaactgaagaaaagtctgaaatgctggcttttattcttcaaaaatgtaaagtttgtaagggacaaaacaagcccaaggaactgctacatattaaaggagcctaaagagacatgtgaactaaatggaaaatgcatgagcttgaagtggatcctggaccaggaaggtgaaagagccatcattaggacaacgtgagaaattcaaataaggtctgtagattatagcattgtattcatgttaacttctggattttgatcattatattatggatatgtaagaggatattcttgctttctgggaaatacacactgaagtatttgttaataaacatcatgctggccgtgtgcagtggctcatgcctgtaatcccagcactttgggaggccgaggcggggggatcacaaggtcgggagtttgaaaccagcctggccaaaatgatgaaaccccatctctactaaaaatacaaaaaaaaaaattagctgggcatggtggcacacgtgtgtaatcccagctactcaggaggctgaggcaggagaatcgcttgaacccaggagctgagattgcaccactgcactccagcctgggtgacagggcgagactccatctcaaaaaataaatacattaattaattaattaaaataaaataaaataaaataaacatcatgcctgcaacttactctctgtagatgtgtaacacatgtgttatacatacatatacagaaaggggcagatcaggcagggtagggcagggcaaagcaacgtggtgaagtgttcatgtttagggaatctgaatgaaaggtgtaagggaattctttgactcttcttattatagcttttaagtatgaaattcttatgtcttaaaattagattgacataaaaagattttaaaaaggctctcgataatggaacagattaaaacgttacatattatcatctgacagcagttaacataaaaaaaaaccagagccacatggatcaatagggatatcaatagggatcaaaaggcaagttagataatgtcacggacagcatggtaccatttacgtaatttaagacacatacaggaaacatcactacacgttatttatataaacatacaaatgtaataaaagccatacaaacctggcctggatacctatttagtttcatcatactgatgatctctgcggtggagaaaaaggaactgagaatgggagtaaaaagcaaaagccagggaggggagttcaaatccctttggagccagggctatccgacgcaggcacaatctggacagtcacacagggccttgagattggtttaattcactgcctgatgccttgaaattcttaacaattttttaattattaaattaattaatcccacattttcactttgcactgggccccatgaattatgtagccagtcctatttcttttacttctttcataaaaaaataactgaaatgaatttgctatttctgggtagtacacacccaggtgtttactgtattagtctatgtactttttgggatttaaatatctttttcaaatttttaattatggaattgaattgagaagaaccagcttctctcctggggattcctgcaaaaaatataaaacttgaatctgatcatgataaaatattaaacagacttaaactgaagaagagtctgaaatgctggcttttattcttcaaaaatgtaaagtttctgaaagacaaagcaaaccccgggaactgctacttatcaaaggaacctaaagagacaatctgaactagatggatcttttctcaagttcaccttaaggtgttactgtagcctgtggccataaaactgggaaaaaccccataacaaatcaaaattcagcgtttcaaagtggggtggccctacaggagagctcagttaaaagaaaagctctctgcctgggacactcttcccttctgcgagaccttagcattacttcttcagacattttcttaaactccccatctgtaatccctcccgtcctgcctggactatcacctcatccctcaccctgttttggtttttgcacagcatttactactgtctaaaagtctatcacttatttacaaagttacgcattttttattctccctcatcagaatttgagccctgggaggtcaggggatctacatgcctcgcctcctgccatgtccgcaacacctaaaacaggacttggcacacaagacatctaatatacggtgaagaattgaacttaggatgagaggcagagacagagaaagactggcaaagatggagagaggcctaaaagtatccatccttttggagaaagctcagagcaagatcttccaacaggttctccaatggcctgcagtatgcaagcacagtacaaccacagtcaagaaccagcaggccagtggcacactggttcttgaaaatcaccatctccagtcacgtcctgagaacgcatatcatggtaacactccctaggcagaattaggagccacttcttcagatgcagcggcctccctaggtcatcaattctggttgtctcaaacttcacaacaggggaaggctgtgaccgaatctcatcctcatgaggccacaaggcaaagacacctgcaaagatgaggggcctgatgcttaagggcggggattccttggcatctccttggtgagctaggattgccagagatctctcagaatatttgcactttctgtgcatctctgctcttgttcatactgttccaccccaacttccaacaacagactcaaacttccctcatacacttgctatgatgactgagcccactgtacaggcagggtcctggcaaatggggcaagctgggtcctggcagataagggtttaataaagggactatttgcctaccccattgcagggatatggtacgactctgtctgaggttagaaacagaagggtagtgaccaccctttggcctgaagggccagagccctgaggctactaacagggtgtcggggaagaggagaagacctcactcttctgcctccctctggtctcttgatactcctcattggctgaacccacccagaagccagagggcaggagatcctgatgtggttcctacagtggacttccctggcactaagggagatcggggagtggatccaggagccaccgatagaagagactctgcatactcacactaacacttataacagggaatgtggattctacccctttttgtgtgagttctgcccttgcttcctgtgtgctcgccttgtctccctctaagagtttagattctaggctcgtcaaggaaggtgaacaacccctaaagagcttaacatataatcatacatcatatcatagaatgacaataatttagtgatgatgtaatagattactgaacaggctgccagatttttctatattaaaaaggaccccaaagtatgagaatttatgatattctgataatagtgatagcagtgggtatctatctcattaacagtagccagaattctacacaactaatttacatttctacacaggatacagcattacctagtaagaaaagtaaatgatggagaatagtttgctattcaacaaggaaactgcattatctgccctgcgaacagtgcgcaaaaaaattctgttgggtatttattatatggccgttatataaaaatattacagaaataaaaatcctaggaagagaaaaaaaatcttcacaaattcttataggcctgaatggtaatatgctagtgcacaatcaattctgatagaaaataaggtaaaagaaaaaaccttgcttttttcttttagtgtagttttctaagtggaataaataattcactattccttcaaccaagaaactctctcgcttattatttaaaaatatttactggttgcagttacaaaatatggtgcatttttccccctggcttgccctttgtattgatgtatatcttctgattataagaatggtaactcagaagtcataaagaaaagttttttgaaacaccatcttgctttagagacaataaggaaagggtaatcaatccaagtttgaaacattctgggtatatcttgggccatttagaataatttgaaataccttaaactagactaattcacatcaccttctatgttcttaaaaactctcctaaaaaacatgttcattaccctattcctagttctgcagcactccagaaggcagagtaacagatcaagtcaccacttaccaggttcaggtcctgccttccataaggagaatgtctgttctcccgacagtgtttgtaatactaattgctctaacctttaattcattaacaactttgcattcctttattcattcattctgacaacaaatatttatgaggtgagacagacctaacgcaaataggtattcaatgactgttacagtcagtgctaacctaaaggctacctcacaaaagtggtaattaagtgaagtatgaatagtgagtactagtaattacttgaaaccaaaacccagtagaagcagcctctccaaatgcaaacctttcataggttttaatctcattttcaaaggttgttatacaaatgaatagcaccaacaaaattcagtagaaaaacttttgcatgaagaccaaacttgggtatctttgagtctttgtcattcaaaaccatttttgcacaaaaccactatattcccccatctccccacagaaaagttgattttcatcaggggaatgaaatgcctggctatcctcctttaaaaagcaggagttaataccaattctaatcattatttttactgctttatggtacatcttaggttactgtctcatttttatgaatatagacaataatcattaattccccccggtagtagtacagaatcatctccctccactgcaacgttttccctcataaaagacatggatgaaaaacatttggggcacctaattcttcttttatggatgatccatgagcataaaactattaatgtttatctcttaagtgtaattaccatatttcccacatcaatgcccacggttgaacacatcaattaaaactagatatataattttcacatttcagatgaatttaattatgtgaaatctgttttatgccctcttgtctatatatttctggaggtgttagtttgccagttctagaatgggttgtcgaatacgggatggctccttctatgaactaacccaatcctccaggcagctgccattaagagcagagaagccatgactgttcagattattttatgttgaataggtgaattctgttcatttttagaaaactgatattaagttcaacttacctacaatattttttattaaaaagtcttcattatttaaaaagtatttcatactaaataatctcttttgtccccttcctaaccaactggtagttcctttaagacaaaagttaaaagcaatacagttccccaaattaaaccaaaagtatgcacaagaaaaataatacaaataacaggaaataaatgaaacaactgaaaaataaaaaaaaaattaacaaagccagaagtcagttctctaaaaagcctaataaaattgatgaccatttggcaacactgatgaagatttttaaaaagagagaaaaccaaagttaccaatatcaagaataaaacagtgaatatgactacagattatacaaaaatttaaagtatgagggaatgttgtgaacagcattatgccagtatattcaacaacttagatgaaatagagaaattccttgaaaaatacaacttaccaaaaggacacagaaagatatagaaaatctaaataactctatatctgtttaagaaattgaatttgaaattaaagaacttcccaaaagaaaactctaggactaaatgtctccactggtaagtttttccaaaaaatgaataaagaaaataataccaatcccacacagtgtcttagaaaatgaaggagagaacacttcccaactcatcctgtaaagttattataatcctagtaccaaaaccaaagacattataagaaaattaccaaccaaaatccctcatgagcacagatgcaaaaatctttaacaaaacattatcatctagaaacatataaaaaaaaatatgccgcaatcaactagagtttatttcaggaattaaaggtttgaaatcagcgtagtccaatatattaacacattaagtaggaaaactcatgatcatttcagtagactcagggaaagcactgacacatctatttatgtatttaacataacccagttgtgttactacacccatttatcctaaaaactttcagcaaacaaggaatagcattttcttagcctttaatgcacatctagaaaaaatgtatagctaagggcatttgacagtgaaattttaaatgtttttcccttaggttgggaagacaaaaaagtccactctcactatctttattcaacattgtattggaggtccctgcctgtacaatcagataagcaagagaaaaaaaggtgtacagattggaaaggaagaagtgaaactctattattcatcatgtgtatgtaaaaaatctgaaaaaatctacaagaaaactactagatctgacaaatgaatttagcgatgtttcagaatacaaaatctattagcaataaaaattgttaaaaatgctttttacaagagtatgaaaaacatcaaatacatacttggggataaatttaacaaaaaacaagccagctttttatactaaaaactctaaaacattactgagtgaatacataaatggagggatataccatgcatgcatgaattggaagactcaacagtgctcagatgtcaattcttcccaaattgatctaaagattcaataccatccaagtcaaaatctcagcaaagttttctcaaaagaaaacacataaaaatacaacttgaaacagtcacagacctaaacatcaaagctaaaaattgttatcagaaacaatgagaatgccaactctgtaacattcattctttctataactcacaattgcagtctcatcatgaaaagaatttcagataaacacatattgatggttattctacaaaattcttagagtagtcttcaaaagtgtcaaggctataaaagacaagggaagactgaggaactacaacagattggaggaaactgaggagttatcacaaccaaatgcaatgtagtatcccagattggatcctggaatgaaacaggacattatggggaaaattgttgaaatccaaacaaagtctgtagtttacttaatctactgtaatgttcatttcttggttttaataactgtaccatggtcatgtaaaatgttaacatcaagcgtagctgaaggaagtgtacgtaggcactcaatgtactatctttgcaacttcctataattttgaaattatttcaaaataaaaagctttaaaaagagttattagaatgaaagagacacttcttgtaacacagaaaggaataaatgtgaaagaaaaattggacttcatcacaattaaaaatatctgttcatcaaagagtaccatcaaaagaataaacaagtaagccacgaaatgagagaaaatatttgcaatacatatatctgacaaatgacttggatccagaatataaaaaccactctggtactcaataataaaaattagcaacaacactataaaagataggcaaaagatttgaagaaacccttcacaaatgaagatagcacatggccaataagcacatgaaaaagtattcaacatctttcctatgtaggaaatacaaattaaagccacaatgagataccaacactcgctcactagaatgaataaatgaaaaagactaacaacaccaactgttgatgaggatatggagtaacgatatggagtaactggaactctaaaaaaccgctgactaagtatgtaagatggcataatccctttggaaaactctttgggagtttctttaaaagttaaacacaaatctactccataacccagcactttcactcctaggggtttatacaaaagaaatcaaaccatgtatctacagaaattcctatattacaatatccacattcattttattcataataaccccaaactagaaatagcctggatttccatcaagggatcagccaactgcgctttatttatatagaagattactattcagcaatgaaaaaaagaattaatgatgcagacaatgatactgatgaatctccaaaatattagtactgtgctggataaaaagaagccagaaacttaaggcacatactgtatgaccccattcctacaaaattatagttaagtaaaggacaacctatggtgacagtaaccacagcaaagcctgcttctgggggccaggacagtgactggaaagtggcatgggggagcttttaggggtgatggatatgttctgtgtcttgatatgcattcatcacaactgagtgaaaggtaaatttagtaactgaacacttcactgcatgcaaattatacctcaaagaaagtaataccgttttcaagaactaaaagaaccattataagatcttctcaagtaaacatttgagaagtgttttttccttcatgcctagattcttttctacctctggggctaaaataaacctcacggttccaggcctccagccactcctctgccaacagtagtctacatctattttctacccagccttttggagctctcagccagggaaggctgctgtgtgtccctaaaatgcttctcgaacgtagtatactacattcatgcttatgccattcgttcctagtgcagcacccggagtagcaaccttataaatgtttctgattttacaaactttaaaaaagaatagtaatttctgccctataccacctttggaagaactgaaaactaccatgccaaattcattatgttttaagctaactcttcctcaccccacaggaagcacagcagtactgagctccatctccattctagataagatacaccgaggaaatctgaagacaaggcagaattggggttctctttaacctggatctattcagaccatactgctcaaagttcaatggctccttagagagctacaagattttgttcacacagtgttgataaggtctgaatcacatttgtgatgcttaccacagtacagattgttaatttctacatattagcttttgatgttgaaaagcataccaagtagctcgaaagaaaaaggctctggactaaagaatcagcaagtattttatttcgttcacattctacccaagtactctcaagagccacaattgcaagctctataaacttaagagtaaacttatatttatgcaaaaggaccaacgaaagatgatcaggatcctctgacgtctagctggatgtagagtgaggtccaatgaattcactcaaaagaaatatagcacaaagcaacaatggttgttcaaaatggcaaatgaacatattgttcgttcttttccaataaaaattcaatttttctttaagaaaaaaattcccaaaatataaaatttctgcatccttggtttcttacatttaaagaggcaaaaaaagaaaagagaacatgttatggcctaccgcaatatgtgtgctccaaacatattaaatgtttgctgcctctagagagtcacggtgtataattcacttttaattttataattattacaattaaaattaaacaaaggtaaagaaaaaaatcaatacctacctataaaagataggaaaatctcactttaaggaatatctctgctttctgagtatagaatggacaagagagaatctgagcagatgacttaatgcagtctactgggagtgaaccttcctatgaatcggcctgctagatatgaccctcaaagaggcatcagacatttctccaacttaagctattcccatgtttattgtaacattcctcccctgagctcacctgccctgtcctttccaagtctcactgaacaaacttcggtgttccacactggactgggggattcggaaaatttcccaaaagatatgatccctgttgtggggggttaaattattttggaaaacaaataaaaaacatacacacaaagacaacaatgtatatcctctcccttcatccaacacaaatcttaaatatccttcaaggttccacttgtccatcagctcctttgagctgttttcctagagttcccaaagaaatgaaccctgctacccatattacgattagcatctttattatagctcctacttacaattcatgtctgaaatatatgtagtaggctctaagttcctctctagtcctctcagaattctttccatggtgcttagcatagcaccttgtatgcagttagtggtcaccaaataatagttgtattctcaatcttttcatttaagtctggagtagggaagagggctgtcatgaggaggagggttaaggagtggaaatcctgcttctaattaccagcaccattctccagtctgtcacattacttataaactcaaacttcattttacctttgcttactgcaatgaattcaacatcgatctggaaaaaccgacatcatgaggtcaatctatcacgtgctatgctgcagatttaggaattattaaaatgacatatagaacccaaaatgctacttaatcaacttaattttcctgtgtccatacacaccaaaaatgatttattaattttttttttttttttgaggcagggtctcactctgtcacccaggctggagtgacatggcttgatcatggctcactgcagccttgaccttccgggctcaagcagtccttccacctcagccacctgaatagctaggaccacaggtgcgcgacatcatgttcagctaattttttacatttttttgtagagacagggtcttactatgttgcctaggatggtctcgaactcctgggctcaagcaatcctcctgcctcagactcccaaagtgctgggattacaggtgtgagctaccacaccagccccaaaggagaatttttattttagaactacagcatgaagtataaatgactacggttttattttattattattgtacattttttttccttttgctcacactgatttattaaaatttatgtcaggcttgacatggatgatcaatccttattttttcaagcttactaaggatattttcctacaaaataagtatataaatatgtttatatgcaagcccttctaaggaatgattctcatcatcacagatcatgatctaggaatttctgtcaattactcttgagctctttgaggtcaaggactacatattaaagtctttgtactttcagcacatggcacagtgcctggcacatagtcggcactcagtgaaagtttgtgaaatgagtgctctgccatgagtcttaggcagatgaaagaacaactcaaaagtgaagacagacagtatgctgaactctcagccttctgccaccacggaaatatgtctttacatgcttccacagggttcaagtcctggccctcactgaggctgtctgggcagagcatgctgttcagaagtcatgtgcaggtagagtgcagggatgctgcatacaagaacatgattaaagacccagtccctgacatgggctcagcacagaggagacattcagtgaatgttcaatgaaactgcttatgttgttctaaagccaacaagttgaacttccattcccagggagttgctgtactatcagggaatcaaccaaggtctcacaactatggatcaggaaccaataatgttgggatataagctgatgtcccttgcaactgtgtagtctttgcaggcattttgattaatatctgaaaaagctgctcacagttaaatgcaatcatcatttagcaaacatgtattgagccccaattcaactattcaaggaattgaggatacaaaaataaataatttgcagtcatcagtactcatgcaactctcaggcatggggttacagctgtagcataaaccaatgagtacgataccagaatctaaatatatatgcctggaaaggaaagcgagagagctagtgagactgcaagtgcaaagtgcacatacaggggtgcaacagcacaaaagaaatttaagcagtgccattgctcccacctgcccttctccccagtaagcatgcacacccgagtacactggagtggaagcccggggcctgttacctcctacagtcaggcactggttctttacgcttctcatttctctgcactgagctggatgctactgtttaaagatacaaatttttcatataacaaagcctccaaactcaaaccacctacttcaggcattattaatttctacatacacattacacatacatacatataggaccgggtaaattagaatacggattagctgttttttgtgagagatttagggagcctcagggacaatttcaattgtgatttctgcttcatactctgagtatgagtctaatggttctgtggaacaagcaaagtgcttcagaagcataggagctggtgcaaggggcaagcctgccctgcctgggggttacagaggattaagtatggtctgtactgtcacgattcaacaacctcttaaaaaatacaatatatgcttaacaaggcttctgttgacctctttctggaagcctgatttctttcctccacttatgttaacagattaaaaatttaaaaaaaaaacataatttttttaagtaaacacaatcaggattttgcccccaaatgtaaatctccaaaaaatctgaagtgcggcatcacagccaagtgatgccaatcctggtctacttctactgcccctccaactgagaccagcaatctcacacaggctcagggcataagctatgtgtagggtggtcctagaattgttgagagcctggactcctacctccttaaaggaaaggatgtgaaaactgcactatggatatccccactctcatcatgcccctacttgcacaagccaaagcttgcttcaagtcaaaagcttaggagatgagcaattaaacaattttccaaaggtttctaagtgagtcagaaacaatccagccacagggcctctccagggcactctgaaaagtactaagtgtcatgcacacatgtgtccattgcagcactattcataatagcaaagacatggaatcaacctaaatgcccatcaatgatagacttgataaagaaaatgtggcacatatacaccatgggatactatgcagctacaaaaaagaatgagatcgtgccctgtgcaggaacatgaacggagctggaggccattatcctaggcaaatgaactcaggaacagaagaccaactaccacatgttctaacttataagtgggagctaaatgatgagaacacatggacacatagaaggaaacaacacacactggggcctttcagagggtagagggcagaagaagggaggggatcagaaaaaaataactaatgattactaggcttaacaccagggtgattaaatagtctgtacaacagacccttaagatgtaattttacctatgtaacaaacttgcccatgtacccctgaacttaaaataaaagttaaaaaaaatttttttaaatactaagtgtcctaatcagagaaccatgaatgtacatactgagaggccccagagcacgtgggagactgatatggtttgggtggttttgtgtccccacccaaatctcatcttgtagctcccataattcccacatgtggtgggagggacccagtgggagatgactgaatcacagggacaggtgtttcccgtgctgttctcatgatagtgcatgggtctcatgagatctgatggttttaaaaatgggagttcccctacacaagctctctctctgcctgctgccatccacataagatgtgacttgctcctccttgccttccgccatgattgtgaggcctccctagccacgtggaactgtaagtccaattaaacctctttcgtttgtaaactgcccggtctcaggtatgtcttttatcagcagcgtgaaaacagacttatacagaggctgtttcatgcttcagagtctacatagctattgtggggcagatgtactaatatgggaagggaaattaaagtttaagactaaataacttcatgaaaatctcaacgcagcaggtaaatggcattatgtaagtttttaaaatatataaaacattaagccagggattcttccttgaatacaagttcaaggaagcttgaacttgttccttgaatacaagctctttgtcctcacagacaactacaagggaaagctgatatttccaggtcatcttcacagcacatactcacctaattacatttctataactagaacaagttgttgttctcgtaaactttgttttccagtgtcagatggagcttgaaagctgccatggatgaaagactccttcaaaagttcagtaactgtatctgtgtaaactaagttaggttcctctttttatcgtatcacttcagtaaataaggccagttgtgctcatttgtcaacaggaaacacagaaaggaaccagaaaacaagatgcagcctccggaggccggtcttggccatgtgctgggtaaggtaacaccatggctgtgtcttgagaccaccccaacctcagttcacttgaatgaagaattttataatctcaactctaagggacctgtcaaattagtccagggtgagctcagacccactctcttgaagtggcagcagcctttgatgataacaactctgaccgcacaaacactacacagcagtgtgcgactcacacatcacagaaacaccacaggagccacactttcaggtctagaaggaaatactgtagattaaagtcaacttttaaagaagtaaaaaaagaataattgacatcagtttaatacattttggacaattatttaagaaatggcatgcgtaaatgaaagtaaaaactcagcaaggtgaagttgggagtttgagaccagcctgaccaacatggagaaaccccgtctctactaaaaatacaaaattagccaagcatggtggcacatgcctgtaatcccagctactcgggaggctgaggcaggagaatcgcttgaacccaggaggcagaggttgtggtgtgccaagactgcaccattgcactccagcctgggcaacaagagcaaaactccatctcaaaagaataaataaataaaataaaataaaaaggcttagcaagggtgagaaaattcagactcattacgttacttaatcaaaattcataaaattaattttggagcaattcagctccagcaacagaaagaacctaatcatccctttcatcagtaactgcttatcttcttcattttaattttatgttgatgtgcttatttatttttatttattaatgaatctagtttcttgttaccctggacttcccatattaataatctgaataaacaaccttattcaacacatatctttttaccaaaaaatgtcctcttagacaaagcacactctgacatcacgttgccttgccttcacttgatttagactccaagttcacagtgcaataaagtacaaggcaattgagaaattttaaagcaaatgtgttttgggtacagcattttacaaccaaaagagctttaaaatggcatttctgaacaactgaagaggctagaatgccaacaaatatctgaaaatgagcatgacattaaaatacagtttgacatgttcagtgaaagagaactgggggtaaatgcgccattatacattttgaatttttagctttttttttttttaatgagtatctgacttcttcatgtgttacaaactcaggaaagcagacagtcttgggatattaaaatagataaagtgttttcaggatgagatggagactgccacagaactgtacacaagcatctctctaaacttaaagaaaacactgattctgggctaagagagtgtttactgtgtagatgaggtctacaggataaactcaatttatccaaatcctgtgccttccagccaagaaactataaaagaagactttgtagaatgaagcaaaaagtcatacttcctttcctaaggattgcaacctgttcacaagacaggcagagctgaacagctggtccccttccagggctccaagaaatgtgaattccaaggacaaggtagccctgaaatgcctgcctcatgggatcctgccctgtcagtagtaagcatcttcaaagtggctcctgcaggttggtctcctcaatcacagagttcagacagaaccctgacaccagccacgtgtaccatgcggtcagccaaatgtgtaaggaacttgttttgagaggagagaagaaaattctatagtaggcgagacaggcttctctctcctgctcctcctccctttctttttctctctctcctctttcttccctccttctctccctctttctctttctctcacacagttcctacatttctgcactgggggacaaaccaggcttctgatcaaaggcaatctgagacttgggttcaaaagctttgatgaagattggtacctgctatgcagatggggggagggaagaagagactagcctaggggcttttatatttctttaaagcatcagccattaatgggctaagtttaccactgggacccagagagctagtccccaaacacaagctcaaaatgtatgcattttccaattcatggttttcaaggacatgttccatttctatgaggctctaatgagatctgagagatgtacatatttttttaaagtcacacttacaatggctctcacagcacatccgggagcaactcagtaacttgtctaagcacttacatactgaagttccgagaaccaccagcttaaggttcagaattgaaatttacagacccagtctttgcttttttcaactctgtaatcttgtagacggttcataggtttaagacattaaataaccatggattatcatgactctagaatcagttggatttgtgacaaaaattagcaaaatgatgaaataaatgtaaggacccccttcccatctcattactttggttagtttatgccccaggtgggatgggtcaggacttaacagtcatccattcatggaacagttattgagctcaagccactccctggagatgtcaagaaaagtgagctgctttctctgcaggaaagccaaagaattaggctggtgcaaaagtaactgcagcgttgccattaaaagcaatagcaaaaacagcaatttctcttgcacaatatatggatcttttataagggagaaaaaaggtattattgatcgatatggctagaaacaggctggacctttgtgggtataaacccagaagggccctggtgttgaggtgttggaagaacactgatggattctttatttttttcattaactacttaaaacaacagttattgatagggtactgtttagagatcactacaattcctttgcagttatttgacatatataaacatactataggctgggtgcagtggctcacgcctgtaatcccagcaccttgggaggctgaggcgtgtggatcacctgaggttgggagtttgagaccagcctggccaacatgatagaacccagtctctactgaaaatacaaaaattagccaggcatggtggcgggttcctgtaatcccagctactaaagaggctgaggcacaagaatcacttgaactcgggaggcagaggttgcagtgagccgaaatggtgccattgcactccagtctgggtgacagagtaagactctgtctcaacaaaaccccaaaacccaacatactacaagtgaaagtaatctgcattgtaaggtttgttatgtgccctagtctgcccacaggaaccctgaaaaacaaaatgttaaatggcacagactttttaactgcaaatactaggtgcatttaccttccttaatacagcactgtgatcacatatatgatggtatagatcaagcttgtccaacctgcagcccatggacgcatgcaggccaggatggctttgaatacggcccaatacaaatttataaactttcttaaaacattatgagattttttttgcgatttttttttagctcatcagctattgttagtgttagtttattttatgtgtggcccaagacaattcttcttcttccaatgtggcccagggaagccaaaaaactggacactcctggtatagatggtgtggctcattctgctcatccttctttgagaaagcgcatttcagaagctatttctcctcattccagattttatgctgattaaagaaaacaagatttgcacacagagcatcctctagttatttgggtaacagacacagccatgagaatgttccgctccacaggggccatcagtgcaaatggccttccccacactacatcgaccacttccccacagcaagcttggccaggatccagccaaccagtgctgacgtccttcgctcagggaggtgttgggccttgcacactatggccccttacacactccattgcaattttgttcatctctgtccagctaaactgtagaaacccggagtgtagggactgcgtcttgaattcatctgtgtctggcatgtgcaaaatgctccacaacatcagttttacactcttaggataagaaaattcattttcaagagttttaatgactacagagaggtggcaaggtaaacagtttccacgtgaccccatagacttctccattaatcatagtttccaattaacttttttgttgtgctacatagatcttcttgttctattccagatcataatgtacagtttcaataatatgtttttttaattgatgttaaatatgctcctagaagctgcactgcaacaaagtaatttcagagaaaggcaaactggattcagttttcagataataaatatatatgtgcataattaaaagagattgatgtttccagaaaggagcacaatggaatgaagaaggtggtgcagaaaggctgagccctgtgctattagtgatgagtttcaccggaggtctttttttttaaataaaaacttaatttctctgtctttgaattctatgagatctctttcagacaaacacaacattctgaaaatcaaagacttggggattacttgggaaaagttcctttgagaactcatcaagaaagcaaggggcttaaacttgagacatagtatttagcttaagaattggaaagactctttttttttaagttctgggacacacgtgcagaacatgcaggtttgttacataggtatacgtgtgctttggtggtttgctgcacccaccaacccatcttccaggttttaagccctgcatgcattaggtatttctcctaatgctatccctcaccttgccccccaccccccgacaggccctgacagacagggtgtgatgttccccttcctgtgtccatgtgttctcattgttcagctcccacttatgagtgagaacatgcagtgtttggttttctgttcttgtgatagtttgctgagaatgatggtttccagcttcatccatgtccctgcaaaggacatgaactcatccttttttatggctgcatagtattccatggtgtatatgtgccacattttctttatccagtctatcattgatgggcattaggattggttccaagtctttgctattgtgaatagtgctgcaataaacatacatgtacatgtgtgaaaggctctttcaaatacgagacttgacatctggtagaacaaataattaatggtgtccggaggtagttaaaaagggagggatggaagacaagcttcaactccagtgccaaccccaactgagcaccacgaccatccctgggtccccgtagctatcactgcataatatccaccatgcattacaggctttggaggtagcaccagcatctctagggcagccagtcatttctctagaatggtgtagaacaacagcaccaggaactgaaaggaacctgcagtacaacacagcaggtgaggaatagaaagccttgcccgaatctcaccaccagaggtgcccttggactgggactcaggtcacttctttctgccatgtgcctggtgggagtaggatctagacaggggtatccagatgaagtgtcaggtctcctttagtcctgtggtttgacatgtttagttcaatggtttcacactgaacactgacccgacaaatgggcattttcatgtgtggaaggtgaatgaacatgttctgtgagctttcataaagttctgcttaaaaagtttccaagcagatcctccctgtggccccgcatgtatagagctataaagggaattccctaaaacaacagacaaacctccagggcctccacggtgctgcacacatgttcttaagcatctcacaagcagccaatgacatgtaaagcaaatcacctctcaagaaccacagaagcagggtaaggaaagggaatatcccacaaaacctctaactacaggagcagagtaaggaaagggaatatcccacaaaacctctaactacaatgagaaaagcacccagtggggaagaaccctgccccctcagaagccactgggaaggggcacttccacccttgctcagcccctcactcacaaccccctgggcaggaggaccgtcttctattagtgcctctgtcggggagaagaatgggtgcacacggctcagctaggtccttctggatcttcccaaggagaaagtgaatctgtgctgctctcctgccatgcagaaaacttagctagcagggtctgccctcaggagaagctgtggctgctaagcatcacctgagaccaatgtgactgggatgtttaattccagggagaagaaacacagactgaaggtcaccttctctgaacctacatttgactgtcatgtataccttatttctcaaaaagttttgaattcaggagagaaagaaaagatgtgtgtttatgagcctcttaaaatcccagcacattcatgtctgaacatgggaggtcatctaatgtttcgcattagcacagggatggcaaatgtctactgccttctcttgcacatgtggcattctccagagccatgaagacccatcagaatccctgtcaacatggtattcatggcggggcagctacttggtggccaccactgcaacatgaaatatcacctatttgttatggctgacctttgcctatgggacactggccatgtcactttcggaagaaccccttcttactgtgcttagccaaacaatttacctatagtcattattctcattcagccattctacaaatatttcataagcactttataactcttttaagggagaggggagcaggtattttctttaaggatcttctctgaaataaggaagtactaagaacaaagtaccatgaaccttactgagaagacacattctcactacagtagcatgtacaatttaggaagaaggggactgaaacattccaaagtgtgcagagatggtgggccatcccaatgatggactgtgacaatcttacattccatatgatgactgacaacttcctgagaccttggctccaccatcagtgtttctaggaccccataaatagaccatatcaaagagctattatctacctgaatactctagtgccacttttctattttggcagggtctgccctcaagagaagctgtggttgttgagcatcacctgggcatcccctcacaatttgaatacacttcagttttttccattccacttaaaggagctaggagagtaagacatcagagtccccagcgacatggaggaaggaactgagaccgtctacgtgaaacaatacaacttcaaataaaaggtcttcccagtaagtaacccggttactcgtcctcagttaagggagtttcatgatgaatcactgaataaaagcaggaggaggtaggaagtaagaatataaattcaaacataaatctttaaaaaaatctccattatttgtattctaaaatcagaagaggaagatcacccatactaactggctaatctaaccctcaggaactacagcctttggggaaacagatttgggtatttacgagctgggtatgaattagaggatctcagttggctggtacggaaagattagcaatcactagccacacagtctcagctaatcccccatctgaggcacaggagctgttacagcctggtggggctatgtgggcaggaatccccaggaaatctgaaggatcacttcctgacagcttcgtgtgctgagtatcagcacctggcctgctttgatgatgggttttaccctaatcagaccacccagaaatgaaagggacaagggagccagctgagtttcagggagatgtccaagaagcaaccaggaggattagagaggaaaggcgttcttgttatctgtcaaatccccatacgtgctgacaaggacgggaggaaatgccgtttgaggctgtgtacttacacagtttacaggctgtaacttcatcttctaacctgtaggataaattacccaaaactaaagggacaaaatccaacttcaaactcagaagaccccaggaaggaaaaggcaggagggtgcattcattttgtctgcagactcgggctcatggggagaaatgactggacttccgaagtgcaaacacgcttgctaaaaaggcaaacacacttgagagttctaacgaccttcatcaggaaagggttcttccttcagtaagtattgtcatgcatttttcccccctcagctgagacaccagcccaaggtggatttaactgtggcacttttcataagcagtgtcaactcaggacacctcagtaagcacagctctcagcctctcaggtctaatcccaagacagctatggttttttcatgggtccaaaagcccagaatataacattctgaaatgatgatttatgttcaggaaaagagaagcagggtaggacctatttcttgatggacaggaacaggtccatctgaaaatgctgggactggaagcattttggattttggatttttttttgaatatttgcattatagaataccggttgagcatcccaaatccataaatttgaagtccaaaatgttccaatgagaagttcctttgagcgccacgtcagtgctcagaaagttgaattttggagcattctggattttggattttcagatttgggatgctcaacctggataagagccagtgatgtcctggtctgaaaggctgagagagaagggaaaaggtcactcacaaagacatttaggaggatatggaggagctatacatataaaggccatagaatttaaatgaattgaaggatttttttttcttttttaagacggagtctcgctctgttgcccaggctggagtggagtgagcgatgtcagctcactgcaacctacgcctcccaggttcaagcgattctcccgcctcagcctcctgagtagctgggactacaggcgcctgctaccacgcccagctaatttttgtatttttagtagagacggggttttaccatattgaccagggtggtctcgaactcctgaccttgtgatccgcccgcctcggcctcccaaagtgctgggattacaggcataagccaccgcgcccggccctgcatttgatttttaacagagaagatgtaaaaacagtaatagaataacagactttgcttaaggatggtatgtctagtgacaactggtcaaacatgagagtgttaagagagggtggttataattgggaagaatgtcctggaacattcagaatgcacaatccctggatttaaggaaaaggttataaaaaccaagtaaccagtcgttgatgtatttccagagtcacctattctttaatgttgccttgattcttttaatactggtaaattttcataggcatctcacaatcacaaagagatgaatgtggatcctggctccatcattcagagctccatgaccttgctcaggttagtggcttctcagagcctcagctttccatcagttaaaatacctactctttagatacttttcaagattagggtgcttaacccggtcctaacacacagtaactgctcaaaaaacagtaactaccattaactcagtgaacaattactgagcacctaccaatgaagaataacatcagccatgtcttcaaggaaaatttataggcaagacggacatgcgcacaaccaagttagactagctatggaaactgtgggcatgttatttgacccgtctgactgcaaacctatcatccatagaatgcatatagtaagagtgtgtacctgacatggttgtggtaaggatccactgagttaatacatgtcaggtgctcaaaatagtacatgacacacagtcgatgatgatgatgatgatgatgatgatatgatgtaatggttagctttatatgtcaacctagctaggtcacagtacccagacatttggtaaatactagtctagtcatttctgtgaaggcattttttagatgagattgacatcaaaatcagtaggctttgagtaaagcagattactctgtgtaatgtgggtgggcctcatccaattagttggaggctttaagagaaaaagactgaggccctcagggaagagggaattctgccatcagacagcctttggataagactgcaacatcaactcttccctgggtgtctagcctgctggccatccctgcagatttgtgacttgccagtccccacaattatgtgaaccaattctttaatatgagtcttagtgtctttctctggctctccatgtatataatatacacttgtcagagacagagagattctatggcctttatacatgcagcccctctgtatacacctatagaattacctttttcctctctcagcctttccaaccaggtcattactcgctcttatatggcttgagcattccaaatccgaaaatctgaaatgctccaaaatttgaaagtttttgagtaccaacatgacactcaaaggaagcactgttgctctctctctcttggtctgacatatcctattaatctaatacaaatgttattttgttattttattattttatggctaagaaagaaaggaagtgtgagaaatcaatatcacaaacaagatttctgcttgatcaactttttctgcgtggccctggaaggactatcctgtttcatctttgttccataaatccactggcagaatgccaagagaagttacttaatgcatacctggtcatttgctttttattagaaaataaatacaaatgtttaattaagataaacttgggtaacatttaaccttcctgatgacaccatggggcaaaggttttcacacttaactcagttaatcacataaacataactaagttctctgatgcaggagagaaaagggccctggtgagtctccctctttactctcttaaagaacacctaagctcctctcctacagaagagctcatttcagtttagattgacactgtatttaaggaacatttaaatatttgcaacaaattgaaatgaatcacccaagatgaaaaatccaacttccatactgcagctttagaaaggctatgatatactgaaatagaaactactagttgtcttactctgaactccatacaggaatgtatatggcgatttccaaaacgaagcttcctgaagcatctgatattctgactacttctgctggattagtggaacactttaaatgtaaaaaacgcaatctgtatttctctcattatctgtttatagcactaataagaaccactctgctctactgtcagttttccgctgggatagttttaaagttttaagagtacctaaaagctttatatttaagtcttgctctcaatgatgggtgtattgttctggtggggcctatatagctttagatgatagttagatgtgttatgctatagtcatttaaaagttaattttggggaaacaaaatttctcaataaatactaagatcttagacttttcagtaacttccactgccaaatgcgtatgtctaatgtggcaaatgccccatgctataatccgaagtcaggacacctgatgctccagggtttccagacatgtgtgtgtgagtgtgcacagggtctatgtatgctggtacacttaatctgctagatgggctttcttctgggattataaagtacttcacacaaattaagccatgagaataagacttctctgaaatggatagaatattccagttctccattttatcctcacagtgtcagaggcatttgaatcagagcaactccatcttgaataggagctgggtaaaatgaggctgaaacctactgggctgcattcccagattgttaggcattctaagtcacaggaagagacaggaggtcagcacaagatacaggtcacgaagaccttgctgctaaaacaggctgcagtaaagaagcagccaaatctcaccaaaaccaagatggtgacgagagtgacctctggtcgtcctcactgctgcactcccaccagcaccatgacagtttacaaatgccatggcaatgtcaggaagttaccctatatggtctaataaggggaggcatgaataatccacccttgtttagcatatcatcaagaaataaccaaaaaaatgggcaaccagcagccctcagggctgctctgtctatggagtagccattcttttatccctttactttcttaataaacttgctttagccttgcacttgtggactcaccctgaattctttcttgcatgagatccgagaaccctctcctggcatctggattgggacccctttcctgttaacaacagtgtcgaaaaccaaaaccagaactagaaccaggaggcaattccagctcgtgattttttttctgtttgtcatacccccacctgtctttgtttcgtggccacccgctcccggctcccacctgtctggtgcagcactctgggaccactggagaggaaatcagaaaaggctgacggaggctaaagacactgtggtagagcaggagcattcccaggcagcacaggctgtgcttctgaagccctgagcagggaacgtgagctcttgctgagagcacaccaggaaaaactaacccctgccaagaaggtgggtctgaccaagggcccgtctccaggccacagacggtgaccacaggggagtttctctggcaaacagtcagagagaaaaaaagaaaacaacgatctcagcaccactctgacctcataggacagcagggattctttagaggattgggcagctctcactgctactaaaggcttcacctgaaagaaaaattgaacagcctcgtgggcagtttaatgatgtaccacgctactgttatttactgcacttattagagcagcctagcacaccatagtaaatctactaaagttttacattaccttaagtatatatggtagcagagtctgacagctgcatatcacgatgatccattcttccattcttcatgactaacagcccctgaattttgttggataaggcaatgtaaccaacttaaaaactacatttcctaatttccactgtgactacacatgggactaaattctgttcaatgagatcaaagaagctctatctgggggcttcttacaaagcttcctaagtggggacttagctaaaacccctcttctgtccttcctccttcttcctccttcctatcaggaatagagacacgatggctggagccacagtatcttgtgacagtgaagcaattttgagaatagaagtcacacactaaggatgacatgataacgaaaatgaatgaatctggggtgctgatgacatcacggagcctctgctccacccctgcagtgcctacctctatacttcatggtatgtgaaagaaaacacaaatatcattttgttaaaaccattgattttcaggtcattcacagacaactgcaattcctaactgaatgagtgtacactgaacacacagatacaacatatatataagtgtaagcagcctgctgagatcaaccaatcaatcattgaaagattatctcccaggcagccgcagtcatccctttctctagtgaatcgttcagcacttactgagtgcctacttatcagccaagtgttgaagatacgaagatggatgagacacagctcacgccctcaagcaaatgacgatctgctggaggacacactcaggaagtagtggtaactgctgtatgaacagtaagatgcatgcagtgcatccatttaacagatgtctgttacacacctactaagtggtaggcagtctccaagggctacgttcacaagtctatattctagatggcatggggcagagcaagttagagggtggacaagaaaaataataaagaagaaaatgaaggaacaagacaacttcagaaaataaggatgatgtgctagtgagtgactgctgggagctattttagacatggtgaccagaaaaggcctcaatgtaaagggtatatttaaactaagattatgaattaagtggggggaggggcggggggggggtcgcggcacagggaatggcctgtgaagggcttggggaagaacatttttggcagaaggaagagcaagtagaaaggtcctgaggcaggaataggtcagatagaatgttagagggtggtgctcatggctcagagaggagctttgattgtggggaaatggagaagtcaaggaaagtttcccaagttgcccttgactacaaccaagtcttcctcctctctagagccaggggattcccatcagagaaggagcacagctgcctgaaccccaccctctccacccacctggcctcacagctggctcagtgacacctttatctgtgccttaatcccaatatattttccttccctgaagagcaatatggatgccgtctccctccaagtataagacttgggctgaggggaaagcagaaacccctccttttccttctgcgttagagaaaaccatttttcagcagcactaccacttcaaaagcagctgtcctgaataagacccaggctgctttcagatcaatggccatacgaaagctcactaaaacaccattcctgttcgaggtttgcccagtaccacagttcaaaaggatcaaccccattgtcatgggtcatagtccacaccagtgtagaagagcaacagcccccaggatctacagctgcagagagcaccaggcaggataaactgatgcaacctgcccccttactccaaaatcctaagctggtcccatgcgagggtccatgaacaggcatgaccatgctggacagtgtctgcagtcctaggtaccctcaaatagcttcatcacaaataccaaaaagatgatgacatccctaatcttttgatttagttactattatttacccatcaggaaatgcactaggaatgcactagtcacagaatcaactttagaagacttcaggggtgatacatctgattttcaatgaatggtggtgttattacatggacagtgattctttgatcagtaaaagaaaatgtgacactgccttctttccaaaccctacctcttttcctctgaaaactatgactttatcaagtgactgagtttttccctattttaacaaagactttctatcctttcatagattcactgcactgaataaattgtctgtttattacctgttgatctacttctagtgaattctgcttgttaaaaaagtggaatcgtaatttctcactggttttctattaagcctccactcaatgttcttggtctcctctctaacaatggagctgatgagtttagtggagtctcccggtaatttccctcttgtattgcatgtttctctcagatgaatatttcagttaaaactgagactagttgataattttttccactgaagtctgtattccaatttttttttttttgatacagggttttgcccaggctggatcacagtagcaccaccacggctcacagcctcgacctcctgggctcaagtaatcctcctacctcagtctcccaagtagctgggactataggcatgcaccaccatgcctaggtagtgatttcatatttttgtagagaaagggtctccctaaattaccaaggctggtcttgaacccctgggctcaagccatcctcccgcctccgcttcccaaagtgctgggattacaggcatgaagcactgcacccggctctactcctatttttgtctggttgttcatctggatctgaccaagtacggcctatctgcctcacccacttctgtcttccataagctctgtttaatgtcagataacatgtattgactttttgttctatctgccaaaattgggattggagttgagtatattgggttgaagttgattatattctttccatgttgtcacactgtgggtgtttttcactgtaaaattagagctatttaaatacattatctgctcacctacaaaagctctcacttcttcagaaacacagaggttggtcaatgcttcccattccactgaattcacacaccctgctgggaatccagtgatgaatggagaatggggagggtcagcctcaccttccatgcaggtcaatatgtttatttttaaagaagagtcaacctgctctactactttttgtttttttaattccttagtactcacacactatgaaccatgcacgcacatgctacgaaccatgcttggggaaggtacaagaaggataagacaaggcattgggtgacagagctgccacggggctcgcctctagccagagtgatatatagtaaagggtccacaggacctatgtccagaaagagttttctttttccagcaaaacataataaacaaaatctaaaatatatattgtcttacacttgagagaaaatatatgaaccataagaagctaattattggattttttaaaaaacagacttagagaaaatgcagtcataaggacttcacgtgagtctttgagtagaattcaaccatttaagtactccccactcattggacacctatgcacgtaggcactgttagtgctggagtaacaaaggcatgacctgcatcctgctcttggggagacctggcccttagacatgagcacatgtatagaggtaactcatgcaggatgataaggctggtggagagatgcaaaccgagcacacaggaaccggcaatcaatcaaacagcctttagctggttgtgggaagaccacgttagcaaacagatgctgaagtcttctttacacacagaattagcaaaactagtagcaaaacagatctttgaccaggtaaagccagtagcctaacgggactctgaagtaagtttttacactttccttgaagactcatggcaaatatgaacctcctatttctgctgatggggtgaagagctgaggtcaaagagcctccctgggtctcccagttctcatcacactttctcacctatgagggcagactgcccacccaggcatcccaggggctcccaccctgggagtcatcaggtttggccccttttcttcttttcatgaagacaatgaacaggaaggagttagtaacagttcctgctttctacttgctcaatttttacctcctgctatctagcaggggaaaatgagaaactctccatcggcctcaccctcactggagaaattgtatgtgatccaggttatgtaaacaactcttccttcaaacagcttcttgtggactttataacctcgtctaccagtattgttatagatggctcagctctaaactctgagatggataattgatatagaagccatactccctgaaagtaagccatgcttatggaagatgcttggggtttaaaaacaaaggctgtcaacaaaagccctcccagccactcggcacctatcagaaaacctgtgaaggatgtgacagagagatccagcacacccagcagaagtctggatgatgctctaaatatagctgttgaatgattagtatcaatgactacgtatgtgcaaagccagttaactaaattttgacaaatagaaattccttggttaactatttcaatgattttctaaacatttcataggaaatgaaattcaagaaacatgtatctttcatgcagtcctcccctgggttctaccagacacaacccttaccccaaagaggcagattataaagagaccacataggcagtaacagagtggtaaaaagatggggatgggacagggtgtggtggctcatgcctgtaatcccagcactttgggaggctgaggcaggcgggtcatttgaggtcaggagtttgaaaccagcttggccaacatggcgtaaaccccatctctactaaaaatacaaaaacataagctgggcatgggtggacgcctgtaatctcagctacttgggaggctgaggcaggagaattgcttgaacctgggaggtgggggttgcagtgagccgcaatcacaccactgcactccagcctggttgacagagtgagacgccatcttaaaaaaaaaaaaaaaaaaaaaaaaaaaaaaaaaagatggggatggaacacaaggaagctctgacttctgccggagggttcaggataccccactgtctgcagaatttccccatacccccaaactcagacatggagcttccctagcagactgacagttaccaaaatataggaaagaaaattaacttggggtaccctaatttgaaatcaataataaataggaattaggccaaagtttacgttttttactacacatataaaatggtctgttggaggaaacaacagtaccaagagttgttgtgtaggataagtcatacttaacctacttaggagactggagtatctcagacatctctgcatccgcaattatatacaaataactaacaaactaattacaaaccattaaggcagtgactatgtctttcatttgtgtgtcactcaaagggccttgccccccattctagacaaaatgatctttgttaaaatgtgtcacttatgggcttctacttggcaacatgttggtcatctcctgcaagcagatatattatttgattcggtcgttcattaggtaaatatttattcaatatttattatgtccaaagctctgtattaagtgctataactgaatataaaggcgcataacacatctaaacaaatatacgggatataaagtcagaaagtgaacatccagccgggtgcagtggctcatgcctgtaatcctagcactttgggaggctgtggtgggcagatcacttgaggtcaggagttcgagaccagtctggccaatatgataaaaccccgtctctactaaaaatacaaaaaaattagccaagtgtggtcacagacacctgtaatcccagctactccagaggctcaggcaggagaatcacttgaacctgggaggcagaggttgcagcgacccaaggtcgtgccattgcactccagcctgggagacagagtgagaccccctccaaagatagaaagacaggaaagacaggaaagacagatagacagacagaaaaagaaaaagaaagaaagaaaaagagagagagagaaagaaagaaagaaaaagagagaaagaaagagagagaaagagaaagaaagaaaagaaaagaaagaaagaaagaaagaaagatagatagatagatagatagatagatagatagatagatagatagatagatagacagacagacagacagatagatcgatccaaacacaggcacactgagtgaatacattacaggaagtggaggtggcatctgaccagggagatcagacggaggcattcaggactggcttggggaatgcacatgattctggtgtgtggagataagagggttggacaccagctcaagagagatggaaagcatggcacgggggccatgggcaacactgagacatttctttttctcagcgctggaataaatgaagggctggggttgaagggatgaatcagaagaaaacatggactcagcacagagcatcctgcagccgagatcaggcatctagatttggcagtccagagtgagtgcttaaaagcactgaatgcttttaagccaagaaggttgtgacaattgtatttaaaagcaataaaaccaagttgcttctccagtcctccataacttaggggagcctccttcaggctggctgactcctttctcccacgcgggtctgcgctgatgagaggctgctgtacaggtcaccatctagggtgggactcggagctctctggtctgtggctgaggttcactgcatgtcatgactgcctgtgtccaccttttttcccaagatggcctgactgctccccatctgcagtgctcagttcctgcaaaactcacccctttatgaagctccaagttttgaagactcctacccttaacacatcctgcaacaactgctcatagtgcctcgggttccatctccctgccccattacacgttttaatatctgcagcacagtctgagggccctggttggctttatatgcaaatagcatgaataattttctttgatgttttattctattgtgtttcatttggaacagagaaactcaaaggaggaaggatgatgaatgagaaaagagggcagcaagcgcctccatgtaaggtgctctaacttaaatcagctttttgcagattctctgctatccccaaatcatcctccttgcctaattctcaaaaagaacaaaacttctccagacagagcccgcaaggccagagcaggacaagcagtgtgtgcatcccccgctcatcccaaatcagcagtccatgtagaattaaaaccagtctcaaaacacaagaataaaacaaaaaaaaatcagactaaaaacccccaactgtcttctgtatcatgagctcacaacaagatccaatcttcccaattacagcaatatgaatactgggaaagaaatgcgtgaaaacctccaaagtatcctcaatttacctcctccaaagtaaatttcatttgggaaaaataaaggtaaatacataacagagggccttgtttaagttgacaataatatttggcatagtgtttatttcagctaggaggttatgccagggcacaaggggtaaatccatggatttgggggtcagaacacctcgagatttaaatcctagctctgccactttcaagggtgaccttaagcaagtaacttaggctttggattcctcatctgtaaaatggaaaaataatattaccaacccaatggggctgtcaagaattaagtgaaatacctgcatataaaagtacttaacacatccatttaggatattttattgcttctagcattcatatatctaaactgttttaactatttctatctccttaagtaaaatatttgtttctttttagttcacctaatgcagcagtccccaatctttttggcagtatagaccaattttgtggaagacaatttttccataaactggagagcaggggggaggatggtttggggatgattcaagtgcattacatttattatgtaccttatttctattattattacattataatatataatgaaataattatacaactcaccataatgtagaatcagtgggaacccagagcttgttttcctgcaactagatggtcccatctggggttgatgggagacagtggcagatcatcaggcattagattcccataaggagaaatctagatccctcgcatgtgcagttcacaataggattcatgcttctataagaatctaatactgctgctaatgtgagctcaggcagtaatgccagcaatggggagcttcacacagatgaagctttgctcacttgccagctactcaccttctgctgtgcggcccagttactaacaggccactgaccagtagcggtccgtggcccaggggttggggactcttgctctaaaggcagaagaaaagataaactttagggaaatatgtggattccatttggtatatgaatgttctaaatactcataactcttataaatatttcaaatatcaaataatggaataaaatgtcttttcacatcatcacacaataaccatgaaatgatatccaggtactgaaatcactctactcttctattttccctagccacaacaaaggaattctaaaacatccaatctctgacactagctatttgatttacaggaggcaggcaacaacacactactaacaaagtgactttagctaaatcttacgtacatgtgccactgcatcaactcagtttggacaaataattatataattaattgtgcagaagcattaaatgtaacataatagtaagcttaaatggattgtttctatactcttttccttagccaagtatttctggctgtgtggttgggattctggtttttgtttcattttactttaacctgtcaaaaaataagggaaaaataagttaaagaagagtaagtatgtgggtgaatatgtggtagaggttctaggagaggaagaataaaaatacatgggttgaatctgaacattctctggtgaaaggcatataaagtcactgtattctgtataccagagcctgggtcatgtttgtttcctgcatgaatgatcacaataattcattgctactactaataatgaagatcatatgactgaatgaaaatttagagggatttttcttctctttcactaaattgtcatatccatgaaatcattttatcttacaacctcaaaataaggacagatttaaccattccaaattcatagattgaaaatttatgcatccatttagcaaatatttcataaaaacctactatacataattacaatcagactcatatcaatatgtgaattttaaactgtgtattatttatgtttcttgccttactgtgacaaactcttgagaagctgaaaacgtacttcctatgacaaataaaatccaatttgtagacagaaaactgaagttgaaaaaaattaagataatgagactacatatgtctacatccaaacacacgtgcctgtgtgcacacacatacacatatgtccctttatcaaatttggtgtccacaaggggctgcataatatgaatccactgaaaatagaggtcatagttctatactcaatagtgaaataagcctttatctagtctaaagactaagaaaaatttattctatagcttaacatttttaaacattctaattgaaactataccttcacccttaagcaaagaatgaatcaagtcataattatttatcaaaataatttttctgataaaaattatgtggtttcccttgaaaatatctttctgattttgtattcataaagaggatcatttttgcaaaaataacttacggtttctgcaattcttgcaagagcttctctttttttaagattcctcctatgccatcatccactcgattttctctttaattactaacttgcctaaccctgccaaatgctcatttgccagtggctctgcctgcaatgcaagcaggtctccaacatcactttcactgacatcatgaaatcccgtatttttgtaagatttacactcatatttccaaattgtattgtacctgcagttccttgaaagatgtttacaacaatcttattagtgaaggacaagtagaatggatgggtacaagagatgacaggttaggaaagagggatgtttgagaaggaaccagttttacaaatggtcagtttattagtaaatactgtcatattacaatacctttttatttatttattttgagatggagtttcactcttgtcccccaggctggagtgcaatggcgcaatctcggctcactgcaacctccgcctcccaggttcaagccattctcctgcctcagcctcccgagtagctgggattacaggtgtgtgccaccaggcctggctaattttcatatttttagtagagacagggttttgccatgttggccaggctggcctcaaactcctgacctcaggtgatccgcctgccttggcctcccattacaataacttttgattgtctttgcaaccctggaactgactgaaatctctgagaataacagcttggaggacataaaaagaagcgctaagctgccttgcttagagagcaagaggtacaggtttggttactctccctttatttcagaaaggcctttgttttctagtatggtttggatctgtgtctccaaccaagtctcacgtcgaattataattcccaatgttggaggtggggcctgatgggaggtgactggatcatgggggcggatttgccctttgctgctgttcttgtgacagtgagtgggttattgcaagatctagttatctaaaagcatgtagcacctcctccaaaccccttcctcctgctctgaccatgtaagacatgtcagcttcccctttgccttccaccatgatggtaagtttcttgaggcctccccagaagccattatgcttcctgtacagcctgtagaactgtaagccaattaaacctcttttctttacacattacccagtctcaggcatttctttacagcaatgcgaaaatggactaatccacttttcaagctcctaaaccctcttgcagacccctctgtcccgctgcccccatcatgaaagcgccctgccttggctgacctcccatgactcgcttttcttccttccatgactgccagtcctgtgtgttattatttctaggctttattagaaagatgaatacatcaaaatagaaataacttatataaaaattatattaaaaactcatcttaacgatactatttatgatgaaaagggtgagcctgcagaagccctctcacatgtctcatgtgtcatgttttcctttacaagggtccttctgctccttaatcaaaggactgactcactcaggcagggcacctgcaccctcctggtcaggaatgtgagtgtggagggcaggcagcttgggtgcaaatcctgcctctcgaacttactatgtgaccacaggtgagttgttgaatcatcctgtgtttcagtttccttacctgtaaaatggaggtaattacagtgctgtacttactccgctgagtaagaggatttaagtgataagataatacatggaaagtgctccatggtgcctgaggtccagtaagcaccaagtgctagtctttaccgggaacatcaaacaccaactggtgctcagcaaacacgaagccccacactaaggcctgggaatacagagatcgtatacatgcctcaggcctgaaaagggttctaagattttagaattccaaaggtatcctcacattcacaagctgtgcaatttggggatgggggactgggacggacattcagtgccacctgtgtctcctggcacctctacaactctagattgggcatctctaatgtctttagactttcctccactggaaaaaaaatggagacaatacaccttaatccacaagttctttggaatgagtatggcatacaagacacatttgagaaagcgtctaggacagactcaccccaacactcacaaatgtgcatttcccttcctttgtttttaaaagaagaccataaacgtaacttgaaaatacctagaagaagatgtgccatttaaatgaaagtgatctgtgattaattttaaatccttctatgtccaaactacaagtcttagaagattgtggatcggtaatagctataacttctcaaattcctcaaaatttattttttcatcctgtactgaagtggcttaccaatgaactaagaaagttatattgtaatacccattctggggctctgttttatatagaagatgagaaaaataacagtttctaaaaataggtaagaaaattacgtgaaaatgagaggtgaagtgaggaatggcaagaactgtagaaccaaatcagtgggctggacacatgagggacggtgagggatggtgtgggaagaacccaagtgggaagctgggcttccactgccttgacctccacatcgccaggcttctctggcatgttcctttgatcaatggtccaaagagggagagactcagctctcacccatgcacctgagtgagtgactggggagacacagcaaatgctgagtaagcacagagagcctgtatctggtaggtttgattgctggacaaggccatggcctaagttgccttgtatacttattccagggactttttgtctatgtgtgaatggagtgatatggatcctttaccactactggaaacaaataagaaacctcaaagaataagtactaccaacagagggtcagtgatgtgtttttgtatacctttagcattatctaaatgcagggacataaaaatgcatggtacaaaaaaaaaacccacttaattaacaatttgccattctgataattatacatagaaggcattgtttgggtttttctatctttggtcacatcttagggctattctgatttaaaagtatagagtataaaagtcagtgtggcaatttctcagggatctagaactagaaataccatttgacccagccatcccattactgggtatatacccaaaggactacaaatcatgctgctataaagacacatgcacacatatgtttactgcggcactattcacaatagcaaagacttggaaacaacccaaatgtccaacaatgatagactggattaagaaaatgtggcacatatacaccatggaatactatgcagccataaaaaatgatgagttcatgtcctttgtaggggcatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggaggggggagggatagctttaggagatatacctaaagctaaatgacgagttaatgggtgcagcacaccagcatggcacatgtatacatatataactaacctgcgcattgtgcacatgtaccctaaaacttgaagtataataataataaaataaaataaagaaaaaaaaagaaaatattgctggactttggaaactacaaaaaaaataaataaataaagagtggagaataagaaagctggaaaaaaaagtatagagaggatagatttcatatatttttgcaataaatggcaacttccacataacacaaatcctgaaactttgtggaaatgttaacaaggtaattgtataacatacaaaacactgtagggaagtatagtgtttagaaatgcttcaattatcaccaaggtgatgtagttaaataaggataataaaatataattaaacattcattacagaaactatcaaaaataattgacctgtacaaagcacagcactcctattaaaaggaaactgatggataataaaatatatagagtattctgtcctctagacataattattccaaggcagcaattaaatttatagaaaactgttaagtttcttctgtgacgctttactactgtgaactcaagatgttttgagtgagaattgcctccaaaaaattcttatgattgtttaacatcttaacaagaagtactgccataaatttaaatatgtgtgttatatacaaaaaaaagatgaattttaagatgcttaggactctgctatatttgtcatatttctggtgtccacaggattgacttttgctccagttgaaaatgtctaattcttctatagccaaatctgagcacagtctaatattgaagaaaaatttaatgttaatgcaaaaataacattctgcagaaagagtgacagaatatatttttatgaataattatcaggccaaattttttatacaagtttgtttcttcatcatttaaggaagcgggacactgttccatgaaatcattccagtgtcttatgggaagcataatgtctttaaaagggtacaaaaatctctccttttggcctttttctagcatattcagagagtattgagaattctctacatagaggcagttgtaaacataaacttctttacactgctgctgggggtgagaggagaatagaatatatttttatactgacaaatgttttaaccactggaaaatgaacatgactttagtaggtaaaattatcatgtacaggcatcagaaaggaaaaataaaagcagaaaaactgagaactgtgtgtggagaacagccttcaaaaatccaattgtatttcatcttcctcctcatttagtctttttttttttttggctgcaaagatgctttaaaaatatattgttttagtccaaagatacccctggcacaagcgacaataatattacagggacattaaattaaggaaagaaccaactgatatgtgtctatgagagaagagctacagggtgaggaactgggaacaaaggaggaagacactattagcaagcactggggccctcctttattgacgtgggggaaaagtctgagtcccagaatgaatatttcctgaagcagagctgaaatggaactgtgacggacatgtaatgtaaaccctgatatcaaaagccactgaagttggaggggggggctgtttgttaccgaagcataacttaagcataagctgactgacacaaagcctaacatccagtttttacaagcaagttatggtttaaggacctgattttaaatgactaaaaatgttatccctcacctgcaaagccttgtttttacattaaaataaatttaaatgatttggcaacattccttaaatatgccagattttgacaactcaaaattataccactaaagaaattccagagacatgtgtgttcatcatccatctctattcatgacagaacatttcagcaataactgagcaagaggcaattttttatacctggagtgcagcactaggtaattctggcaaggagtttctgagagaggaacagaaaatggaataaggaagtcattgatactatatggaaattcaccactgttgctgccgtgactgaagaggcaacgtgagttctatgccataagaatcataatgtaaaataggttaagcataaaacaaaataatataagcacctacccacaaaaattaaaatttatggaagattcggcagaaacagctgagagtggtgcttaataaatcccaggccttgtgctaaagccttgggttatgaagataacatacattctgttgcctgtgaaatctgaaaggggtctgtaactgcatgaactgcaaagacaccctcacattcacaggctgtgtgtggacatacgtgtgtgtgtgtgtgtgcatgtacgtgtgtgtgtgcgtgtgtgtgtgtgcgcgcgcgcgcatttttaggtagagaccaattagataccttattcaattcaacatagacccctgaaaatctgggaggtcattcccctgttattgttaaacaatttatcactcttactggaaaggaagtaatgcttaacaccttagggttgcatgcagaaatcaattaaaatctaaagacaataatccagcatgatatttcacttaaatgaacctccacagcctgtcaaattagaaaattcatttatgtatgtgtgtgtgctgtggaagggggagaaaacagaacacagagggagtcattgtatttctttacagaatcaaaatgacacggtgcagtcacaaagacaccggccctttggtgttggcctacagagcactcacgaggcagcacagtctccaaagatggcatgaagttttaaaaggaccaactggcccatccaggttagaaagatctttcactagtgctgtctgtgacagacaataaaccactgtcaggctgcgaaggtctgtagaagacagaagtctgcacattaagtcttttttagaggggagttcactgaatgtgtggaaacaaaggcttggtcttgttctgcctatggaaccctcagcatctgaggcagaggagcagggggtctctggatggcaggccaggacttctaaagcaggcagcaggcctggcccagtcacactcagtcactggggctgaggtcagtgtgacacgctttttagatgcttgaagaattcttggtagacctcactttgccacagtaattaaaacgggatggttttcaaactcctgggcagttttacccctagaatgaggaaactggtcattgtgatgcatcctgccccaataagaacactgttttaagttttagacacacctacaagagggacacgatccaaacaagaccgaacagacagacaggcttcagaaatgttgatgggaaaccatagatgcaaagcctggaaaaattgatggaactgagtagttacctcaaaaactgggggatacaggcagggcaacagtggctcacgcctgtaattccagcactttgggaagctgaagtgggcagatcacttaaggtcgggagttcgagactagcctggccaacatgatgaaaccccatctctactaaaaatacaaaaattagctgggcatggtggcacacacctgtaatttcagctactcgagaggctgaggcaggagaatcacttgaacctaggaggtgaaggagccgagatcgtgtcactgcactccagcctgggtgacagagcaagactctgtctcgaaaaaaaaaaaaaaagggaggacacaatgcgacacaattcaataaatatttactgagcaacttccaggtggacgatcctatgctaagcaccgtgatgggaaatgtagataacgataagaaacagcttctgtccttagggagtctgcaatctaaatgggggacaggggaaggggaggttgaaaataagcaagtcacaaacacaaaacaggcctgaggaaacacacagtattatgacctatgggtggaaaagaccacgtttcactagaggacctttctgagaaacagataggattttgggagccagaggatttttgaggggagggtaaggaataagaacattatcaaggccgggtgcggtggttcatacctgtaatctcagcactttgggaggttgaggcaggaggatcatttgggcccaggagttcgagatcagcctgggcaacataggggggcccatctctataaaaaatacaaaaattagccaggcgtgggtcacagctacttgggaggctaaggtgggaggatcgattgagtccaggagtatgaggctgcagtgagctgtgattgcaccactgcactccagtctcggcgacagagcgagaccctgcctctgataaataaataaaggagaggacagcaagagtagatgctgagcaggcaaagaccaaatgctcttagggaagaaaaaggaggtagcaatttaatcagcttcctttctgtcaaaaggctaagccctaagtagtttgaatcctaataaaatattgcttttgttgttgtttgtattagagacagggtgttgagcaccaccatccatgcccagctaattttcgtattttttgtagcaagagtctgccaaaaaaaaaaaaaaaaaaaaaagaacattatcaagaataggacaaagagtcagaaaacaaaatgtatgcggctggaaaaatatcaaaaatagtctagttttggctggaaaatagggcttgacaagaaaaggaagattagcacatctaacacatatttccaaggcatatttatacttaaaaatttttatcacattaatataatgttctcatcacagttaggaaaatgaagcataaaaaaaatcttcctcacaatccctctgttacacgtaatccttttagtccagcacattgcaagcgctcacagattgccgagttgaatggaaacatgaacttacattttaaaaaatagtgtatagcatatatatatatatatatatatatatgcgattattggcatttttcctccaaaaatcagtcatgtgtttctcccctttctatctgcttgtaaacacagcccgctcttgctaaatccatgttcacaatatgttccccattttaaccccgtgttagcttcctctctacacccagcatagcctatggcttccccctgcatcaaccaatcacatctgcacccaagcaaaggaccacagatattttaacagtaacctaaagagaataaccaaggacagggatttgtatgtgtgttgcttactgttacatttccagtgtctaaaacagtaactggcacagagtgtgttgatcaataaatattttgttgttgaataaggtaaacagatttgtaaacttacacagaataagccaaaatacaattatgtattttatttgcttacctgctacttaagattattcatggtattaatagagtagcacaatcaagattttacaataaacgaaatgtgaaaatgtatcttttaaaaatccttctttgatgggcactagtgttaacatctgagtaattactcccccagaactcatctttaaatgtttaattgtgtttaaataataataatacgggttagcctctactgtgatttttagactcaatctgaactttctggtcataaataacgtcacacattcttaactgttaaaaaaaaaaagtaccgtagtcattctgatacttcatttaatattactatttacaattattttctatgtttactgagaaaatgactagcaccatatggactaactcagaggtatcctgctgagatgctatgctttatcaacaatatgctaaatgctgctctccttatgacaacccccaaacactttctcttctaacaagtgctttgcttcacattacaacctttcgttaagaagtcaagcttgctctctccgtcctctgctctttcttctttgcctccctctcctgtcctatcctttgtgcttgcttacatactagctaggacaggggtcctccaaattcagcctggggcttgctgcatttggggaagagacatttgcaggttccaaaatggcctggatgtcagcagcagtgcacatggaagaggaaggcgttccaggactcctagagcactgtgatatgctaatcaggacccagcctccacacttgccaacccccatgatgtgcggctccttctgagctgccctgatgtagctgccaaacctgtgacctactttcacacagccttgtgctcctggctccccacaggcaatgcccttccacagggtggacttgctatctgttttctcaaaactggaactcacattgagccagccagataccctttcagcctttcagtcctactgcctgtggagcttcagtcatcatgtgtcagcattttaaaagccactcattgtcacagagttcttcccatcgctcttctcccactaacatctccccaccttgcctcccactcccccagcatatggtgaagcagggccaagacaacttgggaaaggtgtcttgttttaagatgctaatctccagctttctgttccgttctaccagctagaggcctctttcatgtgaagatcatatactttgggcatcacaactgctgaaaaactgtggttattaattgctcaagtcaggctggaagatgtattgatctttcctccctcgggggccccggtgtttcttgcccatatcactcacttggcaattaatcacattttgccttgagacatctgcggtttcacttttgccattttccttagctctttgttcccaactggctggtccacttgatgcacacaggttttagagattatctgtctctgagttttccacagtcctacacagtcctacacaaactgggtctcaaaagtattttggactgacttcttgtctggaaaatttcttcctgctcctccctgctaagcacaatgataaaccctgaaaataccacaaggggcagccaaaggttccatgtgaaaggtgaaaagagtaaggtaaactagtcagagacgctgccctgccaatagaagaaggcaacccggacctggcatttcccaacccacagcctatatacagcaacagaaggcagtcccggtaagtgcattccttctgcaaattgaaagagtctcaccaacaaaaccaggaggggtggaatccgcaaggcggatagatcaatcaccccactgaaaaaacttggccagatgaagcactctcctacctctctaggcctcagattctccttcccaactcagaccaccatgcaagggggatcacccagcccaggaagggttctccttccctaccaggcctcagaaacatgaggcagctgggcacaccagaaaagggaatcccaccatgaaaagtacccagcccaggaagcactctttatccatttccttcttataggctacatactccactgctccacataatgcagtagggaacctggcctgacaaaaactccttcctcctcctcaagcagctgcaccagcagcgcaagataaaccaagcagaccaaagtagcactacaaaggctctgaatgttaagtcatccctacaactacagtccacaaaagtagcctgtgtgctaaatgttaaaatggagactcaaaataatagccagaatgtcaggagatgataaaaaatcacccatcataccaagaaccaggaaaatcacaacctgaatgggaaaatacaattagatgatgccaatgctgagatgatcagtgttaaaatgatgacacaagacttttaaagctgtcatcaaaaaaatacttcaacaatgaactataaactatcttgaaacaaataaaaccaaaatctcagctgaaagagaagttagaaaaatgaacaatattgaaactgtataattaaaaaatactataacagaaataaaaactgactagatgggctcaatagtaaagtggagatgacagaggacagaatcagtgaacctgaagacatatcaacagaatttactcaatctaaacagtagagaaaaaatacatctcatttgtcttttccgttttttttaaatattagcaacatccacactgatatttaacttcttttttaatcattagagtaccaaaagggaagaggaaagtatggatgaaagagtattcaaataataataataataataataataataataataataataatggctgaaaatttcttaaatttggtgaaagaaataaactcacagattgacgaaatccaaataggataaacaaacccaagcaaatccacaacaacacacatcataattcaacttctaagacctcaagacgaagaaaaaaccttaaaagcagccaaagagaaaaggtgcattacctctaggggagtaacaattcatatgatagtagatttcttgtccaaaaccatggtggccagaaaaaatgtccctgacatttgtcaaatactgaaagaaaagaactatcaactgaattctatatttggtaacaatattcctaaaaaatgaaagggtaaataaagacattcctaaatgaaagaaaagagcatttgtactagcaaatctacccttaataaatggctaaagaaagttctctaaacagaaaagatacacagaaccaagtttgaaacttcaggaaagtaaaagaacatcagaatggctaaaattgatggttgaagcaaaaattattgcagcatctgatgtggtacacaatgtatatacagggaatacttaagacaattacatttaaagagaggaaaggataaagatacccaaatggcagtcaggtttctacattctacacgaggtttaacactcattcaaagtggtaaaacactgatagtggctgtgatatgttttttatgtgtattatcatacctagagataccactaagaaaagtatacaaatagatgtactaaaaaacaaaaaaaaaccccaaaaacaaaaatcactgaaaacaaatcaacacagaaccattttttaaatgttcaaataacccacagacaattaagaaaatagaaacagaagaatgaggagtcagaaaaacaataaaagacttagcccaaacatatcaataattaccttaaaagtaaatagtcttaacaaccaaataaaagacagagattgtcagagtggataaaataacatgatccaataatatgctgtctattagaaactgatttcacatacaacttcatatgtagattgaaaataaaaggatagaaaaagatataccatacaaacaaataaaaaaaggcagaaatggctatattaatatcagataaagtaaacttaagagcaaagtaaaatactaaagacaaagaagaatgtgacatgatcataaaacaatcaattgactaggaaggtgtaacaatcctaaaagtatatgcaccaaacaacagggcctcaaaaattgatacagctgaaatgagaaacagataaatccataattatagcaggggacttaaataccctactttcagtaatagtcagaactactagacagaaaatcagcaaggatatagaagaaatgtacatcacaatcaaccaagatataattgacatatattttaaaactctactcaacagcagaatacacatttttcaagtgttcatggaacgaatgttcatcatgatagagcatattctgtgctacagaacaaaattctacaaatttgaaagaactaaaatcacacagagcatgttctctagatcataacaaaatcaaactagaaatcaataacacaaagacaacagaacaatctccagatacttgaaaattaaacattcatttctaaatactgaatggttcaaagatgacatctcaaaagttatatttaaaaatccatagaatgtaataaatataaaaatacaacacatcaaaatatgtagcatgcagctaaagtaatgctgagcggggaatttacagtactaaatgcctacattagaatgaggaacttctaaagtattacatgcaaaaattctccataaaatattagcaaattaaatctagcaatgtacaaaaagaattatgcaccatgatttatttaggatttattcctaggacacaagggcaacataagggatctttgtggtcatgaaactcttctgtatcctgactgtgttaatgtcaatatgctcatgattgtgttgtaagatattagcactggaggaaaatgggtgaagggtacacaatctccttgtgttttttcttacaactgcatgtgactctacaatgatctcaacaattaaagcacctgtggatgctgactataattcaactcagccatcaatgtttaagcaatgttatgttatagaagactgacagtgtcgtggttgttgatactcaggggtaagactctccaaaactaggatttgagattgttgtctgagatttcaactttataaaccacgcgaaatgaacagaagatgaaatacacaaattttcaaaaaaaatcactatgatcactatgattgttagacatataagactagattataagctgacagaacccacctattcaaagaaaggacatgtggctcagaaggatggttgaagaaaccatgctaacaaagaaacaaagaaagtgcacagcatccatcccaactacttccaggggaaaagaagccttagtcaaatctattactaataccctgttggtaaggcatctgcaccatggaggaagaaacacaaaattgtattcattggacttcaattattccagtcctgctctctttcctggagtgcacagtagataaatgaaaatatttagaaatccacattaaacttgcatcggaaaactgagaacaatagctgaaatttatggttgtacacaggtctgcctttgcttttttcctctaagcccgccaagatcacaatcctatattctttccaaagccttttagtccttttcctgtttaaatgaataaattgacattctggtttcacatgtttgtcgtattagtttagtttatgtgaatccactctcaagagtttggtggcaaaactagccttctgagcccaaggcccagcctatgggctgtgagaaattcaccactgaaatggcaccaaccacaggtgacccgttagaagtggggcgagctctcaagatgacggacattctttctgttttgtggtccagtgtgatctttcaaacctactagtcatatttctgccaaaactagctaattagacatggtgctttgttctttgactatatatattaacacaaatgcctcatgatgagtagaaatatactatacatgagatttttattttgactagcaaaaaattttgcatttttgtttactttaaagcactacgaaaaatccaagatattaaaattattacaatagacaatgaaattattttcttccaataccagattttgatatagacttttattaataaatttatattgagttttccaaaccacatccatctttctctgtcaggactcccacctagtttcctaatgcccagtgctcaagtagcctgtcaggtaaaaagcaactaaattagatggacttaataggtttgtacttaaagataaagtaaaacttacatggctgtaatggccaaagattacaatttacacagatgaaatactgcctaaagggtcatttgttattcatggacaaaaaataataataataacctagggaaactaaacccagaaaagatggttttaaaagaaaatgaagaggccgggcgcggtggctcacgcctgtaatcccaacactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagaaaatgaagaatgacagaggatataatcagtaaaattcaatagagatattatttttaagtcattgataaataaaatctttatcataatatttatgaggaaaataattgattctgatttaaataatttcattaagataaatatgaaaatgggaagaaattggaaacagattaatagcactctatggaaaattgattatgggaaggaattaaattggcttaatgatgttccctcaggaacttcatgaaaattaattcatgctgggccagttctgattaaaatgtttatattcataagttggaagtcaaaacatcctatgtcctgatgacatcactgtgtttcttggactctgctgtcttccatactgcaattctgccttctcacaattctcaccccagcccttccattgctctttcccccagtccttcacttctgtgtttttccccatctcttacccttatacacaggtacacaggtattccccaaggttccattttcagcccacctctgtaaatcctgtctccctccccctcttcctctcccaatttctctgcctctcttgaccacccccccgcccccaagcactttaatgctgatgacttccatcttcacatcttgcctgatcctttctcctgagtgccagttctaggcttccaatgcctgcctgactctttcctatggacgttccactgttgcattaaatttgaaccattcaaaactggattggcatctttctctataacctaccagacacaggggtatgctggagctggctcaaaccagcttgtgaactgactgtgtccatctcttcccacctccacattcagtggcactgtcctgggggcagactgaaatgggctttggtgagggcatttacgccatggaaactggcaaacacaacaagtagagccctttgttcaccagagaaaaaagcacacccttgcttatacggtaccaccatatccttaaacagcaaagaaacttgaagccatttcaggcacctcacccaccttaccctccacatttaattaattaccaagttatttgtattctacttctgaaatgactctcacacagccactttctttccagaaccaatgccactgccttagcccaaggtcacctgtgtgtgcctacgctcttgcaacagtttcctagctggtgtccctgactgccgtcttttataacacaatccatccctcacacagccacaggattgtctcactttcaacacagcctgcaacataccattctgctttaatgtctcaccatgttctaaagaacaaagccccaaaacatctcagcaacagtagatcattctgtgttccctgaccacaaaaacatgcacctatacacatccatctttgccctgtcccgagttccctcatcctcctctcaaggcccactcagctgagaagccccttcccagctcccctcagtaagaatgaactagtccctcctctatgcctacatgacctttgtcttggtgccatcctgttcttctggcctcatgctttagtgcctcccacttgctcaacttggtcagcaactgacttcatttccttccatttttaaaacatacttttgcccttaagtggattctattttcctctcaaccatgtattttcttcattttgcttccctaacccaattgcaattatccccaaaccataagcatctacagagttaaggatgcctactctgtctgtcacaatcatgcaagatgaaaggatgtttaaccccaggctgggtgttccaagtggctgcaattaaagcaaatcttttttttctccactttggttgactctatgattaaaaaagaaaatgatttcattaaagataatttagttgacatttctgctttggtacaactaggagttgagatggctttcactgccctgaaataatttagcatgcaggaacatcaagaaacaaggagcaggagtgccatcaacatagacgagaaacgagaaacacaaagggagccacaggggacaaatggcccatggttaagtttggtttgtcataaaaggcatgggcagccacaacagcttccggctagaaggtgcattggcaaccttcctcctgcctttccctttataagtttcacctccctctacctctctttgctccccacttcttaagcaactgaagagacatcttcttcatcatgtgccaaaatttagcaatgtgccactgcaaagaaagagaaccacaggctccagggtcctaagtgagatgagatgaaaaagcagcaagagggagtgtggctgcagaaagagcacagcaggctctggagtcgggcggaacaaactgacttctgccccacactcctgctgtcctcataagatccaagaagaagcaatggagtgtgggagcagttttctggcttctttctctccattgcttgggtataagggagaggagaagatggaggtgcactgccccagcacatattccgcctctcttgttaatgactccccatgggtgtcaggccacagcatcactccatttctaccctcagaggtgacacacaacttcatgttctctttgggtgactagtgacctcagttcactttgaacaaaacgtactcactggtatgaagatccatgtttggacaactcctctcacatatgggatggagtaaactcctttgtctatgaagacagattatttcttattaatggaaagttattaacctgaaaatctgcaccatatctaccagatcatttagacacaaattttattttattttcatttatttatttatttatttattttttgagacagagtttcactcttgttgcccaggctggagtgcaatggcacaatctcagctcactgcaacctccgcctcccaggctcaaaagattctcctgcctcagcctccctagtagcttggattacaggtgcctgccaccccacccaggttttgttgttgttgttgttgttgttgttttagtagagatggggtttcaccatgttggccagactggtctctacctcctgacctcaggtgatccacccgccttggcctcctgaagtgctgggattacaggtgtgagccactatgcctggccaaatctagatacaaattttaaaattaacacctaccaatacaaataatttttagtatttctaagtctgaatatccatttagtatcttttataattagaacttatgaaattttacacagaattatcagaaaagtgtcccacatttgtataatgttctcctcttgcaggcattctctgtctcagtctcatagcagttctctgtgctgctctccgaatgctgcaggagaagaaacaacatatcgcataatagcagacgaatggtgatctgctctgtgagaggtaaagacattttctgataagggataaaggaagaaaatggcaaaaagcacagacgcaaaaagatgtgctctctagtttttctttagggcatttactcgatagctaacaacagactggggttgtccgtgtaccgtcctgaagggagaggtgtccccatcttctccacctgtgacccagagacgttccttctctttccagatcatcatcctgaccctctcccctgaccatcctttctccccttctgctttcaaacaatcacagatcttctacagcttgaaacagccactgattagtgctgctgcttttctagaaaacatctccctccctcacctcccgtttcctttcttcattactaagtttggtttagaatcaatatctctatttcatcatcacccacccacacactttgacttccttcatgagctggctcaaattctttattaaactatttttattgcttgcataaaagtcaacgacaagcttcccttcaccacagaaacgagccttcctcatagcctctccaggcatgggacagtttcccctgccccactccttccggacatgctccccttcctgcacgtccaagcctctaaccctccttctcctccctttcctattggggtctaccgttgcccctagtgacgcaggggctttgacgtggagttcttagcctcctgctctttcttctctatgtctccttcctgaagagcctgaaccactgtgcggatgaagacatgggggaggcgtgtctcacgcacctttgctctacctcccgggcttcctcagcactcactgcttgagatcctcaaccgtcaacctggcttctccatgctcacaaggcttgcactccctaagtttcctaagtgtctacgtctataatacgagcattgaaatatctttcctgcctgatccagagggtggttggaataatggaatggtttttaaatcttcataaacacctacagtattggcatatcaattatcctaccaaccccctgactctaaataactctttttattaagccacaagatctaaatcctctccaatttgttctcccttcacctcggtgggatggtgaatctccaggtcctagggttttcctctgatgtgtctcacaagcccattcttgcccgtccagttcctctttcctcactctttctgcccaggtctccgtccgccaggacttgctgcctgcaatagttgcctaattcacacatttccaattttccctctttgatccattctgctacccccagaataatcttcctaaaccttaatttctaccacatctcatcccattccctaaaatgattatagttcccactatggccaggaaaatatccaaactcttctggctgactctcaaattctctacaatataaccttttctctccagccaaaattatttccaagtcattccaaagccacaacccacaacccactactcctaaatgtaaatgtcataactccctttgcagctccatgtgtgtgcctgtgtctacgttttaaatttattttgcataattcacactgtgcagtccactgttgactgagcatgtagttttgatccactttgtattgaaaactctaagcagggtaatatgatcataaaatataatttgaagggcattttggtttaaataatgactcaccatcgagccctccattggggagtcaggcccagagccaaaccaaaaaaaatgagcgacaagagtcaatgcattagttagaggcttcagctcagtatgactgatctggaaacatatcctgatgcctggttaagaaagctttatggcagaaaaaaaagaaaaatttgaactgatgtcctctgtctaaatcatgaataggaaagcaaaaaagcttgatgtgtctgttttaaaaataaaagaaggctaaatccattaacaggtgaaacaactgacaacggacccacatcaagccagagtccttctcagcatcacagaaatctccttacctagggccagctgaccatctgccagatggctagtggttctaagaaatccaccagggaccaaaagcaggggactataagattaggcatcacacaaatgtattccaaatcctggagctggggtcactgatagtctactacagaaatcaaaagaggtgcctcagaagacacaggctggcttcacagtcatccatgtgtctaccctgagatctcagaggtcacaggaagacccaaagatctatccagcagaaacatttggacagaagcaagtccaagagaattctttatattcacagctgctacagttggtcaactcttgattcaggcaggtttcaagcaagtccttcttccctccctggtctgcacaggggtgattttagggaatcataagggaagaaggggacgtttagaaaaagacaaagagtgacaccacacacagagtttcatggaatgtccatattgcttgccttttcatcacagatagtattttacctcattagttcattcatttgacacacagttattgggcctttatggtatgctaggcatttttaggtgccaaggatatagcaataaacaagacagacacagcccttagtttgttaaggaagcaggcaataagtcagcaaatgaataagataattgcagacagtgctaagtgatatgaagaatctgtaagtctacaaagaatggagagtgactgtagagtggtcgggaactttaagcatggtcaaggaaggaacaggaaggaggcaaagatatgcccccaactcctcgctcaactcccagagatgagaggtgcctcttggctccagctctgcagccacttctgctcaaaaggtacgctgcgttgctttctttattcctttgttaaacctggcaccagcaaaacaggcacctcaacacctataaatggttaggaatagatgggcatgcaagcttttctcctctactgattttactgggcataatagtaggctttttgatatacttgatctgatcagaaataaacccgaaaacaacacatgatacctgtaattgttttccctggtttaccttgtgtcatttctaaggcttagattcccatgacccccagctgttctccactgagtgctcactgtagagaaagttgctcttctttttcttcctgttctctagacgcacttacctctctaactctggtctacgcctccttatcaaggcacagatgcagctaaaaagcattccacctgctccctagcaaaggacttctttgttaagctttgacataaggagggaaaacagagacctcaggacttctactgtgttgacattgttttaagcaaggtgggaaaagagaacagataagcaagtcgttctactggctccactttcccaccacctaagtcaattcagagtatttcccgaacattttttacccatagattcagattacccctaagacagatggttatggtttattccgttttgtgcacacaggggtaaaagtcacttaaaattggactcaaattacttcaaagtttgatacctgccaatcaccatttcatcttgggtatacaaaaccatactgcataagctccaattgcctgattctaattttcaatgttttcccctttttaggtaaataccatcttcagtttttttttccttttttttttaatgagcagtttaatggaaaataattgctccaggtacaggtcttctaggcacattttgtctctgcagctattgttttaattagtgggcctgcttgttcgctgtccctttgttgtggcccgctctggggcaggggtgcccggggagggttcctcttgtggaacgcaggcgttaatgagccatttcagtaataagagtcctgccttgagccagaagtcagagcacccaagacaccccaagcagcagaaatgctcatgaatttctgaaactgcctttctaatttgcatttaaacataacttccaaagaacaatttcacctgtgattttctgagctggaaaggtaagggactttagatgttgaatatgtacaaattatgttaatataacggaggtaaatgaaagtcaaatgcattgtcatgtaaaatgtagacgtcttttctaaatgtctattttctaccaaggcttgttttattttccccctaagtgaaatgtgataattttttttaattaagtgaatctctataataattcctatttgattgaaactgattattcctcattttcctgtaacctagacttcggaaacctcagcaagaggaggcttagttggtgcctggtgacttcctacaatggattgaaaccaatctaatttaacacctgtgtgctcatcaataagtgtactcaagcacaaaagtgagcacagtgttgagcgattctgacactgactgcatgacaaccacagactctgtatccaaacactcgcagacaagaagctaattgcagtgatgaaaggcacaccactaaaagcatgagtaatcgctgcagtgatgcacagataaccctctctcctttactaccagggtgctgcggcatttatctcaaacctgtctctacccaatctgacaaccttttgtctctctgaccaatggaaaatggaaatgatttttcactactgttcccgcagcagtgaagggtctcttctgagtgtggagatttagttcaacagttgagtataaaacaaatgcaaaagctgacatttgtcatccatggcagaaataaaaggctaattaatgagatctgttggagtcccttctcccagtgcacccactggtgcccatggagaatgcacactgccttcccaaattgtgacacgtgtgacaaactctaccagagtgaatgatggtctgggaaaggtatggcagtgcagctccgtggcatggtgaaaggaagaaaacatcatcaggtttcaattcaaggcagtggtagttaataatggacttcctgaaacctgtagctcaatcactaagggaatattaagattttccacttgaaataaccaggattatgtgggccatcctagaagcctgctgaactggaatgcattcataccctggtaatcatattaacttactgttaggccaaggtcaacttgattttgtgtttcaccaaagctcactgggtcttttctcttgacagccattgggcaagtgagggatacacggttgacttgaagctggaatccacccagacccaatgaatcactgacctctcatttttaaccctaatgaattggggtagaattagatattttgaattatcatacaaagcagagtaaacccaacaatctatcaaaattatctaactatctagactgaacaattttacttggaaaggatatacctgcttatgaaatactaatgatgacagcaagaaagtctgatttcaaatctatgggtgccaacattctatgtatggtcatggaaatacatatgtaaacttgatacactgacaagtcatttcctatgacattttgccaatcaaaataaagtaaaatgaagaaaattgtttagaaaatctggatcttgtttccttaaggtgtatgtaggaggaagcagtaggaggcaggaggcattttcatttttattttactgcaccagtgtttggagctcagcagctgagatggggtgagtaacacatgagctttgatgagcaattgtggacacagccctttttgccaacatctcactcattaccttttccctccacttttttttttttttttttttgccaaaccaccctactagattataacagtctgcatcaagaaacatttcatttaattctggaaaggcacagccatggaaatagaagattaaaatgaaaaaaaaaaaaaagaaaaaagaaaaagagaaaacccacacaaaaaaaatgaaactaagagattctgaaagcagcatttcctaattaagaaggcccaagaaggtgacagatgtacccaggtccccacaaccagccagtggcagaaccaccagaagagctcattttcctagtgcctgcccaggttttttctacaatgctcacagcattgcaaggaggagttaacgccaattcttattcaaaattaaattctattagatattaaggatttctggtgggaatacttcagaaatgaaaaagtattttcaatttaaattaaattaaatttccaattaagtcacagagaactgtacttcaacaggaatctcttttactctacccctttacaaaagaaatatttcactttttttctttctggtcatcaattaagagttttatgtaaaatgtgtcactttcatctctgattaaaacgcatcctattttaggttttgagattagaagctgaggcccaaggactcaatgaaattgtatggcatcgttcccgcagatatacatacatatgctcctaggaaaaaggttcgtagcatttatcagattttcaactggatctataactcttccaaaagattaataagttctgttccagatagagctgaggttttggcaaaggtaaggaatccttactaaagaatcttgtttctctcaatagcccctaaatctcttcaactcacataattgcttttaaattcacaaaggaaatccacaaggcctacaaggaaaagcaaattccagcccccactaaaacgggaatggacagcaactgattaattctgcagtaatgaaaatttaatataaaacctttaatttcatttcaggtagcctgaacttcagattggacattttcagtagaaaacccatttctttttgttcctgtttttttttttttttcctaaaaaaggcttatatttacttgatttgaattttgctagcatgctttttcttctgaattcaagtgactagaactgaaattattccacctggggagaagagacagctgaaagccaatttagtattggttttcaaatacatgaagggtactcagagagaggatgattgccaaagaaaatggtctttgaaccatagaaagaatctgagcttgctctaaagttaaatttcctgacttacagagtttatgacattaaactgagagaccaagggatcctttttggagacttcaaaaataggatagatccttaaatgcctgagatggcttggatgtggctttgtctgaagtcaggaggataaatcttaccactgatggtcccttcaggcgtgtgaatctatgggtttgactggcatgtcagaagctagaatgccagcccaggacatctagagagtcatctctccaatgctgggtagcagtctatcaatcgctctcactgcctcaacatctctcagctcgcctccaccaccatagggaacccaaggcctgctcctgtctgaggctgatttccaacgtggcagagaactctgctccctcactgtaccacagcctccaccaatccctcggagagcctaagtttttgagaaaaacaaaaagaagtctcatctgtggtagtagaaattgtgtgaatgccaattttttttaaaaatcagtatttaactttgtagcactcctttttccttcttgaggaaagctaatagcccagctctgcttccaaaacaaacgtctctaagattggaccagtctttgcttttctttttgctggacaaccttgtcccaacttagaaatggaggagatatccatagccttagaccttcagattgggctcaagagcctttgtgtggacccaaaaggggaaccctaggggacacacaaggagctggaagttcaactcccccttcatctcacctgttgtggccttacaggcttagaagtgcagagttcttcagggatcctggaaaacctctggtcaaacctcatctgcaatgcatgccccttagtcaaagctcccagtatttgcccagctcctgctggagctcctccagaaagaactccatactcacaatcagcccatcccaacactgtcctgctctaaggaggagaagagctcagctgaaacctgcctcttcctcttgtccttacatgtccactccacactagtctgtaaaactcctgaagatctaaatgcagagaacgttcacctgggcagtaaagttcaaagagagctgtaccatctgctgcctctgaggttcaggaggagaattcctattaggttaatgccatttccccttttaaaatgaaacaaaatcatctgaaaagcatgtctgaacatgctttataagttaagactgctcacagaactctgactcccaggaactacaaatctaaataggataaacatgtttatatgtgagtgcctgttgtaaagctaaaaacccagcagataccaaaagatgctaataagctcaatatggaaaaattacttagaaaaggtttatgttatggtcttaacattgccaatgcctaaattatttattggtcaataaaaaaacccaatgcatcaataagagtaatattaaagtggaagttattagcaacttctaagacaggcccagcagctgacatgacaaatacaaaagctggacaccatcgggataacgggaacatcattctccccccagacaaacccaaggtgccacgtgtgtgcatggcatggcagggaagagatgaacaaccactataatctcactatctgtgtccccacaaaattctcatgttgaatatcataacccccaaggtgatgatatcaagaagaggggcctttggaaggtgactagatcataagggcagagccagttgagaatggtgcccttataaaagagaccccagagaactgccttaccctcccaccacgtgaggatacagcaataagatgttatctatgcgggcaggccctcaccagataacgaatctgccaccaccttgatcttggacttctctgcctctagaatgagagaaataaatgtttattgtttacacatcacacatactcagtgtatggtatttttgttacagcagcccacataaactaagacagcaactaacaggatcaaaggcaggtggtggaaggactgactacatgggctcttcaactgaagagatcaacgcaatgatctcttcaatagaatagtctgttgaagatctggaagtatataaatagggcatattgtattaatagatatatttgcttgcctccctagtatcctcaaaagatgaggaccgggactaagttgttcttgtatcgtgcaaagaccctgcagtgtgttatatacagtgtgggtttacagcaaagatttatactgaactccactgctttttttcccaagggaaaaatcagtgcctaagaactagctcatcttagtgagaggcagcctgtgagatgggctcttgaagaaaaggggtaagaaggctgatccaaagctcagaacagctatggctctgaggctgagaatatttagattcaaggagaagtctcataaaccatgagaaaggactattcagattccatgaaaaggagaataaacagctccccatctttagaaatttttttaaattctttatctcttttttttttttaagttagaaacaggcaggctggagtgcagtggtataatcacagttcactgcaaccttgaaatcctggtgtcaagtgatcctcctgtttcagccttctgagttgctgggattacagacatgcaccaccacgaccagctaatttttaaattttaacttttgtagagatggggtctctttatgttggccaggctgtctcaaactcctggcctcaagcaattccccctcttgggcctcccaaagcactgggattataggcatgagccactgcacccggcctattctgttctttaccttttatttttaaaaaatcattccctagttctactatctctatattcaaaatcctctttcccactataaatccactatctgaactccaaatatcaccaagaaccagaattccataaagtacaggcaatgtagatacgcaaacatggctctgagaatcttactgcctgtatttctcactctctatggttttcagctacacccctcttgccataattgtgtgcccttaattaaatctaagtttccagccattttttttaatgtgaaaactcataacaatgtccttgggtttatagcaccactattgtcatagcatgttattcaacctcagctagtgcttgacttaacagaaaattctgagtttcatattcattgtagtaacatcagttgtggaaacaaatattgtgctatttgcctttcccctgctgttcctcgatctcttttcagcctcaaaggctgtctggtacacttggttcttgtgccaggatggaagacacaagatgagtcctcagagacgtggtgtcaaggagtccatgttttctttcctctaagtgcagacagaatgactctctggaaggagcatacatgagctggcagttagagacagcacagctcagaaacaactgtgctggagggacatgaagaaaggcaatgatttctctttcccaatatgtggcaattttcagatgtcaaaggaataacagacagatataccctatgaaaggatttgatttgtggcaactgcttttcttttcctgattccattaatgccaggtttcttggccttaagcagagagccaggtattttctttttatttagtgctccctgggcagttattatctgtatcaattttcctttatccaggttaattctcttaaaaatacatgcctttcagtcactgtattgtatttaaccaaaatatctgttggtacaacatgctcttgtagttcatctaaggcacctttaagtcacagagttatttttaaagtatatgagttacttctgattataaaagtaattcaggttcactgtaacaattggaaaagagcaaaaagaaatgaatagctcataatgccaccaatcaagataagctctagtaacagactgcatatttataaaattgggatcatcctctatatattgtttttatatacttgtttttcagttaacatatgaaaattttcttatgacattaactcctcttcagaactatgtggttttttgttttgttttgtttgagacggagtttcactcttgttgcccaggctggagtgcaatggcgtgatctcggctcactgctgcaacctccacctcccaggttcaagcgattctcctgcctcagcctcccaagtagctgggattacaggcatgcaccaccatgcccggctaattttgtatttttagtagagatagggtttctccatgttggggaggctggtcttgaactcccaacctcaggtgatccgcccacctcagcctcccaaagtgctgggattacaggcatgagccaccgtgcccggcccaaaatcatgttttaatatcacattagggcatagagattttttccaattccttgaagtgtttaatgaaactatgatacatattcatgcacccaatcttttaattgtcttcactcatattccaaattgctcttcataaagttaacaactatttaaacttctagaaggatactagaagtttagattagaatcttggttcccaatccttcactttttcaagtgaaggatttcaagttttgccagtttgctagataacacattatgacaatgatatttttatttgcatgtcttcatattcattttcctacatgtttttgaatatctggaatcttcttttgtgaattgtctgctcaggacctttccctattgtttttagagcactggggctttttctaattgatatataagagtacttcatatcttaaggatattaacaaactgtctgcaatgttttcccaatttgtcatctgcctttgaatttgagatcatgtttttaaaaatgcaaacaaataggaacttagtatttctcacatgagcttcaaaatgccacttacaataatcagatgcatgttatgttcttgtccatggactgttaactactagagtcttttttaaaaaagagagccctgaattgtcaactgtgggaagacaaaagaagccagtaccttctgttgcttttttgccattcatagtgccaggacctggcaatgcctcaaagctgctattcctgcacagggctcttcctcagcctggagaagacacacacaagcaagcgaaggtgggtgggaccaaactaccaccttctggaattcagtttggccttccaaggtgactgatatggtttggctgtgtccccacccaaatctcatgttgtagattccataatttccatgtgttgtgggacagaccaggtgggagatgactgaattatgggggcaggtctttcccgtgccgttctcgtgatagtgcatgggtctcacgagatctgatggttttaaaaatgggagattccctgcacaagctctctctttgcctgctgccatccacgtaagatgtgacttgctccttcttgccttgccttccgccatgattgtgaggcctccccagccatgcggacctgtaagtctattaaacctcttcgtttttggaaattgcccagtcttgggtatgtctttatcagtaccatgaaaacaaactaatacagtgaccaaaccaaaagaacataaacataacagaaaaatgcaatccagcttaggagcttaggcaaccacagacactaagttacctgaatttccaagtttcattctggcatgctcactactggaaacattccttatgactctcgaggtctcagtttccaactcccctcatgctatggacccaggatactgaatcgactagacatttgtagaaaactttaaatgtggagtttttaactcataatgaaactaaaaaccaggcaatcaagaaaggaattatgatttaaaaaaatacagaaaatcagaacagaaaaaaattccaaattaaagatgggaaagttcaacagtggaggaaacagaacattatgctttatgacttaggttcgctcacctataatgacccaggtaattgccatatatgggtaacccctgaggaacaggatgtaatcttagtcacaatttgtaagtactcattcatacttcaagtacataatcaggcatacagagtataatccatacatagtttaataaagacaaaagtctcagccccttaaagaactatccaggtgtctgtggctgattggaactcaagcgtaagagattagaaatgtattaaatgaaatctaacttctgcttaatcagaagagcctggtacaagtatgtgattaattcaaagttttccttgaagaggatggtctcgtcaagtcatcagctaccagctatccaatggcagaggtggcagagctgactgaagcctattcttcatctagcccatttgctccatcctgctttgaatggtttacaacattccaatccttcaggtaaaggctgttccccaatagatcttgatcctatctctgtttttttttgttaatccaagatgattcaattctttttctgtgtgcactacttctgaattatttgtcaatgtctttgtgattactattataattattgttattaatatagcctggaataatatcaaatacttgacaacatctctgctaaccaggcagcgacttgaccttcaagggtctgctgttgtttgccatctgaggggagaacctcaagggcaacaggaccagtctccttttatctactgacttcagaaaggctggaaggcaaaaaacataatgatctgggcaatctaggtgagaaaaattcacttttccctgaattctctgtgtaaagaggctttaatggactgagttactcaggtaattgttctgcattggtctgagtttaatcaaaagaagaaagaggataatgctgtcagggaagcagttttcagaaggtttagagttttgcaattgtactacagagctccgaaaagtgccagcagagcagaaaaattaatgtaaataacattagttttaatttcattcattttggaaaaaaaaagcaacttcaaaaaggtttttataaaactctggttttcaagcatgagaaagaaaagctattttacataaaacaaaaaataaaataaaaaagctcttttaaaaaaacaaaaagatcttttacataaaatgaaacaaaatatagaagggttttgcccccagattgtaagaataagctttgtttttgcatttgttttagtcttttattttttaatttcacaacatagtgtaaattaaaatttaaaatgtgaaacttcaagtgttaaggcaattgtggctagagctgaacataatatggacagtgaagaaatacacaatgtatccaagattgatatgtaggtatcaattgcttccagtgaaacagttcattgacttctctacaggaaaggaatctatgagcttctaaatccagtcctgagtagaaaattataacagtgaaagagatcactttcactcagcttccatttccagttttatgcgaagtccttactttagtatgctaggaaacatattgagaggaaataaatatagtccccttctgtggcagcctggaccaagtattaaggttgcttaagaactaacctgaaagatcatctaaatgtgtttttgctttgtttgggtaacctataggatcaaaaacatgctacagctctaagaacgtaaaaataatggaatagaaatggaaagatgcatattaaaaatctacaaatctaaagacaaaatagtgtattaataccatctgttccagttctatatggtccaagtctgcccaccccaccaaccccccaaccccatcacaaggatctagttaattcacaggaactgcttgctgcctgaaattcttgccagaacacttaacagccccctcatttgttgggtggttttataggtctctggtgctgagctgaggtaggacagcttgcagtgtgtgaggaggacagataaaaccaccctgctgtgtagatttagtccatttgcactggctctcagacagaaaacaaattgcaacctctcacaaagcagccccgttctgcactagcaagcctgaaaaatgcaggcaaaaatgagtaaatcaggcaacttcacatcaggaggaaaaaaaatggctaccactctaacagctgctctcgtaattaagaacagatttcatcactaaactcttcctggttatgtctgcagcaaaacaaatacacagatgtgaggcatttgcatactggaaattgtgtactggataaccaaaccaaatttactttttctgctttaaaatattcccttaaaaatatccagtcaataataaagtataaggcaatgtccaaacctaagtacaactatatttctgtcatcatcttgcaactaaatttattttggcattctaccaaattcactttctttttacatattcgaaattgcaatggactgccatgaacatgacctcctttgaataatgaaaatgtgctacccatttcttttactcataaaatttgctaaatttattgctgcctcatttatctatgttttaaaaggctgcatggcacatgcagtaaaaggaatcgcatttgacctttttaaaggtaaattggtgtggagttagatcagagaaataaaactaatgaaatgataaaattacagcaaaaagtgagaggtaaggataaattaatggaaccaccccactaccatgagaaagaacaatttaaaattcacacaacaacatggatgaaccccacaaacaaaatgctaagcaaaaaggccaataatatacagcacaaaaatgagcaaaagtaattgtatcattagaagtcaggatagtggccacccttgggtgggtagggccatcacaaggagggggcacaggagagcttcttcaggtctggtcatactccatttcttcacctgagtgatggttatacaggtgtgtgcagtttgtaaaaattcttcaagttgtatacttaggattacttttctatatagaaattgtactttcataagaagaaaaaaaataaaaaggtgggccaggcgcagtggctcacgcctgtaatcccagcactttgggaggccgaggtgggcggatcacgaggtcaggagaccgagaccatcctggctaacatggtgaaaccccgtctctgctaaaaatacaaaaaaattagtcaggcgtggtggtgggtgcctatagtcccagctattcaggatgctgaagcaggagaatggtgtgaacccaggaggcggagcttgccgtgagctggggtcatgacactgcactccagcctgggcgacagagcgagacttcatctcaaataataataataataataataataataataataataataataataataatgtaggacatgcactgtgttttctgattttcagtgtcaaccatagcgtttactcaccacttttagccacaacctcttcaagcggcaaaatccatcctgcgtttacacacctttatgacactgtaatagcagtgtccttattagccatttttatcaagtcataagtttcactttttaaatgaataaactggccaaatgctgaagcttaagtagcacaatgttctaacagagtcccttatttagtactttaaactgattttcctccccaaaggtgcaaatgctacataattttctattgtgaactgtattattagtactatatttaaagcaaagaagctgttttaaacctgtaattttcagtcaaatgtggttctaagtgcattttaaaaatgacttattatactgttttacctaaagaacaataattcatacagaaatccatagatgtaaataagctgatacaaaagtagaaaaggaagatcatgcctattcaagatgacctagtatgttctaagaccctgaattaaaatgacatttcagtagggttgactgggagtttaaatagtagagcttttcattcagaattgtacttttccaagttgaaattatgctgtggagtaactaggaaggcattagagggcctagagaagtaaacttaggaaacaagtggtggttgttaatgatgagggtggtgataaaacatgcagggtgctctacaggctctttcatcctagttaggtctttggtgaacgaaaaggccgatcgttacaaacgtaatcacacacactttgctctaagtggcttcccagctgcacttctcaattggtgaccatcaatgcatgaaccaggggtcaaaggcataaagagactttctttcccctaaaaggagggtctctctgacctcaccctttgggtttgttcatctatttcaatattgttgcaaaggctgaagtcattagtgtttaaaccattaaacctaaaagacaggggtacggagaactttatccacattctttccattcatcaatctggggtcctcatttataagcgaaagtcatagacgatgtgtacctagcacaatgaagcactccacagatgagtgttcagctctcaactgcaatgactgcagaaatcagaccctatactctgggctggtgcattaagctaacgttagtttagatccatccacagaccctcctgtaatgccagtctgagatctagctgggggccaagggcagtgccacagctcatttaattgtatttattctcaactttagctgaaataagcaatgctacctggacttccccttatgcctggctgggggcatttgttttcaagcactttttctgtagccacaatttgaaaaaactaggtctgcatccttaatgaaattataagatttaagattcccattcattcttacagtgtgtacactctcctacctatcatctgctaccccaaaggaaggttcacctgtgagcctactcttccaatgcccatgttttaaaaatgtattctatgctgtttaagaagttaatgtccaggcagaactctgacagaatgtaagaaataaagtgtattattttctcaatctccagcctcagataatgcttgcttataaaacactatgaacctgttatgaaaaagaactgctctgtgatttttaaagcttttttatttaattcaacattaatttatgaagcacctgcatgttaagcactgtactcagtgccaaggatataaagatgaataagagagcatgccagccctccaggagcacgcagaacaataaaagaggcagctatgtgagccgactgaaaatataatatgatggatggatgaatggatgggaggaaggaaagaaggaacaaagggatgaaggatgatagatagatggtagacaacagagaagccagggagtgaaggcagggggagaagtgctatgaaggaacatagaaagcaactcattccatgaggagtagaaaagccttcttggaggcaatgataaagaagatttagtgccagcttgacttcatcaggcagggtgagtagatgcatatttctggtatggagaaattcacgctaaaagcatggaggcctgcaaagtgcacagcatgttagggggacaacagtcaagctctgagtagctaaagtatagtgtacctggcacagcatcctgaggttaaagctggaggggtgaggtgatgtaaagggtcctgtatgccggacccacaactccagctttttctcttctaggttagtgttttctagcataagtttcccagaatactaattctatgggttgctttgcaaaagcaaaaacaaaaaaccattttgtggccaagtacatttgggaaatgctgcctcctacaatctcctttcagagattagtaacatatatttggtctcgagggggctgataagcgtggcaggaaagaaatcagtttaacttggacaccatttttgcagaactcctgacatccctcggcactgggttctgtagaacacatgggggacactgaacactgccctaggaaagagaggacaaaaggagctattggagcatgaatgtaacatgatctgatttattttttccttttccttactacagaaaaatatttatttggcagtctatgtctggtaatgatatggaggttgaactaagtttggaagagattaatggcaagaagccaggtggtgattaaatgcagaagtgagagagcccactcaagagactttctaggataaaattaaaaggaattcacaacggattagatatggaatgatgggagcaaaccaaagagtaacttcaaaggttctagcttaggagccaggtggaagactctcctttaactaacagaattacagaggagaagcctgctctacagaaaaggtagtatggtcagtgctggtcattttaagtatggaatgttgcaaaaatatccacataggcaaatcaagatagcagttagaaatatggctcctcagcttacaaggaaggtcaggacaagagatacacactgtaatcacagagcccacagaagaagtcatctgaataaagtccttccaggaaaacacacaggacaaaagaatccagaatccaggatacccacatttcaacatataaaatacaaagttaatccatcagctttatggacatacaacatccattaacactgcagtcctagatctgtgtttaccttatccagaacagaatacagggctgagcccgacaatggtttatatttttaatatttgtcatcagtatatagtataaaggaatcaaaatatgtttggaatagaataggatctaattaaatacacctgaaggccagagcaattaagagaattgaccaaagccttatagctagtctcatttgcaactagttcaacaatgatttttttaaaaaaagaaagcgtgaatcatgggctcaggtttgaaaaggaccctgagaggtccatctgtgaattttcatcaaaattgtatttttaattctatgaaaaaaggttgaaaattaattcaaaatatgatattctctttcattttacttgtttctaaggcatttgaggatgcaaataaaatcagataattcacttgaaagtaagatcattatcaggtattagaaaagcattttgctgctttcccacgttatctttttatttttaattgctatgatagaagagtgctaacaatattagctgttttttattgatgtaattgagttgtgtttcatcagaatatcatgggaattagcctgtattcttgtaagggtggtcaagaaaagctgtattctagatcaacaatgatcttatcagctcacgcagccactcaacagacattatcaagggccttacatgagtgaggcacagtccttactcacagaggagacatccaggaaaaggatgaggaagtagcccactcacaactgagttcgaggaggtttccgttggccactacttaattgaatataatgcattcagtgaccagtatgaagtccttaaacacttcagtatacatacttacaatcctgcattaaatgtaacaggatttacaagtctcttttgtgaggaataaaaccaaaaacccaagaattatgaagtttttttgcacaacaatgtgaacagagtgaacacgatctaattgttcactttaaatagttaagatggtaaattttatgctgtgtgtacacatagcataaaatttaacatcttaatcattttcatacaactaaaaattttttatattatgaaattaaaatatctttaaataactgacgtttgtccataaattgtttgttctacatcctgcaaggattgggagcttgtcaatttttttgagctgaggaagaaagaggtgaaactggatctttaggaggattcaccagataatgctactcagggtttatgaaagagaaattgaatcagtggacactcagaagttaggaaagccagcatgaaagtgaaatatttaaataggaaggtagcagtaaaatttggaagaatatgagagaccttcgagaagagcaatcaacaaggtgtggatatggtatggatacggaaaaagaatccaagacgattccaggatgtcggatttcagcaagaacatggtatttattgttactgtcaacctgagttgaaaccaagaaaatgaaaatgcccagggcgcagctggaaaaaggagaccacagtttagatgctgaaccaccatggaccccaaagataccaatctgtggtgtgtaccagaaccacaggctcaaatgaggccccgctgcatccaaccttcacgaacctttatctttacccgtggaaccatcatgttctcccaaagataccatgctgctcacctgcccctacccagtcttcacctgaggtttacccaagcagggagaagggattaacagagaaaggtaaaaataatttcacttcaaatttgatgagactaaagaaatttctggagggccagatctcttctgaaaatttccctggctctagggagacagaagagtcaagcctttcacacacttaacgctcttcaagattctgacaactgttgatcttcttgccatgtttgggtcttagcactgcaggaaactcagaaactctcttgtaatctgcgcagaaggtcatttggtgtatcccgatccatctctgccgtgttcctctcgataaaacagcagattaaattaatccttgctgttcaacattcacaagacttgcaagtgtctcctctctgttgccagacttagagggaaaaaagctgagtcagaatgtcatgatttgaagttggagaatcttattgtgatgtataaggagatgaagaaaaagaaaactgtttttaactaaaaccttcagaaccttatcacaaaatgggccgggcgcaggggctcatgcctgtaatctcagcactttgggaggcaaaggcgggcggataatttgaggtcaggagttcgagagcagcctggccaacatggtgaaaccccgtgtctactaaaaatacaaaaattagccaggcgtggtggcgcatacctgtaaccctcgctactcaggaggctgaggcaggagaattgcttgaacctgggaggtggaggttgcagggagccgagattgcgacactgcactacagcctgggcaacagagcaagattttgtctcaaaaacaaaaacaaaaacaaaaaaacccaaaaaaccttatcataaaaagtcagtcttgacagattaaatggaacttttccacttacaagaagcatagccaatttcaaagattaaaaaaaaaaggaacttggaaaagtgaatttattttcactagaatgtatacatttagagtatcttccctatctctgtcctttaaatttaagcttaaacatttattttttattaaaaagtaggcatcctttaatttctaatctaaggaaagaatggtttaattaaaattttatttattttttttacttctgctagctatttaatctaggaaatacagctcagaaaaaaaatgcagtcataaaacctgttggtataaagataagcagtttatttaatatctaattaaatgtggtcaccagagaaatcacagcttatgaaactttatcagaaaaagattaatccatttcaggcttaacccaaatgtcataagagaactcatgaatttagataggaatccacttattatccaaagacgttttcatatcaagttaggtgagcctatattactagctatatttatacttacttcaatcaaatttatatactttgtagctatcactgatgtggggcacaattatcgaaccagaataagataatagggagcctttctgtctttatcaaaaatttctagaatgttctaaaacacttggagtttatagatcccactctttcagaaattaaaaaaattagactgtcattttaactgaaaagcaattccacaactaactactaaacacctattagatcttgggctcaggtgttaagaaaatgaggatggagaaaatgattccttcctttgaagggctcagaaagtcgtaagtgagataaacccttaaataaccactgatataaaataatgacaactgtaaggcaggggttgcttgtttctctccaatgcctagtctggacacatggtgacccagcttaaagacctcatgtcccagcctaaagctatagccaggtgatctctggccagtacggtgtgagaaaaagtggttcctgctcttccagactgcacctctatgggcaggatatgccctcccctttctgttccttcttcctgatggctggaagggaatatggaccatcttggatcatgtggataagactaacactcctataggtggcagagcaacagaataaagggagtccaatgtcacagagcagaactagcacactgcctcagattgacaatgatagaaaaataagctcttgtcttgtatttaagccactgttatttggaatctatcccatgaaacagccccatgctctaattaatatgtaacggagatgcttctttttctaaggatttttggttctgaaaaatgccgccttaaaagaaagaaccaaaattgaatagtataagcaaagaaaagtttaatttctaactttttcatgaaaaataacacctttaattatgacaatcaatcttataaataacaaaatagagattataattaaaatcttgtaaattctcagaaaagaataatttaagtaatcattggggggcataagtttaaaaataaaattatataaccacatgctggaactaattttaaaaattagaaaactaaaaactaaagataaaactaatatataaaaactaaagataaaaataatatacaaaaacgagagagagttggaaacaaaatggacacttcaaaatacaagaaaggcttaggaaaataacagtgaatgtagctaaaaatacagatcaaagcaattagagagaaactaatagatatgaaagaaagacaaaaatgattaagcataaggacagtttcagtaagggacaaatcaaaaacagtttgtgcaagtaatgtgtacaaacactttatcttttttttttttttttttttttttttttttgagacggagtttcaatcttgttgcccaggctggagtgcaatggtgtgatctcggctcattgcaacctccacctcctgggttcaagcaattctcctgcctcagcctcctgagcagtggggattacaggcgcccaccaccatgcccggctaatttttgtatttttagtagagatggggtttcaccgtgttggccaggctggtcttgaactcctgacctcaggtgatccacccgcctcagcctcccaaagtgccgggattacaggagtgagccactgctcccagccaaacttaatcttttttaaaaaaaaattccctgagctagaacaaactgatacgcagactgaaagaacactccatgtttcaggaaatgcataatactgagacatattttggttaagcttcagaaatcccaataatactttagggactcaaatagaaagaacgaatgatctataagagcaaacagagtgggcatcttaaaagacatcaaagctcaagagaggctccaaattcgatgaaaccaaagaaacagaaagagagaggtaaaaaaagtgagacactgtcatctctgaaatgaagctcaattcatgtttgttagttttttttccagatggtgggatttgagttgatttttaaacttcatttttcttcattatccaaattatctaaatgagcatgtaacctgtcaatataaacaattagaaattagacagaaaaatatcaaaaataagatggaatgcaaatatcccaatgaccaatttccaaagattattatcattttttaataagaggaacgggccttgaaggaataatctggtgggaaaactagaaaaggatattactccaggcatacgcaaagacagaaaggtatgaaagaaaatgatggtttaagggaatggcaagaggtctgataagtggatggagatcaagcctgggtcagattatatgctatgcttgaactcattctagtgttattctttatttttgtcactgatctgcctgacatcatttgaaccagtgaaagtagggttcaccctatatttgaggtacagaaactcaagtccagacatcagggacaaaattattagagctggagtaccagctctaataggaccccatcctagaagatgacagcccaaagacaagtgagaagggaactgtcctcagaaaatttgtgagatcagatgacaccaaataaaaataaataataatgtatggtaatttaacacatgtggacactacaggaattgagaagaaaggaaggggcactttggtggctggagcaggtgggggaagtggtaagacttgcactaggtcttgaaggaaggacagagcattttaacttaagatttccagtttcacaagaaattgtcttcataggtgactcctacctgtggctataattccataaaaagaaagcattttttcttgctgaaattatagaaaaaggatggactaataagtcaattatgctgggatttgactatttaaaaattaaataactaaagcctcatcttacgtcaaaacaaattccagatgataacttttcatctattcctttttttttttgagacggagtcttgctctgtcacccaggctagagtgcagtggtgcgatctcagctcactgcaagctccgcctcccgggttcacgccattctcctgcctcaacttcccgagtagctgggactacaggcgactgccaccatgcctggcaaattttttgtacttttagtagagatggggtttcaccatgttagccaggatggtctcaatctcctgacctcatgacccacccacctcggcctcccaaagtgctgggattacaccacgcctggcccatctatttcttttatagtgtcctatgttagatttaactctaatctttggtaacagtctttgtaaccatactaacaaaggaagagagagagatacaaaatttaatttgtccactaagaacaaaggttaatcaacaaactggaaaaactgtttacaatgtaattaggaaagattgattttcttaatatttaaacaactcttttaactcaatgagaaaaaatatatataaacacttcaacagaaaaatgggtaaaggatatgaacaaaaaatgcacaaaggtttatatatgagaattgtttgctcattttggaattataaattggatgtctaagaatttttcttaggaacaaatcacatatatatacaaaatttacttagtcactcattgcagaataatttgtaatactgaaaaaacctaaaacagcttagataaccaacaaaaggattatacaaataaattataggataaaatcactgaagttgtccaaataaatgagatgctgaaccactaaagaccaagtattgaatgttaccaaaaactgtataacgacatgggaaagtggttacaataagtaaggaaaataaattagataacaatcaaatataatagctttaatcccaatttaatcagaaagatgaagtacagaaaaaagaccagaaggatctgctctttaaccaaaacattaactgtgattatttccagattatagaaccacaggtgatttttttcttctttatgtttttgttgtagttgttgttgttgttttgagatggagtctcactccgttgcccaggctggagtgcagcggcgccatctcggctcatgagtagttgggactacaggcacctgccaccacgcccggctaattttttttttttttttttttttttttgtatttttagtagagacggggttttgccatgttagccaggatggtctcgatctcctgaccttgtgatccgcccgcctcagcctcccaaagtgctgggattacgggcgtgagccaccgcgcccagcccttctttatgttcttaatgttatctaaatttttataacgaagacctgttacttacaaattctttgctgtcctttgcagcaaaacttccagaaagactgtatgtaatgtctctaattcctcttcttgcttctttctcaaacccaagtagacgttggccccaaaaactctcatcaagggaaatgctgacctccatgttactaagcctaacacagcagaggtgacactggtaataactcccttcccttcttgagatcccctttcctcgtggcttcccgaagctatactctacgttttcttcctacctactgatcccttcttctcttttctgctggttccttctcatcagactgacccctttaggtagggatacaccacaggtcagccctcgtcacctgccctcactccctgggttatgacatccaggttcaaggcattagatgtcacgtgtatgctcacaactcccaaatctacacctccagcccagatacagatttcgttctccaaactccagacttgtgggtcacctccacttggatgtctaagagacaactcaaactcaataagcccaagtgagtaagtaaactcttgctcttgcccccaaaacctgcctcacacatagttttcctcatctcagttgatagtaacttcttcctttcatttgctcagaacaaatatctgtcctcagttcctctgtctgccaaccaagctgtcagccaatcttactggctctccttcaaaatatatagagaatccaatcttaccatctttgctgtccccatggtcccagcaactatcaccccccccccagattagcacaataacctgccaagccatgttccacttctcccctgacccattacagctcattctcagtgcaacagccaaacccatcattttcatacctacgtcagatcatgacactcctctgctccaaacccttcaatggctcccaattctcacagtaaagccacagtccttactgaggcttggcaggccttgcaagacgtggcctcccctgccacttctcccatcccatgtacaccactgcagcatgctgtcttgttgctatcccaggcgaggaggcacattcccactcagccttcactccagctttccatcctactccacctggcatgtgccttctccctgccatgtcttcctggctaactctaccacgtcccagcctcactgttctcctgctcacatctcaatgtctcagtgcagtgacccagccaccctcttgatgctgcacccagctcccaccctccacccccatgggcatccccagccctctttcccctgctctgctttttcctctctctgtaccacttactgtcaactgccaaaaggttaaaaatcaaaattctaacaggaatttaggtaggctatggtgacacaggaaggctcctctgactttcaggtctgtctggtaaagggtggcatgaccctgtgtgaggtactgtcctgagggacacagtaaggacctcgtaggtacgaatcagtcatcaaagatggatgaaaatgaaatcgccagcaattaagaaatcccaggggcatgaccaaagctaagaagcgttaagttatagatgggttgatttgttcatcagcataagggtcagagttgcccaaagatgaaaagggcaccccaggagggcaccatccccttctgctggggggtttcaacatgaaagtggggggtttcagcatgtagcagcatgagcctcagcagggatgccacagagagcatagagcatccctcgggggatggaggaggtcttcatcgctgatggagatatccaagaatgggggagaggtgggcagagggcctgtctataccttttgtcagggcttatagagagaaatagctgaatgcatacatttttctattttctgctgttaatccttttgttacacacataaggggtcaaccgtttagtgtgtattaaaaacatgccaaggcctatatggacacagatgctattcctgaaggttatgtctgtcagataacaaatacacagagctcaggagacatacacggcttatgttcacctaaattatgaaacaatgcagcattcccatgaataactgaacgaggaatcgtgacagaaacaggattggtaaagtactaaatggcatgcagagaaaaaggctgagagacattctgggaaacagcaccccatggggccaatgggtgtttctaagaactctgcatattttaggtctttcgtacattaaaacctagttcatgtggcagagacgctggaaatgtgggctccctcctatattgctctgttcccctcatcaccctccttattcccacatcatcttgtggccacagaacacgaccatctgtgggagcacacgcacagcacacccgcacacactacccccggggaaggacttctgctcatgaaaatcaaacaaaggagaacaaggaaaaagaggcagagaacacagcgtcccactcagagcactgcctgttaagtgtttgtttctgaggccagcatctagctctatgatttattttatatgtgctgtgtttacatacatcagtaaatacggtttccatttcgctttgtaacagcagctataaattatatgttggaagtgtttggctcctctcttcccataaaggtctggcagggattacggaggccccaacacgggaaggcccaggattggtggggagcaccttctttcatccatatccttaaattaattaactcacccaataagtatctattgagcacaaactatgtgccaggaaccattagagatgcttcagtaagcagtaccatgaaaatgggacaaaataaacaaaaatccctggttttgtggaacttataatctagtgaaattcatccacctctcttcaatttctacattcagagctgtcaacccatctggggttggacacatgagcaggtaaatgcaaagcaaatagggccactataaataactataggaattattatgagtgtgaattgtttctgagggctatgtgccagccaccgtgctaagcactgtaagtactaactcatctaacagtcataaaaatgctatcaggaggttctaccatgattctgtcacagatgaggcaactgaggcaccaggccatctggccagcaaatggagtgaagaaactcagacattccagctctagaacccacactcctcgctctgctctagaaccgggccaattacagcagagagaggggtcccagtcagtatcacttccagaggcatctcttggtcccacagcccaccctttggtcagaacagcaacaggagtgtccaggcatggtcaacgggtgcttgccacatgagtagctatggaatgggatctgcaaacagcaccagggagactccattttcatctactgtaaatgtattgctaatgctggttaatcatgtggagataagtgattctactgctcagcccaattaaacacactatttaatacactgtggcttcagacagatctgtctcaacaagtcattctaaatgcttactatgtgaacattttaatacttgtcctcagctcaaatcttgttgatttagtatttcatttaattgggaataaagctctcatgtgataggttccactatagataataatagctcagaaaaaacaaatacgcagaaaaagagagaaaaggtgatctcagacttgaaaataaaatctcaggagggggctagcatcaaataaggaagaattacgctcactactcaggatttgtgatattaatccaggataatcttggttttcaagatttcagttatttctaatacaaaggaacttgtagaatttcatctctctctagcacgcgcgcacacacacacacacacacatacacaaacataaaatcactctcaacaatatactcgcttttctattttgtttgcttttgtttcaaaggtgtttaaataacagaaatgtagccaatatttgccaaatgcttagtatattgtcactgtgctaagcatattacatacgtctcattcactccccgctgctgcaataactctgccaagcaggtatcattatcatgttctccacctcacacataaggaaactgaggccctgaggaattaaaccacttgctccccgtcacacggctgacaggtggcaggcccagttcttgctggtctccatagctgcacccattccacagcattctacctcttccctgtatatctgaaagactgcacaagatttctgaccaaagaaaggatgaaagacacaagcttttctcacgaaactggaagagtgacacctcctttctgggtggaataaacacgggatcacacatcactttcaaccaactccaaacacagaagcccgggggttcttgagcagccccaggtgcggagctcaggccctggaggctgcagctgaagggaaagcagccctgtaatctgttcagacgcattccgggggagaaagctttacgagaactgagaaagtatggaaaataaagtgggcttgctaataatctccctccaggtcccaccctccacgctttctggtcagtggtagtttcccacccttgaggctagaaaacttggcttaatgatataagtctgaaggagcccagagaggaaagagaaagcaaaaagtctctagcaccttcacacacacgatacattttaacgcactttcttcaaatttctcatcacaagactatagaaactgaaactgaagttttttcatgttaaatgccttacctttttttctgttttgttttttggtttttggtttttttgagacggagtctcactctgtcgcccagactggactgcagtggcatgatctcgtctcaccgcaatttctgcatcccgagttcaggcaattcttctgcctcagcctcctgagtagctgggattacaggcatgcgccaccacgcccagctaatttttgtatttttagtagacacgaggtttaccgtgttggccaggatggtctccatctcctgacctcgtgatccacccgccttggcctcccaaagtgcagggattacaggcgttaagccactgcgcccagcccaagtgcttcaccttttaagaccccaatggccaaacataaaaggactggaaaatatggaaatatttccacttgccagtcttcattacgaccttcagaacgacccatctaaactacagaaaccaagtgcttccctccagcatctgagatcaaggtttgggtctccactctttcgggtatacgcagtacaggcactccacgttctaagcggacggaagctgcccatcgagcagacaggaggaagcgcagagcgtaaccatccgtgctgttgctatgccacgctgtcctgagggacgtggcctccgactgccatgggtgagcgagggtgatgggaaagatgacaccacgacaggtggggaaactgagtctccaggcttgccacacaccctcatttctcccaggagcaatcagatagcaaacttcaatttgaaaacattatacatctcaaatgtaattaagaaattcgactggcatgaatatgtaatgtacacattgctttacagatgccttttttgcccgacaggctggtgccgactttcatttggaagaaatccattttcatacaaaggtaaccaagagtgacaggaaataggaagcctacatcatttatcttctgtgaactttagaaaaaatcagttaattgcttttctaggaagctattttatggaatcgcagtgcttcatctttctattctttttcatggcataaacggcaattttaaaatgcccttcatgaaaattctatgattaatcaatacatcttagactatttaattacttattttaacaaataaaattctgatcaaccataaatggtttctctgttcttatagatgaattatcaaccactacgaaaacatctaggataccacagtctattgattgatatccaaattcaggtgtctctttccttaccactgactaagctatgggcaccagctcctggcttcctctgctctcctggcttatcaaatgaattctgttcccagccactggagccctctgcaacagcagtttcaaactatcactacttattaaattgcaaacagaaaactataaatgtgtaggttttggaatacactgctgaagctgtaacttgtcaaaccaccaactgcaaaaggcccaggacactcctgtgttgtctcaatggctctgcatgttaggtttttcacaccactgtcctattttgtgccctgcccccatcacctaacatatacatacgtatttttaaattctaccaagtttaggctaatgtaacttttttcaaatccaaaatgatcatcttagtaatgattttatattattccatgagccaaagacagatacactatgaagttaatgatgcttaagcttcagggtctctaaggctctggggagttgggggtcgggggggtgggggtggtactgtgttaacacagttatatgtctttgaaataatggcaaaggtgagatattttctattccttcatttctaaagaagatccccaagactgcaaatttgaggtcccacaaaactgtatctgcctctctaggttaacagtccccaatgtttgaatctggaattacatgctgagcacaaaatattaatttgcgtgtgtgtgtgaacaaaaaataattcacttcagtcagaaataaaattcagtgtgctgtgccctagaacattctagagggcatgctttggctattcgttagtccctggtctctcacccaaccatagacagctttccaaggggcactcccagggaggctcacttaatgaggagtggtgttcagaataaaagactcagctacaacaacaaaaatatgtttttcattaaacacaaaactgagtcggaaaaagccagccaagaagcaggtgtaagagttaaagaattctcttgaggtctttaacttctacatcaaattgcactggatttttctgcactaattacctattattgaagtctcaggaattactgcaaataatttgccatagcagcaggtagggtgcagatgttgtaagggaaagaatgaagagtttatgaagtgtaaaaccaggcaaagggattcaaaatttccaaatttttaaaaataatacagaattgtttttctactacaagggtgatgaaggtgagggaattttcctagggctaaaaggccaattttaaacttaatttggactgtaaatgagagaaactgcaaattaaaagctatgtgctgcagtctaatttattcagttaatgtaaatttcttggaggcagagattacatcttacactaaaaaaaaaaaaaaattctctcattgcattgcacctagttattaatctgattttcttatgaggaatgtacctatacgatgccaaacagctatttttgtatggccctccttgtttttatgtcatttttacctaacccttccagcccccaaattcttcacactgtgataagtcttgctctgtagctaacatcctcaaaaaccatagtcaagtaataaccttgcaggttattttctttggaaatttccctaaaaaacccttctctacctcactggaagttaatgtctgtactattgagaggacattttcataccagcagtatctttatttttaaaaatattggcatgaatatttttgaaattgtcacattaaatcgttttacctctttcaaaaaataaaaatatttattccctcaaaagtaaaatctggttgataaaattcttcagcttctatgttatgattgtgaattttatttttttatttattttttgtagagatgggatctcactatgttgcccaggctggtcttgaactctggcctcaagcaatcctcccacctcagcctcccaaagtactgggattacaggaatgagccactgtgcctggcctgattgcggattttattggaatagcctataaatattgaacaatgcacctgcgaaagagtatgtcttaatcttctcttggaatactgtcaacaaagatctctgagtttgaagggtagaagtaactcactacttggctgctgactgtgaaatttagtcatgtttttattgtgggagtggactgattaaacagacaagtgttataaggttcaaattacaacatttctcctaatatgcagtgcttttaactatgataaacactgcaccccccttcacaaaaaaaaaaagaacccacccaccaatttttaactttcttctacaaacacctcttatctcttctctatcaaagcatgactggcctttttgaaatattcaggacaaaaagttaggaagagggcaggctcgctagttcaatgtcactacatataggggaaatggaacacttcccatagaaagctctgatttctctcagcgtgagtctctgtctgaggcatccccctctctctctgctaaccagacaccatacacagcatgttctttccaatctgagtcctcaaagggcatcctgaaagtgtccaggttattaatgacatacccaaaagcctcataaaaactgcacagttatctgcttaaggctttactggcaatcaaaaattcatctttttttgttttaactagagttttatgaactcactgaattccaaaataaacaaacatgtaaattattacctaataaatctgaagtttctttggtagataaaaaccattttaacaagaagtcaattgagattgaaataatgaaggggttcctggtggttgtaaaagtcagtcaccactgctcaaagatatgccggaatttatttgctgctaccagtcatttgatgatgacgaatcaaacagcctgatgaattcagttttgtaagatggtacctacgtgtgtctcctacaaacttttaaaaacgtaaatgcctatagaaattacattttgcttccattagtttctagtgaacattttctagaatctatcataaacgtgtaatcaaaaaaagttacggtatacctgtcacttgatcttctctacaaaaccagtgtaaacatctcatagattaaaaaagaagtcttttctaaacggtgatatgttgatatccctatcagtccgtggtgatctctgagatgatagttcagaaatgtttaagctcagccttgtcaaaaatgcaacaacaaatgtcaaatcattgctttcatttggttattaaatcaaattaagatacaaagaatattctggccacactgttactcagtctttaaagaatatgttaaaaagagaaaaaactgaacagttcctaagtataatgttctagaactcacatttaattttagttagtatacaatatcacagcaaaaaatatgtatgcatggtcatatttttttcttcatgtactcttcacaaccatcatcaatttggaatatggtctgagacaggacaggatttccaaaacatttgaatagttcaccatattcaaagttgaataatttaaacaattaatttaaaaactattatgaggtttatttggtaaagtttgtgttaaaatatttcaaaacacgaaaatgttaagagttttggaactcttttacataaaaatttaccttaaataggtaaatagatactgaaattatagcctttaagtgcttttcttacttctgaatcacttattcacttatttcttaattttatttataccctcagtgaacactagctattcagaagaaaattctcaaactatagtgaaggggacattccttccctaactaatacatacacacacaactgcatttgctggaactctaaaaattcaaattataataaatttgagattttaagaaatcactatttaagtctgcctcccctttcagtgactgctacaaatcctaccacatgaagttaaccacatcactgaaaaaaaagaaacatggaaactgaattcacgagggtcaaattgtcacttgtaactatgcagttgcatgtgaacggtgctgataaagactcacctccccctgcttggggatgctgaacttggagagcttggccttggctctggcaggctccggcttgctggcagggactcccctgtatgatgtgcagtgcacgctggtttccgaagacgacttcagcttaggagactcatcaggggcctgatcttggccgtccattggcctcacatacgcggtcggtttctgctggaccaggctgggttttgaagctagggatggaggaaagttctgaacacagtgtccgctgctgctgtgcttggccgccatggcaggtggcctctcctgggtctgaaggcccacctccacattgcacacttgtttggcccgaggctgctgtctgccaacaccatctccaagcaaggtcctgagagagccctgttgtgctgagttggaagaagaagaagaggaagataaggatgaggggggtcgacacatagggattttcttttttcattatagttctctgggttttagcagatttgtgcaaatcaagcaacctgtgcctgtgcttacttgctctctgttggccgtcagagggtgggtgcccagccttctgccagcccatagtgcctctcttactctgctgcacggggacagctgctggtgtggaagttgtagtgctacagatagacgagggctggttctgggctcttgaatctgcaacaaaatgttcatcgatcttgttcacaggagtctgaggaaccccaggtttgggaactccaacgagatgactctgattggatctatcagttaaaaagtctttcatttcatcataattgcctaaagtgttctggatccggttggagagttcatcccccttgttagtctggagaaagaaaaacacatccacgctattgttagagacaacagaaacaccggagataatcaacaggtgcccttatcaatcacagagccagggttgtcacatgcagaatgagagctgagagatgaaatcgaaatccttatcgtctctgaagatgtctgtcagcacttggtgatgcaccagaacaggaagcctgtaatggccttggggtgcataaaaagggatctatccggccgggcgcggtggctggctcatgcctggaatcccagcactttgggaggccgaggtgggcggaacacctgaggtcaggtgtttgagatcagcctgaccaacacggcaaaaccctgtctctactaaaaatacaaaaattagtggggtgtggtgtcgggctgctgtagtcccagctactcaggaggctgaggcaggagaatcacttgaacctgggaggcagaggttgcagtgagccaagatcacgccactgcactccagcctgggtgacagaaggagactctgtctcaaaaaataaaaaggagcagggggatctatccttggtactgtgtgtgttgcagctaaaacagattacctggaaatcaggaaaattaactattgcaactttaaaaaatgaactggattaagtctttctatgattggattgtcctgtaattgtagtcccgttagaagctttacttgaaaattcagatttggctcgggattagtctaaatatcattcttgccagaaatccagagtgacaggcaagagatgtcaatgtgaagcttaaaggaacatggggctaaatgtgcaggaagctggaatgacccagagctccatgccgcctaaggtatttgtgaaatctgggatgacatttcattttggaagcaaggttatatttctggcctttggtaaaaatgagaaataatcttagactttctttctcattagccctaacaggtactctaatcctagcgtgatccatgtacgacaaatatgtaacacaacctccttctaatagtgtttgtttcctacgatctgagaaaacataacaaatgggattgaccttataatatgtcaacgcggagatgaagtctgtattattgataaaaatcacagcaagcagatctcaatagtaaacaaaagttgcatgttactgagggagtggccagtaaagccatgtgaaccacacacctcaatttctgggggaagaccccgtacttggtggctgagctgtcttccctgggctgaacagacagaagatgcagtcaagtttggtcggccaattcttttagtcaaggccaccgtcacagggagtgagagaaacaagtgagaggtagagatgaacaactgaaaaccatctaccttgtagggctcactgaagagagagtaactagaattaaacgtgccatcatcctgttgagtttcttgatttcttctttctcgttctttcctccgtaatgcatttctatctggttcatagacactgcatcaggaaaaagaagagagaacaaccacacacacaaattaaactgtaaagcccaatgtaacacttgtgtgagtgcagaagtctggttcgtggacaaatggtgatgacaacaagaacatggatgagacaaaagccagagtcatcaggcagtgtgctggggtgtctaacaattacattctttggggggaaaagaatccttaggaccagttccaaccagtactaggtttctcttcctggtatgtgaaagaggaactgtttaagcaactttgacaggagaagactgaaagtaatcttaaggcagacggtaattacagtgatgtgtaaatagaaattatgagcatattttctctatgacagagcttctgagtgttatatgggaatgctcctgttctttttttttttttcctttttgcatggctgtgtttctgcagtgattctttcattaactagctccctaaagagctgttaaaactgcatgctgcagtggttttcacagttatgagccttcttctgatctctgttaatcagtcaagtcgtcaaacgactactgaatcaattcttccttctgatatatttgacactatcactcctcctaactatgaaaaatgtgccaggaggaaggggtgcaggcaatgaggggagagaacggaaattgaattatgttgtgtcatcaaggaactccgccttttgttgaagaaaattaatatctattctctcaaaatacaattatgaagtggccaggcaccagacaactggaagaaatgaggaagaaataaagtgttccttccccctaataaggagaaaacaaaggggctaattcaactagtgatgaggaagtgacctgtttactgaaggaaggaaatgcacttgtttttctggctccctggataaagaaatctggcctccgtgtagacaacagaaccaacactaccaatcaaaaagagcttacagatcccttaagatgagctctgtcctcctttcccagcagaagcaggtgggttcagtgacctggccatcattctgcttccagctcccacttggtctagtgggcagatgctgagctgggagttggcacactcacctgcgaaatgtggttctccccaaatcagcgacatggggatggaaaagccactcggtctctctacgccttaatgacttcattacaaagcaggggcgtttcatggcactgttataaggcttaaatgtgaaggtaatctataaaatggctttggagtagctttaggtgccacaaaatccaacatattgctaataaaatattgttaataataaaaggatctgtgggttcaaaggaacttataaaaattgtgatttttaaaagctaaataactatctttagtaaaacagaaagtatatgtatcatgtagctgtagggggacacacaaattattgtaaaataaatattgcttatcctagctctgcccgtgtggctggggtacagtttaaatttgctgtctaaggggtgatgcgatactaaacatgcttctggcaaggctgctgcagcacctaaggcatttaatttaaatttaaggttagggaatgtaaagatatccagaacatggagcctattagcattttaattcatccttagtatattacccacagttattagatttgggagtccaaccagtgaccttcatataacggggactgcagcctctagaatcttctaccaactgagaggctcacagcgctaacatcacgatcactgatcactaagaactctctggggtggctgtggtgacagtgaccagcctaaggaaagcaggagatgggaaagacactcttattcacagaaccagacttccagttcccagtagagggtatgatggtcctgccctgcttgtggacatttgtaatatgaaaccccggctttcaggaacattccatggatttaaaatggagactgctctgaggatatatgacccacactgcagatggatatgaagtagcctttaatcaacaggagaattctagtttcattatgcacttctagcttttggaacaatattgacacctgcagttagaaaacaaaaagcagccgggcgctgtggctcatgcctgtaatcccagcactttgggaggccgagatgggtggatcacgaggtcaggagatcgaggccatcctggctaacacggtgaaaccccatttctactaaaaatacaaaaaattagccaggggcggtggtgggcacctgtagtcccagctactcgggaggctgaggcaggagaacggcacgaacccgggaggcggagcttgcagtgagccgagattgcgccactgcactccagcctgggcgacaaagcgagactccctctcaaaagaaaaaaaagcttgcacagcatgcatcataactctccccttttcccatacatagcagggactcccacacacatgcttgctgccctcagtcaggtcaacccaaccagacacacaagactggtgtgatgcacgaagtggcctcatgtaagatggagcaggcaggtggtcattgagaatgatttctgggcttctcagaaggcccccatgcccaaaataatacctcctgcatctgctggctgatgactgaaattccacaactagagagtcattcctctggtttaagatgtcttcacccctgcaagaaatataaacaccacaagaagctgaaacactttaaacctgattagccttgagtatcttagcgtgcatgagtctgtcagcatattttccagaagccgaggggaaagaatccaagatcccggagggtcagaacgggaggcaagctgaacaaaggaagggacaacagtagatgcagccatgaaaacagattcataaactccacttatttttcagtgtggcttaaatgtttaagacaaaggcaataggataaaaaccaaaattaattaggcagatatcagacccaatacatttccagggtctgggagttatgagtcatgtcctactctgaaaatgttggaggtgagagaaaagatgctcctctttaactaaacctgcctcatcccccaacccctttaagctgaaggataccccaaagcactccaagatgctttataaagcatccagattgctagataaaatccactaatgaagttctacccgcataaccagcctacagctcctactaccaagaaggagtgaacaccctcaggaccacttactcataatcttctaatagaaatccactagtcgtcttttcaggggcctgccatcatgctcgtgccatgcttccacaccataagatgaacccagaatgactcaaaatggcaacgtccccacttcttcaaaggagaggaaaggaaactcaaaaagaaaggcaatgccttccctttggtttctctcctccttccttggtgggtagctctgtagcctccactgagctgcttcttaaaactaacctacccattccttctctttaactagaagcacaagccccccaccacatatcatttcatggctagggagctaaaatgtcacttgcttaaagcagatgtcactgtaagagaaaggctgggcttcccaccccctgtatctccctaagtgtctgaactctcacctttctaccaatactaaatgttttgactcataaagacagtagcttctcgacagtgagcccccatcccactaattacaagtgaaaattgtgccggtgctcaccagcctgcagagtgcctttctcttcatctcttgccatgaaagcttagccctcttcgtccccctgccatttgagcaatgtgaagatcatgctttaaaagcaaagaaagctttcgcctgacaagctgaaagtcaggtcagcttcccctgggatggctgacttaggtctaagagaattccaattcccggcatgccaacatatacattaaactcaaaatgtgttgcacgttatgagttatgtttctttgttactagcagatggtaaaaatttctatcatctgcaaagttgctcctatttccataaaaattacaaaaatcacattcctcaaatgtatgtcaccaaatgtatttatttattttgcatgaaagtggaggtagccaactgcttcaatattatttatcatttgttgcagatgcataacattcccagaaaataaacctttttaatcaactccttttaaagggcctatttatttttagaattaaaaaaaatagcaaataaaaaatgtagtgaaaacatttttgatcatttctcacttatttgtttttaatctataaattgcggtatcttgtagagctccagccaaggccaattatggtggttaagtagaaatagacgtctaaacatgaaactgtcatcatttccaaaattcatctattcttgatcatacggtaacagcatgaaactaaataaaagtaacatctatgagcccgatggcttttctcttccattgagctcaaaacatttcacctatatgtcccttaattatcctcacaatgccccttggagaaagacactgatggtgaatattatgactaggttaactcttttaaagatcaagaaacttaggataagagtttgatcatcaaaacaatgtcataaagacacactgtgtaaaaggaacagcaatgtccaaagtaccttactcagctctgcccagagaacaggagctatcctggagccaagaagtggtggcacctcttaaaccctgatgtctgacaagcccagtagtgagaagtagttaacatgagccccagaggcaaaacaggaataaatgaaataaggcaagctatttcccagtcagacagagagaaccataaggagaattctggaataaagtctcagctgttataattttttacagcccccaactgacaaaggatagaaatcagtctctttccacagctcacacacaaagcagacctatgtaacctagaattgtggaatggaagatagagaagtgaataaaaaaataaaaaatgataagattctaaagttgcccagcgagggctactgatgtcactatttttatcaagtgctacccattcattagcctgctccaatctctccctaggctgccctactggtgagaaaggtgctggagccaggacagcctgccctctggctgagtcacaggttgattcagcagacccagccagccagggggggatgacctccttcccactgcactcatccacatgcagcctgatgaaatctgatgaaatgcagtttgcttggagcactcgctccaagcaaactgcatttcccatggaggagacttttaggcaagggtatatgaagccaattgtatcccttgactagaatcatcaaaatgttttattcttatttttaaaaaactatccaaactactgatatgtctccagggttgtggggagtctaagaaataagcaaattcaaggagaagagaatgaaccacctctcacctatcttttggaaaaagttatcatgttttgcatgtttttaaaatacagtccttttcaaataacaaaaacacaattcactttcgtccaaaagcattttctgaataccactgtgtcagatactagggagacagggtcgtgattgagccatcctgctgatgagaagacaacagtctggggcaaggagaatggggaaaaggaagaagggcaccaattcacaatcaaacaatgtgagcagcctgtggtcagggcactggcaggggtagcacaaggaatcagcattgtttcctgcaggagaccagctttgagcttgagaaaacggcaggttaaggagatggaaaagaagaagggcttagaggtacaaaatacatggattactagtaagtggcctttgggagtatattcagaggcggttatgttactctctccatacctccataccaccttgcttcctttttttttttttttttttagacggagtctcactctgttgcccaggctggagtgcagcagggtgatctcagctcactgcaacctccgcctcccaggttcaagtgattcttttgcctcagcctcccgagtagctgggactacaggcatgtgccaccacacccagccagctaatttttttttttttttttttttttgtatatttagtagagacagggtttcaggacgttagccaggatggtctcgatctcctgacctcatgatccgcctgccttggccccccaaagtgctggaattacaggcgtgagccactgtgcctggcccaccttacttctttaacaaggtggaattcctcatttaaagtttcatttatgtggtttacccactgctaacctatcattgctacctcactctaaacaggttcgtctgatcccttcctaagagcagatttggtttggagcaaatgcatgaagagtggatgcagaggacacagagaaacactctccccctttttacagtttatatcaggctgcctctaagcagcctggccacagagaagacaatcttttcagatactttgagacctgacaacatgctaacatgctccctgggcatggacctggagccatgagggtgaggaggaagaagaaaaggcataaggaggagagaagaacgttccccagaaactcccctgctctccagagcagcagcgtaagcactgtgtataattaaggaaatttaatcaaacactccaaatttataacaattgttttaaatttaatgagtcaaactaattaacatctcttgttatttataaagcaaatgataaaaattaaaaattgttttttaaattagagtaaagcaaggttgctgaagtgtacttgcaaattcccttcttaatctatagacatagctggtggactgaaaggcagaaagacagtgagcatgggacagaggcaactcagacagagaaggtgaggctgaaggtagaacgtggtaaaaaggcaagaatctcccaactggagtcttttgaagctctgagttgttgtggttgtgatgctataggtgcgatggtggtgatagtggtggtggtggtgatagtggcagcagaagtactggcagtagtgttggtggtagtgatggtgatgatggttatgatggtggtggtggtggtgatggtgatgatgatggtggttatggtagcaatggtgacagtagtggcagtgaaggtgttgtggtagtggtggtggtggtggtgatggtgatgattgtgataatggtggtgatgacagtgatggtgatggtggtggtagtggtagtgatggtggtggtggtagcaatggtgatggtggtggtgatggtggtggtggtagaggtgctggtggtggtggtagttgtggcgatgctgataatgattgtggttgtgataatggcaatggtagtggcggtgatggtggtgggggtgatggcagtggtagtggtggcggtggcagtggtagtgggggtgatgatggtggtggcagcgatggtgacagtggtagtgaacatgttagtggtagtgatagtgatggtgatggtggtagtgatggtgatggtggtggttgtgataatggtgatggcagcgatggtcatggtggtagtggtggcagtggtggtgatgtggtggtggagatggtgatggtggtggtaatggtgttggtgatgaaagtggtgatggtactggtggtgatagtggtggtggcggtagtggtggtgatggtggtagcgatggtgatagtattggtggtgaacatgttagtgacagtagtgatggtggtggtggtagtggtggtaatggtgatggtggtggtggtgatggtggtggtaatggtgttggtgatgaaagtggtgatggtactggcagtgatggtggtggtggcggtagtggcggtgatggtggtagcgatggtgatagtattggtggtgaacatgttagtgacagtagtagtgatggtggtggtggtagtggtggtaatggtgatggcagtgatgctgatggtggtggtggtgatggtggtaatggtggtggtgatgaaggtggtgatcgtgctggtggtactgatggtgatggtggtggtggtgatgatatggtggtgattgttatgataatggtgatgacggtagtgaagttgatggtggtgatgatggtggtagtggtggtaatggtaatgatggtggtggttgtgataatggtggtgacagtagtgatggtggtggtgatgatgacgatgctggtggtggtggtaatggtgttggtggtggtgaaagtggtagtgaaggtgctagtggttaaaaatctgttgaggagtgagaaacagtcaacagtgcatataacaaattcttaaatcctaaagaacatgactatgccccggctcacttatcctggattttccttatgagccaagtaatttcagttctcatgaatgttcactctactttcccccaacagcactataacattggctcaccagcactcctttcacccacagtgtattatttctaccatggactcctcaaaaatatcggtccccttttacttgtttgtctctgaccacaaacaagtaaaggttatctcaatcttaattcaatcttgaaaatattttctgggagcatttctagatctctactttagctatgctgacctgttctaccagagcaggaatgagattgagggtggtctgtgccataaccacttctgtactctatcttttgagaaactatgacattaaagggagtcacaaagtcacaaagacccatagacaagtttaaaccacagtcaccccaaataattttctgggtctatgtcatcctcccaggcccatctggcccatgttaaatgttgctagtaacaactactctacatggactttacatgaattactgcatttaaaaccccaagaggcattctccctatttacagtggagaaacaagaggctctgaggttaactaacttgtccaagtcccataaccagtaagcgacatcacttagatgtgaagccaggcagtctggcaccagagaccaaattcttagactctgctccactgcctccctggggaactgctcactgacaagctttgacaaatggtaccttcatcctttgttagtaaatgctaggcaaaagggtattaatttacagatcatgcctgtttcagttcattcttccaagatctgctatgcctccttggttgatatgtgtgtgtgtgtgtgtgtgtatatatatatataggctaattttaagaattcttctaaaacctataaaatataactggaatatgcaattcaaatgacacagcactagcagtgaactaatactctagtccctacattttttcaaacagaagatttcagaagctgtaaggtaaacagactcgcccattttaccgattttttagtgtgaattctgcatactgaattccttaagaaatacagaatgccatggtaagttcattttatgacagagctagcacagttgagttgctgcaaactggtattggacactcatcagttttttactgatcatttactgagtcccaactccatttctagttcagtggaacgatgactgtttcaaatctctctcgtaaatatactccagtgggttttcgagagatgacagataaatgacagctttgcatttccaagggttaaatgcttttcctgagggatcctaagtcttggtgccatgagaacaagtgtcaggctctaatggaattgttccatgataaataaactgccaggctgtatgacaagcagctttcagagtctttctatatagtataaacagcagaagttaatttgagtttcttaacaggacctttttcctttacaatataaaagtgccttgggatgaagcaattactctgatttaccatcttctccttggtagaatataaagatgcagcagagcctcacaaaggcagtaacttaaccaaatgagacccacttgcaaagtccctactatgctatttcaaagagctcccttcccggcagcagcacagggccgtcatcaatcacaggtgtctgcgatgagaaggatgctgactctcagggcttttcatgggagagccaataaactatttttcctccaacaaatgctcagttaaatttcattttcactttacagcaccagtttctgaacttcagctcctaggaattttaaaagctatctacacaatgagtcatattttataacatgcttatgttttaaccatgatgcccttccctgcaatccttgctgtggccactcaggctcatgggctggtgcctgaagtcagaagggagaagggtgtctgagtcctctcatccaatccccatacttcaggttggtcagtctcacggacccagaaagcccagagaccctcaacgttagccgtaaaaaaaggctcatgctcttcccgaatccaactcgacttctttttctcccaggactactaaggagataggctgtggttgaaatggggtttctgaaaaggactaagagtcaccttgaactactgctatccattgaactgaatcaacttacctgtgaggtagagaacaagccctaggctagaaagaagataaatggaaccgacttttcaaaaaggaagaattaaaaggagatgtatggccccaaatgcctcatgatagctaatcaccctgacaggccaaccatcacggttctccacggagacaacacaggtggaaaccaacagaataagctcactaatgtacctgagaggaaaggacaccctgtgtgaagagagaatgacctgttttggtacaggcagtttgtcagcttagctggaagtctcagcgggtcaagaggacacagaagagagaagtaagacaataaaaatatcagaatctggaagagaacacagagcagcccctgtggtcaccacaaaagcagaatcgggatgtgaggtcaggggctcggttccgcagtcagcagtggtcagatgcgcctcaatttccctcctccaaccttccctcacctcagtcttcacgccctttcctcctctctggggggagccctttctcctccccaggctaactctcccacctgggctctgaggcctatccccccaaccccaccttcccatagatgccactttctcgtgtttgctcttggtctcaattggcttttttgaatcagcaaataaacctggtcaaggcctctctgtatttagaaaaagagaatgataggccctccctgaccctctttcttgccattacaccttctcttatcagccacagttttctgcaaagctgtctatacttgctgtctctctccaattcctggtttccctaaacatgcaatctggttctcctgttcacggccaggcttcaacttcctcatggggcaatccgtggatgcttttcactcccctatctccccttggctagcactgcccttcagaggtctccttccctggccctctggtaccatgagattgtggtctccctcttgtctctttggctgctcctcagtctgcttgccatttttccctcctgtgacactccaggctctgtgcaaaacctggtctcttctcaagtgacagtctttatgggagatgtcattcattccttgctttcaggtgccatctttatgttgatgttgtacaactctccaagactcactcaaatctctcttctcagctaccaattatccaactccctatgtggccttctcaagtcaggtttctcatagacagcctgcatgtccagacttagctcaccaccacaccgaccccaaccccagcctctacttgttgcctgtgtcagcagaccgcagcactacccacctagttgcctgagtcagaaacctgggcatcatctggactgtgtgatttcccatgccccccatatccaatcaaccctctctagacctgtcaactctactacctgaagactgctcatacttgtccaactctctccttctgcactgccaactccttggcccaggccaccatgggctcccttccagccccctgcagagcctcctaaaatgtatctcccggctgctcttcctaccccagcccattcgctcctaccccagcccaatcgttcctcccccgtcaagccagggtggtgtttctttaaaaaagagcagtttggtcatgccactgccctgccctcaggatagcatctcaatctggtagccctgctcatctgctcaaggtcagctcccaatcttcccagtttctatgttatggctccttcctgtgccttgaacacctctgctgtccacctgccctcttcctcctgatcctgaaggtctcactttagtgatttttccctcttgggaacattcccagactcccctcaccaaatcccggggccctatataagtcgtacgtagaaccctccactctccccgataatggcacttcttatgctaattatctgaatcctttattaaaccataccataagaagaaagtctacatctagtttctatcaaactgtatcctcagcacatagaagagtgcctggcactctaattcctggtttcctgaaacacgcaacctggttctccttttacacactggcacagagtgggcactgaataaaacagtataagatacattaaaaatatgtggtaaatgaacgtttgtttcatgctttttccttccttttcaaaatttaggctgtatgcatatcaccatttgaacacacagaactaaaccccattcagatcctgagtcctacattttatttatggttatagaatttagtaatagtgggaatcataataacagtaatattgagcaactgcctggtgctggaaagcttgtaaagaaagtttatatttgttattttatttacccctcaacaaacctccttatttatacaaaacacaaacttttaataaaaggatataaatctaaaaatgatacaagatctgtgccataaacattattatgctcattttatagataaaggcctttcatcaatgaaaaaagtggggcttagaaaatttaaacagtttgcaaaagtcacacaataagtattagaatcgggattctaagttgcatggaaactgtggatattaaaaacaatttaagttctaaaaagtttatgcttttcaatttaaaaaatattatttaatgctcattatacacaaagtaccagctacacaggacaaaaaatgtctgtgaccacaacttccacacaagtactgcggaggacatttctgtaacttcctttggtgaaaactctgtagtcaatcaagcttgactcagaggaagacattaagaattatgaattatttgaattccacagttctataattcattctgtgctagtgacactaaagacgattaattctaaatatccatataacaatgtcagaaaaccaaggggtcttcctatagctgtggcatcactcacaagttcccaatttcagttagacacctaatctatcatacaaatattttacttgattccctagaacattaggaatgttatatatcatggggctgcctaagcatgataattatcacaaatctttaagaaatgttgcaaagaggacatgaagtctactctaacaatgtgtttgtttcctcttaccttaaaatgtttccctttttttcttttcctcccttccccacttttttttcgggggagacagagtctcactctatccccccggctggagtgcagtggtgtgatctcggctcactgtgacctccgccttccgggttcaagagattctcatgtctcagcctcccaagtagctgggattacaggcatgcgccaccatgcctggccaattttttttatttttagtagagatggggttttgccatgttagccaggctggtcttgaactcctgaccacaagtgatccgcctgccttggcctcccaaagtgctaagattacaggcatgagccactgcgcctggccctgtctctttttatgtttcccatatacacccacatacaacacagcaagtccaatgccacaggcaatacaggcagctagctctgtgatatggagataaatttattaatgtgaagagagcccatgaagacggctcttcttcctcgaaacactgcacagaacaacagacaagctagggtaggtggggttgggcatttagttgtatacacaggaagagatagggggagacacttcacatttctccccatccttgatctctgccaactcaacatcaattagtcctctgccgagttagcaggcctccattctgtgggcctccatctgggtttcccagctgtctgggccctttggggtctccatccactggacttcagagaacacacctctcagcttagctgagaacaagccctggctccccgtaagcactcaattaccatttgtagaatggatggatgaataagtatctggtgttccttctcactgaagccctcccttcactgagccagtaaggataaacaatacgtgagatttgcctggtcttccaggacagttaagcgcatactataatacataaagctgcttcaggtacattctggaagcagcagcctcaaggagtagatcaagctagcttttaccaaattttgtttatgactggcacaaagaaacatggaagtgtcaacattgtccttttggaattaaaattctacatgcattaacagaagatactacataatttctgggaaacatactagaaaattactaaacttgaagatgtcttcaacaagaagcaaatgattccagatcatcttagaattacagaagagggagaaacagcaaggcctcccattaaacaagaagaatacttcctatcactgaacgcatagtttccaaggagccccctctacctccaaagatattaacattgtgccagaaatgagaagattcagctaaggtccaagcagagacaagtcaggactctgtgccttaccccctcatctcaagcagggttaagaaaccaatccatacattgtgatcagtggttggcaatgttaaagtgctctgccaaggtaaaatatcatcaatacctaaatgaaagacgactaacatagccaccattcagaaagaaacactatttctccatctcagacaggtggcctgggtaggctgtcattaaacactgacttcgaaccagcaatagcatatttaggaatatactattcatatttagaatttcactacagaggccgggcacggtggctcatgcctgtaatcccagcactttgggaggccgaggcgggcggatcacgaggtcaggagattgagaccatcctggctaacacggtgaaaccctgactctactaagaacaccaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcaagactccgtctcaaaaaaaaaaaaaaaaaaaaaaaaagaatttcactacagaattatttataattataaaacaggccgggcagggtggctcatgcttgtaatcccagcactttgggaggctaaggcgggtggatcacctgaggtcgggagttcgagatggatcacctgaggtcaggagttcaagatcagcctgaccaacatggagaaaccccgtctctactaacaaaaaaaatacaaaattagccgggcatggtggcgaacgcctgtaatcccagctactcgggagtctgaggcaggagaattgcctgaacccaggaggcggaggttgcggtgagccaagatcatgccactgcactccagcctgggcaacaagagtgaaactccgtctcaaaaataataataattattattattattataaaacaaaaataattgtaaaaccaatgaaatatccattcttaggagactggttagtaaattatagcacttcgtacaatagaagactgtagacattgcactggatggagtggatttaaatgtatagatatggggaatatccaagatacaaatattaagtgaaaagaataatttgtagaaaagcatggattatataatctcttgtacataaaatgtgtgtgcatttatagacacatgaaaattttaaaatagttatcttgaggtgaaggatagagtggtgaggagtggggaagaatttatattcttctgctttagttgggggttttactgcaaatattactttttaaatacaaagcattatgttttaaaaatatcgacagtgtaagttttaatttgttctttccctttaaactatctataaacatgaaaaatgtaaaattaaggtagtaactatcaaatacagcacaggattatgtgctacactataccaggatcctggctttccctaccaggctaggcctattttcttcattcttcttccttcctaaccaaccccttccttcctcactccccaaaaatgaactagaccattcagtagctctcctatacaccaacagccaccaagcagacagtcaaatcaggaactcaacctcttttacaatagctgcaaaaaaaaagtaaaatacttaggaatatacctaaccaaggaggctaaagacctctacaaggaaaactacaaaacactgctgaaagaaatcacagatgacacaaacaaatggaaacacatcccatgctcatggatgggtagcatcaatattgttaaaatgaccatactgccaaaagcaatttacaaattcaacgcaatccccatcaaaataccaccatcattcttcacagaattagaaaaaaaattctaaaattcatatggaaccaaaaaagagcccacatagccaaagcaagactaagtaaaaagaacaaatctggaggcatcacactacctgatttcaaactatactataaggccgtagtcaccaaaacagcatggtactggtataaaaataggcacatagaccaatggaacagaatagagaacccagaaataaacccaaatacttacagccaactgatcttcaacaaagcaaacaaaaacataaaatggggaaaagacccccttttcaacaagtggtgctgggataactggctagccagatgtaggagaatgaaactggatcctcatctctcgccttatacaaaaatcaactcaagatggattaaggacttaaatctaagacctgaaactataaaaattctagaagacaacattggaaaaacccttctagacattggcttaggcaaggatttcatgaacaagaacccaaaagcaaatgcaataaaaacagtgataaacagctgggacttaattaaactaaagagcttttgcacggcaaaaggaacagtcggcacagtaaacagacaacccacagagtgggagaaaatcttcacagtctatacatctgacaaaggattaatatctagaatctacaacaaacaaacaaatcagtgagaaaaaaacaaacaatcccataaaaaagtgggctaaggacatgaatagacaattctcaaaagatgttatacaaatggccaacaaacatatgaaaaaatgctcaacatcactaatgatcagggaaatgcaaatcaaaaccacaatgtgatgctaccttactcctgcaagaatggccataatcaaaaaatcaaaaaacagtagatgttggcatggatgtggtgatcagggaacacttccacactgctggtaggaatgtaaactggtacagccactatagaaaacagtgtggagattccttaaataactaaaagtagagctactatttgatcctgcaatcccactactgggtatctacccagaggaaaagaagtcgttatacgaaaaagatacttgcacatgcatgtttatagcagcacaattcacaactgcaaaatcgtggaaccaacccaaatgtccatcaatcaacaagtggataaagaaactgtgattgatatatataaataaatatatatataaatatatatatatataatggaatactactcagccataaaaaggaatgaattaacgacatttgcagtgacctggataagactggggattattgttctaagtgaagtaactcaggaatggaaaatcaaacaccatatgttctcacagatatgtgggagctaagctgtgaggacaaaaaggcataagaatgatacaatggactttggggacttggggggaagggtgggagggtggcaagggataaaagactacaaatagggtactgtgtatactgctcaggtgatgagtacacaaaatctcacaaatcaccactaaagaactgactcatgtaaccaaacaccacctgtaccccaataacctatggaaaaataaaaacaaataaacagagaaaaaaagtgaactagaccaatgtttccacaaacctatcctataggctttaatcccaaccaaactccaggttgattaaggacattccaagtctcaaagtaattcctctgtactcaggcaggcgaaaaacaaaaacaagctcactgtatctattctgatagcacctaatttgcatctgctccagaataatggtggtctctgataaataagctgcattattccccaggatacctcagaagatagcaggtcttctgacaccaggcctgggggcttctctttataaactcaacttgtctccttccaagagatacaggacctccagactgaacttgcagactgaacttgggtaccaaggcttctagaactttttaatttatagatagataacaatttacggaactgccaaggccttccaggaagtctgaattctactctcctggctacagatttactaaccgtctattcctcttccttattcatccccctaaccacatctctcctacctttaaaatttcatcagtactcttctcagtttttgcataaaactgtatcctttactcctatctagttaaactttgctgtttgataaacaagttattatttcttcccaagtaagtatgtaataaaattagaactttagataaaaatgtgttccctgttcacaaatatttacattttaagcagtttttttctgactagtatttaccagtcttacatagcaaggaaatcatcattaataaatgtaacaccatttcttaatattaatgttaagcatattatattttcttaaacattaaaggttgttaactaatagtatctcattactttactatgaaaacattggtaattctgcaaattcactgtccatttacaatccatgtgaattattttagcaggcacattaaattcacaaaagaatgataaatatctgaaaactgcatatcctcattaatcatcaaggaaatacaaaccaaatcaaggtgaaaccatttttacctgcaaagttgaaacagtttttttcaattagttggaaaggtaatattcaataccagtgacagtggtattaggtgacagtggtgtctcccaggcagcttgaggaagtgtaaatcagaagaaacttcctaaaaacaattttgtattttgtagaacattttcagaatctttaaaaagaacactttacttcgataatgtcctcctaggaatctgaccaaagaaaactgtcagaaatgctcagatttatgtgtatgaatttccatcagagaattgtatgtaagaggggcaaactagaagaaacctaacatgtaataatcagaaaataattaaaacattatgtagctattaatactcatgtacctcaataatatttaatgacacaggaaaggctcataatgtaatgttaaatgggaaaaatcacataataatataaaatgtttacattatataaatggatagtgtgcatatacatatatatatgaatatatccataaaataaaatctaaaagaccactaagatgttaacagtggctattcttgagacacagaagaaataaaattttatttttccattttctgttcttactatttttgaatgttttatattaaacatttattattccttatacctattaggatggctactctcaaaaaacagaaaataacaagcattggtgaggatgtggagatattgcaaagaaacccttgagcactgctgatggaaatacaaagtgggcacaactactgtgcaaaacagcatgggaggttcctcaaaaaattaaaagtagaattataatatgattcaataatcctccttctgggtatatatccaaaagaactgagagcggggtcttggagagatatctacacccccacgtccacagcagcataacgcacagtaaccaagagggggaaacaactcaagcgtttatcagtggatgaacagatttttaaagtgtgcacactcatagaatggaatattattcaaccttaagaagaaagaaaatcctaatatgtggtcaatgtgacaggctgaactatgtcccctcaaaagccatatgttgaagccctaacctccagtatctactgtatttggagacagggtccctaaagaggtgtttaagttaaaattgggtcattagggtgggccctaacccaatctgactggtgtccttataagaggaggaaactgagacagacatagaggggcaacagggatgcttgggcagaggagaaaggtcacatgaaaaggcagcaagaggccatctgcagccagggacagaggcctcagagaaaactggccaccaccttgatcatggaattccagcctccagaatggtgagaagataagtttctgctgtctaagccacccggtcggtggcattttgtgagggcatccctagcaactaacgcatacaacacggatgggccttcaggatatgatgctgagtgaaataagccagtcacaaagagataaatgctgtgtgattccactggcaagaggaacctagggtagtcaaattcattgagacagaaagtagaaggacggccactaggggatgcagggagtgggaaaacagcatttgttgtttaatagatataatttcagttttgcaaaatgaagagagattggttgcacaacaatatgaatgtgcttaacgctactgaactatatacttaaaagtaactggttgggcacagtggctcatgcctgtaatctgagaactttgggagaccaaggcaggtagactgcttgagcctgggagtttcagaccagcctgagcaacatggcgaaacgctgactctactaaaaatacagaataattagccaggcatggtggtatgtgcctgtagtcccagctactcagtaggctgaggtgggaagatcacctgagcctgagtggtcgaggctgcagtgagctgagatcatgccactgcacgccatcctgggcgagagagcaagactgtctcaaaataataataataataataataataataataatgataagatgataaacttcttgttatatatatttaccacaattttttaaaagtagacttgagccttaaaaattgtttcacaatgatacatgttgacacatttcattaatatttcagataaaacaccatgtaattttcctcactagctatcagtagcaaaatgacagtattctagaagtttacctcaattttacaataagatttgtcattagggagttgcaaaataaaacaacgagataccgctacacacctattgtgatggctaaaatccaaaaagctaatgtacagcttttgggaaagatgcagagctggctggaatataagcagctggatatggcggcttaggaagatagtttggcaagttcttagaaactaaacatagtcccaccatgcaatccagcaatcaagctcctagatatctacccaattaatctgaaaatgtacgtccatataaaaatctacatgcaaatgtttatagagatttattcataatcaccaaaatctgaaagcaatcaagatgcacttcaatagatgaaccattggtggtatatccataatggaatattattcagcaatgaaaagaaatgaggtatcaagtcacaaaaatacacagatgaatcctaaatgcatattgttaaatgaaagaggccaccctgtaaagctacatattggatgattccaattatacgacatgctgagaaaagctaaatatagagtagtttccaggttggggacaggaaggtagagaaggttgaatgtagagtacaggagattttttagggcagtgaaactattctgtatgatactgtaatgatgaatacaagaaattaagcattggtcaaaattcatagaactttataaacacaaagagtaaaccttaaatctcattcaggagattagggaaatcccaggaagaaaagcagaatgagattatacatatgcattttaaatgtattttaaaaacctcacttaacagtatgaggaaataaaatcctgacccaaataataactttagaaataagtggagtctgtaaaaaaaagacaaaaggaacttcatataaatatcatactctagttgataaagctgtttcccgatggaagtacaggatgataatgctgaaactgctatacatgcatactggaattaaagatgtaagtaaatagatggtgaataatggaaccaagatttctcaatgttgaagtgggtgggattacacatatgcaacggaaggaagttagaatgatccatgtgataaatggattagagctggagacatcaggatgaactcagtagcatatgtattagcttactatagatatagagggttacatatagaaatgtatacatacacacagagagattagtatacacacatgtatttccttgccctgtagctgagtgaccctacacccagtagcaatgagtacacctagcatcctgatcttcatttctaatagaaccagggccacttggaaaaatggctgattctaggactggggcaaaaaatatacaaaataggtctgaggcaccttgtagtgcagaaagcaagaaaatgctcacaacaacaataacacaataatgggtatgtatcaaagggttacaggaggcaattgaaagagtttccagtggctaaagccagagtaatttgagcaacacaataaagtagtattggcttatcacctgaagtataaaacaaatatccatgagtccacacggtaaataaataaatggggaatagctgaatcacccatgtggaagaattccaaataatttatgtagatattccaagcttaaggaggtgaagcatagcgctgcactctttaagaattacagctatatgcaacaacatcaatctcacaaacataatattgagtgttacatattgaaagtatgtcatattgaaagaagcaacacagagaagaatacctactatataactctgtgtctataatgtaccaaacaagtagacttatagtcttggaattcagcatatagttacctctagagaaaagggaaagggtaatgattagaagtatgcctgagagaggccaggtatggtggctcacgcctgtaatcctagcactttgggtgggacaaggcaggtggattacgaggtcaggagatcaagaccatcccagccaacatggtgaaaccccgtctctactaaaaatacaaaacaaattagccaggtgtggtggcgggcacctgtagtcccagctactcaggaggctgaggcaggaaaatcacttgaacccaggaggcggaggctgcagtgagccgagactgcgccactgcactacagcctgggcaacagagtgagactctgtctcaaaaaaaaaaaaagtatgcccaagagagattctgggattctagctgtgctctgttaaacttgatcactgatctaagttctgtcgaagttctcaaagttataaccaattcaatgaattgtgtacctcacactgtatacaaaccaacttcagttcagaaaaagaaaatatgaacttaattttgatgtaatgaagatatctagtacaatttttttcacatggtgatccaattgacccactaatggttaaacagatcattattttcccactgctccgcggtgccaatttttgtcaaaagttatgtcttcatatatgcttggttctgttcctggactgacttttcaattccatgtgtatatttgcctatccctgcatcaacactgtgtgtcttaattactataaatttatagcttacttatctacctatttactataagtaataagaaaaattatttattataagtaatgagtaattaccataagtagtaagtaataattactatagatttaagtcttgatgtcagtagagtaagtccaacaaccttattctttttcaagattggcttgttatgccttatcctctgtacttttcatacatgttttggaatcagcttgccaatttccacatacaattttgtacacaactgttggaaactagtttgggagcaagtacgtcacatccttgcatatgccatacccatatttccttccttgccaaatctggaagcatggagatggagtttctctttgcctgagtccctgagtgaggccaatgttgcaaagagccttcacccccatcaacacattacaaacatacagggttagcaagaaataaacctcattattaaaaaaaattaaattatatggccctaaaactttaggtaagaggaagcattaaaagagaaagatttgagattaactgtggatttattttaaatatctgagctatgataagcttatatgcacacatacactcataaacacaaatgtgggatacgtgaatcgttacttctatatgaaacatctgagttacttgcaactctctgaaattaactcaaaccatttaccagatggtaaattctggagataaatttaaaatatgcaaaacaatgctatctgacatttctatgaaacacagagtacctaattgtaacttaacattttaattttgggaagaggaaacaatatagaatttttatttctaatattagctttgaatgataatcaattctgatttgcaaaacggtctatgttttgttaacaaatcagcatttcccacttgctgtttttattggacaataaaagccatatgggctaagaattcatcacgattaataaaaaagatgcaaattcttataatacaatgttccacataactttataagaacctctgcaacagcttttgtgtatatcaaattaaaatttactatataataaaattatgtagtaataattttcaacctctaactaaagtcatatgattcttcaacatttatccactgctacaccacagtacataaatcatgcaggctaattctcacaatacatattatatagggcacagaattattttgatttaattctcaataagaaccgaagcagtaacttgttattttagactggcaaatcaatagcaaatgcttgttctaagattggttatcactccagtcatgcaagtagcttaaaaactgacatattagcattgacaaaaggattgctctatttgttttccaaaggctttcccgcatgactctatacttagttttatgccaaagaaaatcaatctctttattcaacttgtcaatcagaaaacacatgtagaaacaattattttattgcaacacataaaagtacactgaatcatataggatgaaatagaaataaaatgccaaagtattaacatgcctgtaaacagaattaagacttaaatgcaaaaataaaattaaatatagaaattaaacctaaaggataaaaatcagttgaatagacttactccaatcctcagttttcaaatacaccaatctcttttcatttcagaattttaaaaactcattagaaggactagcttcttccaacacaatggaagtccataaaaacctaattttccctttttttttttaatctgcaaaaactaagctttctagacagatgataatgctggcacatttatatcagaatatcaatgaagaaaacatttctctttacaacaaggattttgagtgattctaaattacactttacataacaaagaaccaagaaatacagatgcctggcttttgatctagtgcctataaaaagagccccagaaaggtctacatggaataccaaggtagaaagcaacataatacacaagatctaatgatcacctaagttcccccggttccatcaaggtcactcaagttcacatgcatgaagtattcaatgtcattcacattaactgcctcatgtaaattttcctttgttttaatggatgagtattgtagggcctggttgtaaaatatgaagtctgacctaggaaaggagtcaaatctttgtcccagtgtccattcccctggggatcctcatgtccccagacttcagctccctgtatcctcaaggccaccaaggaggcagcacaccacttcacaccaccacatcataaacaatacacctgtccaaccatggctctctctgctatggctacaatcaactgcctccatttaaattttagtctctgggcacctgtggaatcacacagatgcacaaagtggcacatgctttgaagacgctcaggccaagacataacctcactttacaccaactctgtcaaaacaaggctgcttatgaagcatatttcactcaagtattagcatcctacatggagccttttattatgctaaagaaatcgtcactgacttagacaacacttgtccctatccaagaatactgttggtgtgcaaggagcttccaagggtgaatagatcacatttactcaacaggagtaagcagacatcccaatgatgaacaaaaatgattgctgcagactatgatgactaaggaagaccatcaaattcttatagctgaagcaacctactaacttttttgatcagccttagcgaagaagcacatgggagcagacaccacaaagtatggtgtagcagaaagagcattacttggagtccacaatacgggctttatttccagctctgccttttagtttacttaagcatttgaagagcaaaaaccttcttttcatctatatatcctcagtacctagcagtgtttgcaaaactgtgaaccctcgatgagtatttgttcaatgaaagaacaagagaatatataggatgtatgtgatcttaagcacttaacatctttgggtttaagtttccaaatctttaaaaatggggacatagtaaggcaatgcatgccttttacactgggttgctgaaagaaccaagcaaactagcagatatgaaagttatctgttaatcataaagtctgttacaatagtacactgcaagtaaagaagcattctttgaattgggggtggtggaagcaatgaggctacttcaaggaatatggccttgaaaagcccagatttctcctctgtcccttgaatcctttaatctacctcttggcttaaaagggtgttcaactcactgagagagaaaattgatatggttctaatcaaaaccaaaaatgtgtgccaagttctgaaaaatacagtgctaaaaaaaaaaaaaaaaaaaaaaaaaacaactttctcaaagtctttcctggcaacagtcaccctcatgaatttccccactaacacaatggcaccaccctgctcacaatgtgccagccctttcccagccaccccaggtccttctacttaataatcctagcattgcccacacgttaccctagcacccattagtatcctaccaacttttctaaaacctaacttcatataattacaaatccatgaagaaaagtgggcgcttcaatcaacttacttttagatttcagaataacaggtaaaatatttgggaaaaaatacattttattcctaccttgcatttaaaaaaatgaattccaataaattaaagaataattatttttaaatgaagccattaaaaaacaagaaagaaaggcaggggctggcatttcttaatcattaaagcaatgagagagaatgtaaaaaaaatggacatatttgatcatgcaatcatatacacataaccacaaagttacaaaattaaagataaactaggaaaaagatatgtgacatataagagaaggggcagtagtctcatgatatatataaagagctcttacaaatgaaaatggttgaaaatcagagaaatatgagttgggacatgaggtgggggtgaagagggagagaaagtagtcaaacaagtacaaaagcagcagcctactccaaacagaaaaaaaaaaaaagaaaagaaaaaaacaaaaacaaataaggaaataccatttttacctaccaaataggcaaagaactaaaaagtgtaaccctcaataacctacagacagctgtgcagagcggcaggaggtctcatgcgctcctggtgacagccaaacaggtaaaatccttctggagggaaacttggcaatatatcaaaagcgttctgaaagctcacgtcctctaatcagtaattctattgttaaaaactgttactaagaaaattaacagcaatgtgtgcaatgatttctgcacaagaatgttcaccatagcacatgttcatgtaacagccaaaatattagaagaaaaaaatctcaaggtccaagaataaacaagttatggtatatttatgtaatgtagtttacaaatgtgttttcaagaaaaatatggtatttaataatagatgtttacaatactagtgaaaatgtaagattcaaaactatacagggtatgatctgaacatgtgtgaaaggcccaaataggaatacacatattttatacatacatgtatggggggtatatttatttcatatatatttatttatttatatataaatatatatttatattttatatattatttatatataaatatatatttatattttatatattatttatatataaatatatatttatattttatatattatttatatataaatatatatttatattttatatattatttatatataaatatatatttatattttatatattatttatatataaatatatatttatattttatatattatttatatataaatatatatttatattttatatattatttatatataaatatatatttatattttatatattatatatttatatattatatatatttatattaatttgtgtataatatatattattaaatataataaatatatttatttttatatattatataaaaatatataatatataaaatatataaaaattaatctatatctatttacaaataaacatatataatatataaatatatgtgggtgtgtatatatatatatcagcgagaaggtcaaggacagtagtctcaacttcaaccttgagtgtttttgtgtttttaattttgttttggaattattggatttggatctctgcagactctgaaatgacgatgggtaaaagaaaacttttcaaggtcaattattatttcaaattagaaaactctaggctttatttctttgtacctgggaagtcctcatcaagccattaagggaagaggagagggtgaagacactgcagccatcagtcccctgcaatgaagtctaagacagaaggatctgcaggagacgcccaaggacacctcagctgggctggcacatctaagccccgcccgcttccccaccactctaagcgctaaagtcgctgtctggtcttactcccgcagattaaaaccacatgagccacctggaccccaaccccattcactttgggattccagccttccagcaacaatcaagttgtcttatattttcctcaaattaaaaaaaaaaaagggctcatttataaaaaagagaagggctgctctgatcaaaaagtgttttacagaaagacaaagagtaaacaatctcaaccattttgtgagctaataacacaaagagagctttgattttatttctcatatattttataaacacaggagagggtgggtaaaagacatcatgtggcttgcagttgaggggacagaggctgggcacgggtccaaaatctccccatgatgttacctgtgacacatacatgcacaaaaagtctgccacataacgaagcatttaaataatttaatttgtatctaagggtcatgggactatgcagcatatttattttcttcttcttcttcttttttttttttttagacagagcctcgctcttgttgcccaggctggagtgcaatggcgttatctcagctcactgcaacctccgccaccgggttcaagcgattctcctgcctcagcctcccaagtagctgggattacaggtgcccacgaccacgcccggctaattttttgtatttttagtagagacggggtttcaccatgttggccaggctggtcttgaactcctgacatcaggtgatccacctgccttggcctcccaaagtgctgagactacaggtgtgacccaccatgcccagcctattttcttctttatagtttttctacttttgaatttttctgaaattaattgttttacttttataatgagaaaaaggtcagcagtgtctaaaatttttgtagttaagtgaaataccaacttcactatatctctttcatcctcaaaaatctacaatggcttccccaatagctatcttatcgaattcacagtccttcaagtgttttctaccagacctgatgtccagaattttggcataacataaaaggtccccttgggcagcgcacagtggctctggcctatagactcagggctttaggagacctagacaggaggattgcttgagcctaggtggtcgagatcaacctgggcaacacagtgagaccccatctttacaaaaattaaaaaactagccaggtgtggtggcttgtgcctctagtgtctgctacttgcgaggctgaggcaagaagatcacttgagcccaggagtcaaggctgcaatgagctatgatggcaccactgcactctagcctggaaggcaaagggagaactcctctctaaaaaaaaacaaaaaggccctcccccatggccaatgacctagcctgtctcccttattagctctacccgttaatcttctgcgtgggtccatattcttgatgtccgggctggctccctaatgggtcatgttcctttacatccatatgccttcgctcactttctaactttgtttgaacttcctcttctccccaccacatcccacttactggctggctctggtgaaagttcccctcctcttggaaacagtccctgaggtgattgcctgtcgcttcctccttgttccaggcaccttgtgctcacattcagtacagactaattttccattgttctctctaggacaggaactcctctttgctgtccccagcacagagctcaatgactagcctcagtggataaatgtctgtcaaattgtgttttcatcttaatcattctttcttataaatttccaatgcagattcactacctcagccttgcaatcatctgcctcagcattaagaaggactgcaaaacccagtaacagcatgtgccatgcttcctcactggaatttcatcaacctaaatgacccatacctttgcccccttttcacgaccctccacgctcttgtcacaagaagcctcccctcccagtgttattaagtaatatgacgattattgcttacaacctaccctgttagactgcaatctccttcatgaaagaaaatgtgacatattatctggaattccatctctcctgagtccctatacagtgttccacccaaagaaagacctccaacccaatgactgcagcactactttgctccaggaaagagttccaaccagctgagatacaattattttactaatttggccaatatacatcattgagtttcaaacattccaaatgttcctggagaccatcctcttctcagttaagaggcagagggaaaacaagatcatgaatcccttttctaatcatgagcaataagagaaacaaaaatgtcctggttttatcagttacatcagaggaccaccatgaatccctgatgagagcaggatgttgaaggagcgaccagggctgatgtcaggtcgcctgcctatgagagcaaggcagaaccagggctctggcacacctgctttgttcccctgctaccgacaggcttgctatttctttcaaagattttctcatggaccatcacaagtgaaagcagtgttagaaaacagcttcagggcttggggaggcagcgttgttttagactggctggaaagtcatgctgagcagcaagaggacagatctcttttagaggagacagccccacctggctgcaccctccaaggaggccacagggcatatcatccaggtgggtcaggtggcactggggctcacagtcaagccatcatcaggttactgcctctgtttcatcactgtgaaagttaagccatgatccaggtctctgggtcttcctgagcaagtcaatgcagagccaaagcctgtgcacaaatgaataacctcacaaggatgagagctgtgtgtgattgatggctctacacaaaccatctcagcaaaggagttcagtaagagccttgtgagcatatgacactctccagctctactaaagtgatagatgggttcacacggaagctactaaatgggcctcattgcaaaggcatggcttcaaccatagctggacttcagggagcacagtgttttcaacatataccttggaaaattcctcactcataagtaaagattacatatgcaggggcccagtgaatgcttgcctaaaagacagtgtaatgctaagcaaaatagtctgttaataggaaaagaaatatcatgattttaattctggagtgctaagtcgcctaatcttcaatgttctgtgttcagatgacaggcaggaagctgagctagagtttatgcttgtccaattaatcaaataacctccatgccacttatccttggaactggcattagaaaagcccccacgtgcccccaaatcatataaatttcacagtttcctagtcattaaatccaggttggcctaatgctgacgtgtcatattttgacatgtagccacaggggatatacagtcaaaattaagaggagaccctgagctaaaactggcatgccctactcggaggaacaatttatgcccacacatagataaaactgcatgtatcttctccaaatgatgaatattaaactgttagaaacatagggagatataattcattgactcattttgcataaaacatttcttttagctttcaaccaaacatatagaagggatatttgcatcatcacaagtacacaggctattattacatgtaattacatgcagactttcaatactactatcacaatggtatttattgaataaacctgcagcattaataaaatcatattttccctggctttaaaccctacatggcttccccatgcacttactataaacgtttatccaacccctcacatcgcctccaaggctctctgagcccatctctaccacccccacaccatcccaacctctccagcccccggcccggccccaccatcactcattctgccctgccacactggccttcttcctttgttctttgtctcttgaacaagctaagagaaaggcccttgtccccgctgttttctttgtttgaaaggctttctcccgaaacctccgtgcagtagttaactctccgatctcaggtcaaatgtcaccccacagagggccctccgcagccaccccagcgagtgctgcctttcacctgcaatcaccattatgcgccccgcactcacttcattttctctagagcataagtatattccaatctgaaatatattgttttttttctgattatccggaccacaaatatataagctccaataagaaagtagtttgcttccactacagggtctagaactgtgtctgacacacaatagatccaccacaagcatttgttacacagatgaatgctgtgctagaaggtggataaagcaagttacagacatggcagcctacccactgggtgctaatgattgagaaacaagtggacaaatagccaagaaacacagaaaaaaaaatttagcagctgcatacttaattatgattaagtaatcaaagttagttgaacatatcaaacgtgaataaattattaagtcaagacatgtcatatggaaatgctaatgacctaggctgggaaagctctctgaggtttgagaatgaggaactttatgaagtttctaacatggtccctgctatggcacctaactgcctagaacatcagagttgcttaataaatactgctgaattttgcaattcttaaactaagaaaatgttaaaatattattttagctttcttagtgaatatttttaaagaccacttgtctataattcgtactgatgtttttctcggcataaataccagatatatgagtatgaaacttaaatagtagaaaaatcatccatggatgcaggtaagacacaacccagaagaatttttttttttttaaacacagagaatttttttttagcctgacaaatttcaaagaggctttgcaagtgcaaacagacttcagctttttcacattcctatgcccagaaactgggacgtgaaaatgccaggaaccctttcaataactagactatgtgatagatgcaggagaaactctccaaccaccaagattactcctatggagctgccaaagaaccagatgcttccttcaaaagcatatcaatttggcggtgaaaaaccctgtggcctcagctccagtcgggaagggcaggtgggatggcatggtgcaggatgcctgttcccacttgcctcagcaaccatcttcttctgacagcaaaactgtgttactcccaggcttgaaggcatgagcaaaatacatggctttgctatatataaggacgggacttggaaatatttggtctgaggccatgcaaaatgaattccatacatggggagactgtaatatcgaaaaagatgaaaatagtttcactgcacttgaaatttttatcttcaaagaaattgaacatagatgaaggaaaaaatagctgcatttaaaaaaaaagtttcataatgcaggacgttagaaaataaaactttttttaaccaatacatataacaaagagcaattgtttttatgactgccatctaccaaaccatcaactgtgaaatctttctctttaatcacgagtttttaaaggctctattcatgtgcatccattttcacaaactcttgtgaaactagcatgacctggcttgaaataataaacccaaagggtttctgttgtagttgttgttgaggcattagtgtttttatttttttaagaaagccaggacttcatttctgcatatgaagctcctcgtggtgttcatcctcacttaaatttgcagccaaaattattttttcagtctctttaaccctggtgggccccctgagagcatgtgtgttctgggcttttgtaattaggcagcttgcacctgagcgtctccatctctagtaattagagctcaccgcggcagtttccttcccagccgatctggccatggggccaggaatgaacacatggaggagtgatgagggtggtgtgcggctgtcttgacctcttctgcaccttaccctacttcaggatggcagggttctcagttacaccaggggtgcctgaaaggcaggacccgcatcctccattctaccctctcagcaccgagcaggatcccctctcgtggaaaacagctcaccccgtgtattcatgcacagctatgtattttgagggaagtggctctttctgttttcatctgtcactgtccactaagatacaaataaagagaaaacctctgcatctctaaatgaaaacactgaacgtattcagaatagctccgtttcacaacccccttccatctatctacccaagtcatagagtgcaatgaacctcaatgtctttttttcaagctgtttttcattctaaacacctaagttgactttcctgtcccactgcagtagccaacagctaaaaataaaatgaatttccctgggcaatatatagaaaggcatactctctcacttttttccttcgtgggctagacagatgcttgctggttcacttgccaataatgatcgacctggcactcgactgagccttcaaaacactaaacatatcaaaggccccaggttaacctctgagatttactttggagtaattaataggtttatagtccttaaaataatctatggatgtgccaaagaaaactgtacaacagtactgtccgtttagaggccccatcaaacatgggggatgtctgatggggcctcgaaatggacagtactatttctaaacctgggggatactccacagcagcctcgctgtccagcaagtcagaccatcacgtcaagcagacatgaagagagagatgggaacaagctagggggatgtggacaagacggcaatctgctttgggaagaagagcatcagcccacagcatcttttttaatctttccaacagaggctccaaagcacctcctcagcccaaccagcctccctgatgaaactcagggctgtggctggtcaggaagagaaatgaaaggaaggggagggggactggccatggcaacagaggtggggaaggggaggagggtgaggagctggccgttttccttatcaagtggtcagtggtagagaagacggtgaggtcactcagaagacaactgagctagggagcagctgagtgccgcagttactacccgccagcaacagtcgcatgttcaccggcgctcttttcttctcgttctgcctctaagaggcacagaaaacagacaagcaactgcagactaatgtacttcttaataagaacagcagctcccgtgactgcgttctcaccctatgtcagatactctgctaagaactgccttatgtcttcccctttaaggctatcaatgaatatttattattttaagtgagggctttcaaaaatacagttgatccttcaacaacatggattttaaaaactgcatgggtccacttattgtaggttttttttttttttgataaaagttacagcaaatgtgcctgcctctcctgcctccctttcccctccctccacctttcccacctctgccagtcctgagacagcaagcccaacccttcttcttcctcttcagccagtatactccacaggaagatggaaagaatgaagacctttatgatgacccacttccacttaatgaatagtaaacatattttctcttgcttatggttttcttaataacattttcttttctctagcttattgtaagaataatatctatcatatattaacagtacatataatacatgtaacatacaaaatgcatgttaatcaactgtttatgttatcagtaggggttccagtcaacattaagctattcatagttgagcctttgggaagtcaaaagttatatgtgaatttttgactgcatgagggttggcacctctaaccccagagctgttcaagggtcaacagcacacactcctgagttccaagaatagtctaccacttgctgatcacatgatctaaggcaagtaactcaaccttcaaaagaaaacctttcttgatctgtaaaacaggaataacagaattaacaatgcatgtaaggcatgtacttagctggtgcagacaatgattctgataacagctaatgtttacattatcctatacctactctatagtgctcacacacaaacagaatgaggcacaagagaggcccagtaatgtgtccagccccacagctagtcagcggtaacatcaggattccaacctataagtctggtaccagagtccatgttcttaaaccattaatctacgatgcctctcaagtaaatagtcaataagtggtaggtgtgaggctgtaggaaaaagaggagacgaagggacaggaaagcagtcctcattggaaaactaggtttcgactggcactgttggactgggctgcagtttaggtcctcccactgctgagttccctcacttcatctcctggtgcttctggtttcccatttataaaatgcaagggaaggattctatttatgtcacaaggtgcatctaaggagtaaaaagtcacgtcatgtttgaccaatgttagtcagatcaagatttattttagataaattatctgttagttttaattaccatgactcagtttttatgttcactttttggtcaaagctaaataaaatatataaatatataaaatctgggctccaaccagactcccacacactctcagccaggcatcttgagcaggtaccgtccctcttgtccaatggctgtgtaaaagtgagggcaggaatccgccttgacaaagaaagttcaaccgtctaaactcagtggatttgaaactatttcagaataggatttctcagaatgaaaacaaatctatgactcctcttaacagccaaaaaaaaaaaaatcttgaaataatgactttaagagtaagactttaaaaatacagatctacactttccactgtaacagccactaaccacatatggcatttaaatgtaaattaattaaaattaagttaaatgctaagctcagtttcttggtcccgacggccacgtggagccaatggcacccgtgctggatggctcggatctagggcctctccaccgtcgctgaaggcgctcttgagcagtgctgagccacatgctacgtggacaagtcaattttcctttaacatgtgcccaatgtactttatttaaaacactgaacttcttataatatttgtcactcctacattattccattatttatgtagtccttccctttgttccttggctctgtcatagtggtgacagaaggtgaatgcaattactgatttacttttctatctccccaaggagacggtgagttccagaactcggtaaatgctgagtcttacaattctcaaaggcacaacacagaccccgtccttattacattaccatcctacaccacgaggataaactccagacaatctgaatacaacttgaaaacatttttaattactcaaaaaataatccgtagtatatattctcaacaatttttttaaacaagatacagttggagtgattaaaatcttgagttaaaaaaagtcagcgattagctctaagccaatgtttaggcaatgcagtaatgcttaagttctttattcaaccattagtatactgatgaaattctctgtaaggagtaaaacatcatgtcctctgtgacaaattaagctacaaagctgtttcctctgttctctgctttctagcttgtattaactagtgccataaaagaaagcctttaagataatatttatttgcagaaacaaacactgattcaaggcacttagaagcacatatgtgcaatgaggggaacacttgagggaatcctaatattttatcatgtcctggatattactgccgttgtacctgcatatctccatactcatcccactctcgatatttcatgtcaagctctactcccaaccaaagacgttctggtgttatacctgcagattacccacaataatggcaccagtaaatatcacgtctcaccctttgtcagaactgtctaagattacataaacatgacatattttaagaaggaatgcatccctgttgtttacaatgtaacaaagataatgccgtgacaaatatcctaagctataaataaagacatttaccattgtactgcacttactcatctctgggttgaacaaatgttaattatagagaatttgaaaatgggacttgttaatgccatttttaatttagcatgttacagtgtaaatgttttccattgtgttaatttacacctgttatcacaagcttcattattaggtttatagtggagcagctctccgtgactctgaaatttgcttaaaatggcagaaacaattactaattagaagggcatgtttactttaattatatttatttcctagtctagttttacatgtaatgtactatggaagtgtatgatttaattagtgaaacccatttatgaagagcaatttctcaaatgagtactgcttacaaaatacaacagattctttcagtgtttcgtaaattccttgggtgatatttctacagagagatatccacatggaaatctttcactcatgagttcagagcatttcccgtttttgttccaaatactgcaataattaccagtaacaagaattcagctctagaaatttttaatgcaaatcttaatatatggtgtgcaaaatgtagaaatgtatgagtataatctttaaaaatctataaccaaaattaacatgggatttctttattgatgttcacgctcacaaatttcaaatcctattttatcaaatcctactgacagtcacactcacaaatttaaaaatcccaccttaatatataaaaagcaaattcggttttttaaaataaaaaagacatggcttttttcctctctgaagtcatttctctggcttccaaagcacaactgccttttgtttttgtcaaatattgaggcacagtaactaccaatgaaataaccaattcaggcaaagatcattctgcgaaagactacggggaatgggatattcacctggtctcaaaagatcaccccacaggctccttaatcacaaaaggaagaaagaaccttatagcacagagaaatctggtggccacagccttattcatgtgaccatacatcccaccaaagggatagtgtgacaccgtgtacttcctgtggtgccacaggggaaggccactctgtcttgatgggatattctcgcatcttataggaggaaacaattggaactgggggacattccgcaagacctagcctggacttttcaagatgctacatgtcacaaaagactttgaaaaagctggaagactattatagattcaaaatgaggctaatgagatgtgacaactaaacataatgtgtgatctctggctagatttcggactttagaaaataacggccataagaaaaattactaagacaattaaggaaatctgaatataaactgtgcactagatattattatattcaggttaaagtgtcctgagttacactagaaatgtttagggattaactgtagtgacctcaaagagtctttcaaatgttcagaaaacaaagtgagagctatcaagagaatgtggcagaatggctagtgaatgtgggtgatgagtattcgcccatctccatgacaccattttttaaacttttctatatacttgaaattttaaaaaatcacagttgggaaaatataaataatccaatgggcagagtgggaggtcaaactaggagtactcctcatacaacatcttacaccccaaacttcaagaaacattactgccctattctgaatgtaagctttctagcattaatgttaaacccattaaaatggcagttactcggccaggcgtagtggctcacgcctgtaatcccagcactttgagaggctgaggtggacaaaccacgaggtcaggagttcaagaccagcctggccaacatggtgaaaccctgtctctactaaaaatacaaaaattagccaggcatggtggcatgcgcctgtagtcccagctacttaggaggctgagacaagagaattgcttgaaccaggggtgagccgagatcacaccactgcactccagcctgggtgacagagcaagacttcatctcgggggggaaaaaaaggcagttatgcttgcaaatggcttcacggttgtctctcaaaatatttagtcacaacattcccatgaagcacattcttcacattgtcacataaacattcttatgttttattttactttttatttttgggatagggtcttgctctgtcacccaggctagagtgcagtggcacgatcatagctcactgaagtcttgatcatagctcactgccgtcttgcagttcaagactcctggatcgaatattcttgtttttagatcccagaaagaatccatgccacagagcagccaagatgtttcttgtataaagactcatgcatcttgccagcttaggtgagagttcctgtacttgctgtctagaaaagatgtaactgcagagtgtgtttcaattttaagatccttactataaggtccactacacagcactgtgcacaagtgtgcaaaaacacactttcttaaaggaaagtaaacgtcagtgcacgtaggattttgtctgaccgagagaaatccccaagcaccctaaagggcagatcattaccccctcatctcccagcagtccctgcttcacatttccacactgcccctgcagatgcagatgggcttgactgatgcaccaatttccatgcaggagctgatgctgacaacctcttctggggatgctgctattgactaatgtggagtaacagccaacaagggaacagtcccgcggaaagaagacctgccagaagaatgccacattccaggttccctgtctcccatcctctcctacccagacagagaaactgcccaacatgctctccgctaatccttgtgactgacacaaagctttccagcaacctatgtcgtttttagaaatgctggggaagttatttacaagagtcctgatttctccccacggcaaagcccatttcttccacctcaaatagtcattcaggtagtcttctttaaatgtggttatcctgccggttagggcagacatcaagcccctttgtttaaatgcgcacccactcccaccccagccctggatgaaacccctggggtagaccagccctaataagggaggtaaaaagtattttgaaagagagctggagaatacgagctgagcccacgcaacggctcccaggaagatgtcgaggggcttccatgaagaactagttaaggcgggagctgatctgcagataaatcagcagctcagcagctttcaactcagtcttcaaacatactgctcttgcaatgttctgaggctgaaaatagatattctgtctccagaaaaggaagaattaggatgaggccaagcttgttaggagaaacaagagaagctggtattgaacctgattagacaggagcatcttgctagtcccctttcccaagctgtaaaaagttaagatgaaaaaaaccagcatggctcacatttcttatctactgttaatatagagtttaaattaaaactcagggggtctctacatggacagatgacttgtaagtgtccgcctctgtgtgttcacagatgtacaacatacactgtgtgtgtgtgtttcaagaagggacagcccagataaagggaggttactgaagcaggctaagtttcagcaaaatgtaaccttcaccttagaaaccaggaaccagagtaattagattacaatctttccaacactatgggagagatttgatcaattaaagccaagatcagttacattatttggtttacctaagtaatggacccttaaatgcaatcaatacttctctaggctgtgagtcttcaagacctgagatgcattcaaaaaacacaaatggattttcaaagggcctcgggatgttcatcacaggctgaggaggaggactgcagagggtggggggcagaaggaaacagacaacagacctgagcttgctgtatgaagtcttcatttccttccctcactgatgtgctgctttcatgttcattttgtagttcatgtatgaattaaatttgttttaccaaagaaccttaatctagggatgagcagccatgtcactcaattcattttaaaattgcagcattaaaactcatttaataggataaagaatacgattaagatttctatttgtgtttctgaaaatccacaaaacttacattgggaagttacgaagaaaaaggcagaagtagctctagatcttctacctcgtcccccatgccatcccttccacaacatggatttagggaaggacaatgacccagtatgcttgggacccagggccatgacccagtatgcttgggacctacctggagctgaccatatcctgccttctagaactaccctggcttagagtggatccataacagtcccgtgttaacagcaaactttcacaccacctatactccttgtccccactctatgtgcagggtctgtctccagtcctcccttacccagacagaggaactgctccacaggaacccaggaaatgctcctgggtttagagattgtgattcaacttggtgggtccatttgccaaatcatactgttttaaagcctaaaaataatgtatctgtatgtccagatagaacactgcccaggccactctcagtccattcactaatgaggactcctgcaggggcagggcaggacagggcgctgcacctgctcacatttcctccagccgccttccccagtacgagcttgagcatgcgcacctgcaacatgtgaggctcttatcagtgattttgtttaacacacttgtaataattagaaagtgaagcaactaattcctgacttccccaagagcagggcttctgttaaaaggtgtggggaaatgtgacaagaggggaagtggagagggggaaattgatcctgagagtttactctgcatagctttgaagtctctgcagtaatgatgaagacaagctaaggtaatctaaaacaacaggtaatcaaaaagtcatttatgtttaccttttatcatcaattatcttcctcttggcagcagttgaaaaattatgttttactcaaaagtcaggctgttgactttatttatacaacacttgaactgtgttgggtgtcagcgtgttagccactgtggaatttcaaattctgctgtttgacagtacccgagagttgactctgagagtggtcttctaataactgtattcttggttcctaaaatgagatgttttagctcagtgccaagagtgtgaaaacacatgggggcattacattagaaacctgggacctgtcaattaatatcattttcctccaacatgaagaaaatacatccagagctcagtcttctcatttatggaatggggataataatgtgtagcttgcctttcatagttgtcttttagaccaggaaagataatgtataagaagcacctagaatcatctttgacatggggtgggagcacagcctattatgatgagacatatccctgaaaaagagtccctttgagtgtcttcgtctttccggctgaatcatctgctgattcaagaagaggaggccatatgcagacagcacaaagggaactcccccatggagcttcagatggtagccctgcactcacttaattattcacgccagcatgaaatctgcctgacatccctcttcctcatcctcttgacagcaacagcattaaaggattaagtagtatttggggctctgaaggggcctgaagagtgtttgtgtacaaaaggaagagctcacaatccaagtacataagacagcggacatcacttgggtttacattgacctcctctgtatctaggcaatggtctcttcaaaatcaagcaccacacccccaatggctgcagttctccatcctggttaaggcctctccttctgaggaatgacttcttccatttaacagtcagtctaaccctgagggctggagagggccacagaggtcattaacacaacctctacacctgctgaacagtgtggcaggaagaacatagggctgtggagtgagaagacctaataacccaagagctaccttggccactgaccaagtgggggcaccttgggaaagttacatcctctgagactctgttttctcatccacaggatgaggaagttgcattagatggattttctgtgtcatcttgcttgggccatggggtgccacacatttagtcaaacattattctggctgtttctggatagaagtaacatttcaatctgagtaaagcaggttgccctccctaacatgggtaggccccagacaattggctgaaagccagaacagaatcaaaaggcagacccctcctagatataagggggaatctctttctgcttgactgccttgagcctgcgacatcagtttttccctgcctttggactcaaaatgaaacactgggttttcctaggtcttaagtctgccagcctttgaactggaactcacaccactggctctcctgcatctccagcatgctgagtcattctgcagatcttggaacttgttgacctccataatcacataagccaattccttatcctaaggatttacgtgtattgttttccatccatcctattggttctatttccctggaaaatcctaatacaatccccaaagatgaactttcatttctaacccctaccaaatggccatctgatccacttgtacacctcttagagacaagactgcactgctccctgtggcacctcaccctgctctaagggcagtggaggtcagcctcttgggaagcactaccccaggtgactccaaagctgaaccagccacattcccacccacaaagagtgtttctccaacaggtgtgatttgacctgagcagatacagtagaaattttatccctgctttcactgtaattatgtcaatgtaggctgagattgccttggttgttattgttgggttttatctcgttttgggtttcctggttatcacatactgttcgttggctcatattgagtctgcagttaacccttaactcattttcacatccatttcactgggtgtggccaaatcaccacctgacacttctgaaagagacttttagtacatagggaaggcctttatattttttactataccaacatcatcttgttaccttagggccagaatttttgcagttcttaccctgtcatctaaagaaccatgtccacctctccctctgtgtcatccagagattggattgcacagtacatcattaaccctcataggaaacaggagatggcacacacgcccttgctgcactccccactagcaccctccctcctggccagtggtctccagctctgacttcacattacaatcacctagaaatcttaaaaaaaaaaaaaaaagaaaagaaaagaaaagaaagaaaaatgccaggctcaacctctgattctgatttagttggaggggctgaggaggaaagatgcttgggcattagtaagaatgctttaggtgattctaatgtacagcaggctgagaaccagtgttctgtctaggccagagatcagcaaactttgtctgttaaagagccagaaagcaaatattataggctttgcgggccaaatggtctctaaagcaactgctcagctctgctactgtagcacgaaagcagccttaaacaatacataataaacaaatgggcacaactgtgttccaatacaactttatttataaaaacaagcaacaggccattttgccccagaagctatttcattagttgatcaatctgttcatcacccagttttaaaatagttgtgggcccagcacagtggctcacacctgtaatcccagagctttcagagtcggagaaggaaggactgcttgaggccaggagatcaaggttacaatgagctatgatcatgcactccagcctgggcaacagagtaagaccctgtcacttagaacaaaaaaaaaaatcgctgtctctctctcacacacacacacacacacacacacacacacacacacacacactggttatggcagcaaatataaactcatcaaactgtattatcacgctagtcacatctctccatcttgtctgtgacaccagagactctcaaagtggctggctgaaatcaatattcactctctatccggcattcccttcatgtatcagacgaatgatcccatctaaacaagaaaaagacttgttcttagaggatcctttctgtctcccattactcactgctgccttattatatgttcacaaacgtctgcttaatattgcttctagaattcctcagaaactgacttaagctcacccatctgtagtttccaaaccatgctttcccccttgaaagctgggacatgtttgtcaaaatcatttacaatcttctggcatcctattctccttgattcacaaaatattatctaaagtggttccacaatcacatctgcaagttccttccgtgcccaggaggcgtaaaggcatttttttagtcattctcattatctcttctatcttgggttttaatgtctcctaaccatgtttattctaccctttccaacttaaagatcatttttcctgataaagatgataaaatcaaaatagaagttgagcagttctgttttgtccatgtcatttgtttactctataccatctgttctaaataaggctatgtccttttttgtggggagtgctccaaatagtattgttttaaaactcttatatacaggcaaccacactttctggttcacctcaggcactctggtatatactgtctgccctggggtaaatacgaatagaggcctctttactctgaaaagtgtctggttttttgaacagctggttcaataagtaaagctgaagaaatggtaaagcactccacagggttcatgggctctcaggtcttccacacattcaagaaaaagagaaaactatttctgttgaaaactttggccacactgggccaggcatggtcacacctgtaatcccagaactttgggaagccaagacgggtggatcacctgagatcaggagttcgagaccagcgtggccaacacggtgaaactctgtctcaaccaaaaatacaaaaattagccaggcatggtggcgggcgcctgtaatcccagctactcaggaggctgaggcaggagaatcactggaactcgggaggcagaggttgcagtgagctgagatcacgccactgcacaccagcctgggcaacagagcaagactctgtctcaaaaaaaaaaaaaaaaaaaaaaaactctagccacactggattcatatcctaggcctgccacttactagttctatgaccacaggataagttacccaatctctttaactctcagctcaactcactggaatctctgtgcctatttaatactaaatgcatgattaaagcacatagcatttacacatatcacatgataaatgctcaagaccaattatcattgccaatattactatcagtgttattaactccctcaacccctccacagcaacatggtatctgtgactctctattggtgcagtttgtccttccttttcagaatgtcacatcttgttttctcaccaatctcttgctactggtttaaactcaatgctacctccccacaatctcgtaaagtctttctcatcttgacaaagaaatctttgtcttcactagaaatctggaatactccaaggaagtttcttctctggcaaagaagcaaccagcatttataacaaacataatttgtgagctgctctggaaagaaatgcaaacgtgtattccatgaatccctcagcaactgtctttcctggaatcaagataaactattattcttcatggttcccttgggaacacactctgaaaacttaggagactgcaactctcaaatagcttgagtaaatcaccctagctagaaaataaaatgacattaactttctgagaaaaggactgacccaaggcatattcaaataggggaatcataaaagggaccacacaggagaaaaatgagtgatagctacagttttagtatcaactacaaaaacagtaaccatttactgagtaactaagatatgccaagaaatggcataccaggcattttataaacatgatttcatggattcttctcaacaattttgctggaaattgaggctcagaggaagcacttgcccaagggacataactagtaaatggcaggtacagcacttaccacgggtcttctgcactctaagttcaagctctttcagacataccatgctacgtgtatttttttactgaaggtgctccaaactagtttttgagacagttaaaaataaaaggacatcatgaaaaaagcaaaaataatatttacatacattttagaaaaaaaaatatataaacattgttggttaagtggatagcagacctttaattagcaattttgaatgatgaaacagccacataggtgcaatgcttctggccagggcagctcattagggactcagtatccgaagtctttctttttttttggatggctagccatgtatacacactgtatagcctctaccaaaattacataccacttagcacgaatgcaagagatcccttcctcgtactataaacaaaaattaactcaaaatagatcatgaacctaaatgtaagagacaaaactataaaactcttagaaaatataggccttgattagcaaaaccttcttagatatgacacgaaaagtacaagtataaaaaagttttcatcaaaattaaaaccattatcaagaaattgaaaagatacacacagaatgggagaaaatatctgtaaatcatgtatctgataagggacttgtacctgaaatatacactgaattcttacaactcaataataaaaagaaaacctattttaaaatgagcaaacattcttggccaggtgcaatggctcatgcatgtaatcccagcactttgggaggccaagggaggtggatcacttgaggtcaggagttcaagaccagcctggccaacatggtgaaaccccatctctattaaaaatacaaaaattagccaggcttggtggtgggtgcctgtaatctcagctacttgggaggctgaggcaggagaatagcttgaacctgggaggcagagcctacagtgaaccaagatcgtgccactgcactccagcctgggcaacagaagtgagactctgtctccaaaaaaaaaaaaaaaaaaaaaaaaagcaatggatctcaatagacatttctctaaagaagataaatgaatggcaaataagcacaggaaaaggtgttcaacatctttagtctttaaggaaatgcaaatcaaaaccacaatgagacaccaccacacatgtagcattgggatgcctatatcaaaaagacacataattaaaaagtcttagtgaggctgtggagaaactggaaccttcatacaccactagtgggagtttactggtagggtcgtaaagatattctaaaattatggtgatggctgcacaactctgtaaatatactaaagccattgaattgtacactttatatagatgaggtgtatggtatgtgaattatatctgaatatagccagcgtggttgttgttttaaagaaaatggtatgtcctcatttcttccaaatccaaggcaagttagcaaaggcataatgagaaaaagaggtctaattttcattcagaggccacatcagtgctccatctggacaaagagtcagccaagaagccaactgccaggagtggaagatgaccacttccaggatctggcagagagactttgcaagtgcctttgaaagaggacaatgaaaatgtatctggcatgaaacacagcaggatccaaagaacaggctttgatattgccagtcatgatgcgtgtctttaagatcacagataacgttctgtgtaacaacaaacacaaaatgcctatgactaagtgtatccttctgatccactcgtgtgcagttagagaacacccaaggggtcccacacacacacgtgaaggggacactcccaacccatgagggaaacacaccctccatcctcctttggttcaaccccagcctccgagaacaggtaatttcataggagcttgctcagctctgtgttatccacaaacttgtcacctttatagtcacttgaagaagttggaaaaatacagtgaaagtcctggtgctacaacagagatgtagcctatgccagataagctttacatgtgttacctcattagtcactcaacacagggtgatcatcttacaggaagagatactgaggcacaggaatgtcaacttgcctaaggtcacaaagctagaaggaacaaaatagggcttcaaacccagtcattttggctccaaaggctatgccttaaccactgtgctaagcgccgcctgcttaaccgggctaccttttccaccacaatttctcatcccttctgaaagatggtcacaggtgttgctgaaatacaggtaacactatagatatatatcagctctctgagctattagataaatgatttaaatatttatttttatttaaaaatatttaaaaattctacttaaatagaattttaaatagttttacatttaggggtacaaaaactttacaaagatagtgcagagaacccttgtatacccctcaccccctggatacccctcacttggtttattctgttgttaccattgacattactacgtacatctgtcacaatgagggaggcaacactggtatgatactattgactacacgctacactttctttggatttcacaacttttttccccttaatgtccttttctgtcccaagatcccatcccactacgtttagagctcatggctcctttgcctggcctggtcagtgacactttgctcagacttcccttgttttcgatgacgttgatggtcttgaggaacactgccaggcatttggtaaaatatccctcaatgtaggtttgactgatgcttttctcactcatcactagacccagattatgggtttttcaggtcacagagatgaaacatccttctcaccacatcctgtcaaggtgtgacatagtcgatgtgaactgatcactgggatgagaaactgtttgccaggtttctccacctctaagttactttctttccttgccctagtgtgatgtttgaagctaagtcccaaagtgcagcccatgctgtaggaatgaggagttaagctccatctccttaatggggagtaactatataaatataaccttatttttaatgatggttaatccgtatggcattaaaaaaaataaaacaacatgccaagtgacagtgtacggcccttccctattgttgctgactctgcagtggctgtaatggcttcctgatcatctttatgtctcagaatcacaggaggtaagaagcactatctccaaggtgacaaaaaagtaaaacaactggccagcatggaaagagggaagtccattccattctagatgatgtttaacaaacaacaggagtcagagaaaggagaaaaaactatcccatgatggaggcaacacatgctgcatgtttgtatgggcaggtattaaactggaagtttcaagtaagtttccaagcaatgacagatataaatttccaaagtgaggtgccaggctctccaaaggagcttttcaaagttaatgtgtcataactagattcatgattttttataccccgacctactctgagtgagaaacagaagtcaacagagaattttgtttttctttgagggggaaaaaaagagctgtgctgtgatcccctccaccatcaccaaagagatgggtagcacagtggagggggggggggtgccgactctcaagtccactgacagaggcttcaaagcagaaatgcacagcacttgatataatttccgtagaattttggaggcctgctggactggcagctggtacacagctaaaagatagaggctagctaaaattgcactgggaaggacctgaactgcattctccctctgaagtggaggaaaggcaccttaatttgggaagccagatgtagaatttatgatggggatgtcgaccaaggtcatcctgcccaagagatttcttccagggggtcagatggacccagcagggtctggatgaggcagatctcataaaatcagaagctgcgagcaatgtgggagcaagggaaggcaaggctgccagagtaaggtggctgcagttggaggggcccagcagaggagcacacggagtgcccatgtggaaggccctttaaaaccagctcaggcttccagaagtatggcagactaatactcttgttgttttactgtctaccagtaatgaatgaatgaaaaccaattattattgttttgttgggttcagaggaaatgaaaaaaaaatgtctacaggggcaaaaaggaaaaggaacaaacagtaacaaccaaaaatccctgggcagtgagcctcagaaaaggggaacggtcctgtgaggacatgtggtgatctcacgtgatctctgggaggctgggcctcagctctgtggctgggtgggggaactaaactaaaattccggggttacatggcagcatctggaaggcaatggaattgtctcaggaccgcagtacccccgcaggacagcagcaccctatgactactggcaaaagcaaaagcaaatactctgagaaaagcatccttgacttaggccccaagactttttctacaattaggatcaaccaaatatgagctagcaattaaggtttactaaacagacagggaaacgaaacatcaggagtgagagaaagaacagatgcaaagtgccaaggacttcagatgcttcagttaccaaatactgactataaaataactacatatgaaaggctaaagaagtaaaagacataatcacaaaaataaataagtaacaagtgactatcaaaaatgaccaggcagggctgggtgcagtggctcacgaccgtaatcccaccactttgggaggccaaggcgggtggatcacctgagtccaggagttcaggaccagcctggccaacatggtgaaaccccgtctctactaaaaatacaaaaattagccaggcgtggtggcacttgcctgtaatcccaggtactcgggaggctgaggcaggagaatcacttgaacctgggaggcggaggtttcagtaagccaagatcgcgccactgcattccagcctgggcaacaatgagcgaaactccatctcaaaaaaaaaaaaaaaaaaaaatgaccaggcagtttcagctttgcaaactgaaaagagctgtggagattggctgcataacaacgtgaatgtacttaatattaactgaactgcgtacacttaaaaatagcgaagatggtgaattttatgctatgtgtattttaccacaattttttaaatgacaaggaagattttaaaagaactaaaactttttaaaataaaaactatgattattgaaataaaaaaatttgctagcaagattatacagcatttagtcaaagctaaaaatagaattagtgaattggaaggaagaaatgaaaaaattacctaaaaggcaatacagtaagacaaggaaatgaaaaatataaagaaatgttaacctaaatggagaatacaatgagaaggtccaaaatatgtctcatcggagacctagaagaaaagaatagaaaggaaggaggaaagggaatatttaaggagatgataactgagatgtttccaggagtgttaaaagacataaatccacagatatactaatcagggtaaatgaaaagaaattcaggctgggcgcggtggctcacaccttaaaccccagaactttgggaggctgaggcgggtggatcacctgaggtcaggagttcaagaccatcctgaccaacatggagaaaccccatatctactaaaaatacaaacttagccgggcatggtggcatgcacctgtaatcccagctactcgggaggctgaggcagaagaatcacttgaacccgggaggcggaggttgcagtgagccgagatcgtgccactgcactccagcctgggcaacaagaacaaaactccgtctcaaaaaaaaaagaaaagaaaagaaaagaaaagaaaagaaaagaaattcaatctaggtgattgtcataaaactgataaacaacaatgataaagaaaagagatgttaaattgcaacaaggcccagaaaacacaaagccagcatatgaccagacccagtgagaaatcccttctatttcttactatcacctacccctcctctactccttttctccccagcattcactcaatgagaaagagtagctggagcgggtggggagagtatcaatatgacactaaacctacctcctcccacataatctggatggatgcctacagccatgtcttcaatgggcaaggaaagtcttactttcgcataagtgaaatttctgaagttctcattaacatattaatattcttgactgaatatctgaattgctactaaattaagatggtgtgttttcaacttaacacaactgtccaatgtaggaagaaagagagacatgtgagttagccttcctcaacaaaaagcttgtgataaattcctgttacctatgcattgcaagttgcagaagaaaccaagtctatctctcaccatttgctttcccagggtcaaaaaccacaatcatcttgataaacaaggcctatgcaaatacaaaaatacatcgtcatgcagcgataatttcaatgcctgcactcacctccatcccatttctaatatgcaacgtattaactgccaactcattgtgaaaagcatctacgctgttctcttttttataaattctatagattcattatgattagatactctccatatacatcagctagccagaaaaggggaggagataatgaataatacccaagggaaggaaaatccctttttcagctggtttaagtcatgccgataatgtgcacacagcactatgcatttaccataaagcttttcaattagttcatagacaagttaaccttctaactcccagaaaatataattcacgcacattttataccacacagcatcctgctagctattatccatcatttacaagtgttatttgtctataaaaatgacactaaagttttgaaaaacgaggctgctctgccttcttctggctgtgttttaacaaatggtatcaatgcaaaaggcttataaaaagtcatataaaaagcaattagtcaaaagagcaataaatttttttaaaaggatataaatgactgcctgtctagatagccaaatgtctgaaggctgatacacaatgaaataagggttaacataaaagagtacacttcattatttattgttaataaagttaatcaaattcagttcttcttacgcatgcatttaaacagaaacacaagtacgatatgcatatttatagaaaacagccctaaagatcattatctctaaaagaaaatccagcaaaaagagatgcataaaatgtagctgttacccttttacaacataaactgttttgcttaaaacacaaacatttattttaagtaaaactattaaactaaataatattttccacaactgacaaccatgactaaaacatgaattctaggattaacattaaaataattttgggacagagggaaacagaacccttccatttttcttttgctggtatcttatccacctacactagttttgttcttccactcaaaaatctattctcaaaagatatattagaatctttttaaaacaaaattagataagcataagctcatcaatcagcaatttctaaatgcattatcttcaagtagtttggtcttttatgtcacttatctgcttaaaattaagtataaaagagtttccaagaaaagaagatataaaattaacttcatttcataataagttctccaatcatgccagcagacagctgacattattacagctcacacttataaatcagtgattatatacactagttaagcaagaaaagaaatgaagaaggcaattatatagtggtgaaattcccaagaagcacatttgtagtcaatgttgctaaacagtagttcactcgtggttaaaataaaagccccctccccctgccagatatttttggggttgtgagttttgaggggaagaaagtagaaactctatgcaatttgttttacaaataaattaaaaagccagcaagaaatcaatgaactgtaattttaactcattttactgtttactttggagctgaattctaaaacttccatatgacattaagctataaaatagtactgaatcaaacggagagtagaatactttggaggaaggggtggtatctgaatatctatagacatttggtaatgaacgagccagtgacgaatgaagacacagggaactgagctgagcttggtttccacaccctcttctgttccctgccacttgaataagagccaaaatgccacttctaatcttattttccatttcttaaatgtgttttattaactcctcttttattgcaaagctaaatattctaattggcacattatagacatacagctactagatgtcaattacactttaatgtgtttgtaatgctctgcagcagtgaggttctggcagacccagtgaggtcccatttatttcttcacttgtaataatggcatgataatacaacctgagtagtgcatcagaacacagtagttagcatcactgcaagagaaacactctcttccatcttagttatattgctttgaagaaatcagatatcctttctactcattcaaaaggagaaccgaacaatgctgattattcctgaaggaccttttgattttcaaagcatttgctagtaatctgttaattaatccacgcagcccctccgcaaggaaaactagaggagaactgcgcaatactgtactaacattttagagacaacaacaggaggggacagatatttggagaacctgacaaaagtctgagagcttctacaaacacaacctgcagaaaatgtcacttgattcatatcttcaactccagggttatgccctgaaggaaatgcactcatgatgatgtgaactgcaattcgtggacttgtatcttcatctaaaccatcttacccataattcattcccccttacctagcacactttaagatctgttcatgcttccacatagttaaaaaaaaaaaaaaaaaggtggggggagggtgtagttcaaaagacagacagataatcctaaacccctttcgtcccaggacttagaaagcttattttttccagtccaatatacagccaaaggaaggagcaggataatctacaagggaaagtgcctcttatctgtttccttcctgagaacaaatggaccaagcatacagatgtgagtgtacacatgtgtgcacacatgtgcccctctcaaagtgcatctgaagtaaattaaaagaatcctttctgagtgatcagtctgttccctgaaaggtcagaattttctggtaaatattttttataactccaccctgtctaaacagcaacaacgacaacaaaaattttagctaaaagcatgcttgaagaagagtctaaattccattgataagccaatagtggcattaataataatggcaattaataatgcacactagcatgatgttgttttctgtagcacatttttctagatatcttaagactctcggtagcccatatttttatcatccctctccatgaggtagggcaagggtacttattatccctatttcacaagagaactatgtcctagaaaattaaaagacttgtctaagctctaaactggtaacaaggcagagacatgaatttgggtctccaaactctctgctaactaaataatggcccagaagacatacaaaagtcaacacaaacagagtgccagctgttatttacactgcctacaataaatgtttgttccagaaaaaatagttcaaacaagatgagaaatagtttaaacacaaaaggctgaagggttcaatataggagaaaaaatatgtttgcttttaatacagtggaggaactgttcaggaacagtttgttcttctgtaaaggctggccttgttgtactgccgaaggccgcaagatcacaagctacgtggaattgagacgccagctcgcttcggcacaaccaacttctctcttaatgctctaagttcctgtcttcttcatagctttgacctgaaccatgaatgatctttttgacaaacaaaatttaaatgtgtgttataaacagggagcaagtgtcctaattttgatacagggtgctaagaaatacagaaaacaaaggaaattaactgggagatccagggaggctaagaaacaatctgccactgggagaaacagccatagcttctgatgagctaggaagattttgtggttgatatcacagctgtttgttgaggctgtggtgggatttctttttcaagagggtgaagggagatttgaacttggcgcctgacacaattatcctaaagtaggaaagcctcagttggaagaggatgagtttctttaaatagcccaaaggctgtgatgcgtaaaaaaggacttgacttattctggatagctccagagggcaaaactagcaagtggccagcaggaacacacatactcagagtagagcagagcttgctaataattaggactgcctcatccatagcaaggaacactcagaggctcatctcctctgaactacttccagctgggactcccgacgcccaccatcaaggatgctgggagggaaatcccacattagtaaagatgatggacaagataaacgctaggactctttcaactgttaggatttgagggtgattttcaaggtccccatgacagtcacttccagactatgaggtggagagtcacacagaactgagtcccaacctcagttctatcactttgggtatttttttctccttagatggtaaccaaaccttgtattttttaagttttctttgaagttcaggggtacatgtgcaggtctgttatacagtaaacttgtatcatgggggtgtgttgaacagattatcttgtcacccaggtgttaagcctagtactctctagttattttttttttatcctctccctcctcccaacctccaccctccaacaggccactaaaagaacaagatcatgccctttgcaggaacatggatggatttctatcattttttttaactgtgtgatactgagtggctctgccacccaagtgtgacctccaaatcaaggtgtttattagaatcaaatggggaaactacttaactctaaagataatcagatctataccccagaacttcaaaatcttaccctccagaggggggtccaggaatgtccattttttcccatgagttgctagcagtccaattttggaaaccaccaataaacatttttagcctatgaattcatttgtaaaataggaaacatgatagtttttgcctaaatgagtcatggagatatttaaataacacgtaaaatacctagtatgatgcctctacctagaaaacagtcatagtccctttaaaaaacattttctgcaatatatgatcaagcttaagagcattcactgattaaaaatgaggacagaatggcttacatagagttaatgtttagccatctcctattttcttgcctgttttttaatcctgtcttgttcttcaagcaacacaaaatcagaaagaaatttgatacgatataacttgaatcagtttaatcaaatgccttatctatgtgaataatgccttaaaattaatgtatcatcaacacgcatttaaaagttgaatgcagtaatagaaagcctatgattttttgctcttttataataatcagaagctccagatataaactcctcactcaaaaaagtttaaaattcatacatatctccccattctcaggtaaagataaaagatcccatgtctcttctcctctgtatcacgcagttacactcactcctttaaaatcctgcaaggtattgaagtggaagaatcatcctgtcctgacatttatatctctacaaatggcttcagttctttaattgtgaagttgcttctacacattagggtgagtgttaagatactcccagacagaaaggaagagggaaggtaattggagtaatttgtatcaagtgaaaaaagtgtctcctggatttctgtattcctagttgcaagttattagactgtttctgtttgggtggttttataaaaaaaaaaactgtaaaacgtggttgcgtaagcacatctaaaggttaaactccaagcagctaatctgcatgtgagaacaagtaactgtcaaacatttaaccttttgcagattaaaaccgtctgactaacagatgtgaaaccatcgttgctataattgttagaagtagaaatctgagcatttttagaagatacaacactttttggagcagtcatgtttatgctccaggtcaactttcctgttcatgactgagatgcaatcatagcctttcatttattttcacactgtgattctcctgaattattatacgatgttcatagtttattctacagacatgctcttagaaagttataagttgaattctaatcgtcagttatatttgcacaccgtttcatacatgataattttttttccattaaaacacttagttttcttaacagtacatgataattttaggaaggcattagcttcatttccaactgatccaaactggccatggctcctgaagattctctcttcccttccatttctctacgctcatttctgtcacataattacaagtgtcagctcatggtagatgctcaaccaagatctgttgaatgaagtaattatctttaacacctaaaagatctactccctgaagacatttttttcacgaaagcctttttttgtattgcaaattgccatctctagtgaacttgcgtgataatttttaattttaataaatgagatttttcttataataggatatattgtttctggttttcagtattaaaattgctgataggaatgaacattttgtaatatataaaaggacgtgacagaataatactgtagctaaatacttatccagcacagtgtagatactcaaatatttgtttaaaattactctacatttcagaagttgtggcattaaaacatttgacttgaaacacactgcaatttaatgctacatttcttcttgtcaaccagggtctaacagtatatgacctgtttctaagaagaaatagaatgtatgcaaaagcttttaattctggaaatgtcatcatatacaatagagaaaaaaatttaaaataaaaatgtctaatactagaagaaatctgagatatcttttacacgaaagtataaaagtgacaggaggggttcaagtctccgaattctgagctttttatgtgaatagcatataaaacatgaattgtgaaatatacagtagaccatctgtgagtaagatgactccatgatgccatacttgacaaacacggacttagatctgaaaaacacacaaagcaagcatccactttacccacgaaacacgtcgggagagaggaagtgtggttctgtgaggcccctggtctgtagaaagaaaccaccacgctctggctcctgcctgaagctgcacaaatgagctggctcagtattagtgtcttcttttaaaggttagcacctttaaattgctggcatggcgattggtgggagctagaaggggtacccctaaaaattcttcgagcaaaaccgtaaataccaaattacgacataaaggggctgctactttctttacaaaacctcggctgtggcttgtttctcctccgtgaatcaactgtctttttccaacaaagacacccacttcagggtttcaagggatatctattcaaggcacgtactgtacagcatatgtggttatctacaggtagtacagcctgtaaacctagtttgctcaactaaatagcatttatcatgtatttttatgccttctgacatctgctactaaatacaaacaatgaaagcatctccaaaaactagagatttctactctaggagatgtggtggctggtaaaatcacctgcactttaaccatggaacaagacatttcccctccccatgtccagcccatgcccagactgtcctctaaatcaggggtccccaacccccagaccataacagtccatggcctgttaggaactgggccgcacagcaggaggtgagtggagggtgagtgagcctgagctccacctcctgtcagatcaccggcggcattagattctcataggagagtaaaccctattgtgaactgtgcatgcgaggaatctgggttgtgctctctttatgaaaatctaactaatgcctgaggatatgaggtggtacagtttcatcctgaaaccatccccaccctcacctcctcgtccatggaacaactgtcttccacgaaaccggtccctggtgccaaaaaggttggggattactgctttaaatgaacccttggcctttaagggcacatgctgcacacctggagctggacccatggagagctgatcctgagttgggctggggcaggcttgctggccgggctataccatgagctagctgcctgtcctactggtaaagcctgcaaccccagagaaagtgcccatttcagaccaagaagggaggtgctcacaacaaacggaaacatctctgcagtcacaccaagagctgcacccttgttcctcatgtgtattaagtgcaggattaatgccatgaatgctaggaatccaccatatcacaaacactgacctgttgggtcaaccagtttccaaaataacctcattgctgtttcttctcgtttgtattttatctttgccttttcaccttcatttccctctttcctgccatcccttttaccttaactgagttctttgtttcctatttctgtccccatattaaatgacttggctagttcactcgttgattaaaatacgaagaagttattgttggaatgagacattgttcactgcaatgtcttttttcgatggagaacaagataaaggccaacgctgtgagtgtcaatgttgaggacaggttccctaacttcagcctcagaggatcttcccatgctgtagtctaacatgctgttacaggttgaattgtgtccctgcagaccccacaatattcagatgctgacatcctaatctccaatgcttcagaatgtgactttatttgaaaatgaggttgttgcagacctagttaagatgaggtcactctggagtagggtgggcaccacaaccctgtgtgactggtgtcctcatgaaaaggggacacgtggacacaggcatgcacacaggcagaatgcccagaaaacatgaaggtgtcgggtgatacatccacaagccaaagaacgccaaagatcaccagcatccaccagaagctggagaggcatgaagggattctccctcaccaccctcagagggaaccagccttgccaacaccttcctctcagccttccagcccccaggactgccaggtgacacacacctgctgttgaggctgtccaggctgtgggactttatagggcagcttcatcaaattaatacatatgccatgcattttctctgtctaccctgaaattcaacaaaatgtgttatttggtcaaataaaatgaaacacagagcaccaaataactaagacactaacctctttctcaaataaaggcaagttcatatatcatagtcagaagttaaaaattaaaagaacaattgtcgttgtctataatctaaaggttgctgtcaagggcttttcagatgacctcttcataggaatcctgtttattctttgcctgtgaaaattttgtgttgcacctaagtttaaaattgtaaataaggaacctaatgtgcaaaatgcaacactttacttcatccatgactttacggacctgaataagagactaatgaaatgagaaattgttaaattacaaaaaacaagaacacgtgatctgtataatagggtactataaacacagtcatatcagaggaactaatctctcacaagtcagaaggagactgagtagaaaactgcgaacgaccaccacccctggtcccttgttgtaactcagccacggacccaatgctgaatcgctgcaagccttggtttccttgtgtgcatccgtcaggtgtctcaggcaaggctgcccgctccactgtctcccgatctaacggagctcaatgactttgctgcgttttactctgctgacccctcactccttggaatttcccacttcctgagctcctggacttttctgcctcctggccctcctcctgctctgttcctcctccacctgtccaaagtattcctcagtaccctcttgttcttgccactctctgtgttctcccaaagggagctggtccgctatttccctgcctgcatgtccaaccctgacctctcgcctaccaagagcagtctctaggacagcagctatgttaataatcatgataatatgcttgcacttacgtatatttatactgtgctgaacactacgattttacagtggatccatacagtatgaagcaataaggtgacttaaaaaatggtttgttaatagattagtttctttaaaaaggtcaacatatcccagcactgtttacagaattctttggtttaacaagggcttttatctcattttacttggtgaaaagttaaagcccagtttgtctctgaattctaaattagacggtacacaataggcaaagtgctttcaattgcatccaaggtgaggatgtgcaggtccttcctaagactcaacacccagttagagataatggacaaagccccagccgagggcttattgaccttatttatgccaataacacaaactctgactctggagaattaagggatgttggaaacagtcactgccacttggaggtcaattaaagtccacctttgagcactggtggagaggaggcaggaagcctgcagagataaaagtatcctaatttaaatgttaaaaggaccattacaggatcttaattccttctagcaaacagagcatgtacttagatgacaatgagtataaatacaaccactctagaaagaaaagacaggagctctctgctccaaagagtattacagctttcacaagaaggacctgagctaacttctcatgtttgtaggtgggcgatgggataagtttgcagaagacccatttacggggaccatgggcaaacagaagcagaccatgaactaagttaaaattcaaggcccccaggtaaaccagggcaaacatccctgactccccaatccacctcttctaaaactctcttaagaaacaccatgatcagtgtcttcatttagcaaagacgtcttcaagaaccacagctcgtgtttggggcaatcattttgccccctctagtgagggggcatttctttatattaaagccctgagaattaaagaaaaacaatatgcagaaagtgcaacaaattattatccaggctgtgtgcttctctttctcagaacattctattaagattcttcactaaagaatgcccttccacagagcaccaccagacaagagcttggagaataagtacttatatttcctagaaactgtcagaccagaataatcccatttctagaaacggcaacaacagtggccaaaaaaactgtttattagggaaataattatggaaatttcactataattagggaaaatctcaaattctgtattttatgtttccagcttttactttttctgataggttctggccaaattcccagaatgcatttatctgatgatgtctcaagtgatggcaaacacagaatattatatttcagttgtttgcactgcttgtttctccatagttcccaccctcgatgagatgttttgtgcctttggaggcatagtgctgtccaaatgctttggggcccgtaggatggagcttggtgtgacctggctacttaagacacagccacacccaaaggcagctcagattctcctttaagaccctggccagtgtctctctgccattccaggtagtgttaaatctggtttgtggacaggttagcatgcaaagcaaattagaatacaaaaatgggctgcagacatgtaaatgtctcaggaaccaagtgagtttcctctgatgacatgaatgtctacgtcaaatcagggtatggatgcagagcagctggtgttcatggtgaaaaagatgtgactcaagtgccactgactgcttctcccgaactctgccttatcctcaattatgtctaactacaaaccgagatatcttcttatctaatgcagtgacaattaaaatgtcacccttgagatagtaagagtagggcttctgctgcagagaactctaaagacagtcagtatcacattcagactgtgtgcaggaatttcttccccacagaggatgtgacaacttcccagggctttaaaaaagcctcgatacctgaaagtaaatacacgtcaccccaacatggaaggcaatgtggtcactgcaggtgaactctcaaaatgtaaaacctaatacctcaccaagttgcctaagagacaggtctcaaaacacctatggctccagccccgggaacccatttcccttttcctctgcaccactgagtccaagtaaacagcacactctgcttctgaggacactgaggttgactccattcgagctgataaaactgcctccccaacatgtagttctttttccattttctcccctttttccttttaataaattccctgctgtggtacaagggaccggaacagtaaagctgaaagtctctcattaattataaaaatgatttaatctgctggaaatatttatttccagagagggaagtgtggtgtcccagctctgtaatgctatcaacgttatgtatgtgcagtaagtagaagaatggctccccaaagatgcccacctcctaatgcctgcaacctctgaatgtgttcccttctatgacttaagagactgtgcagatgtaagttaaagatcaggcctggccaggcacagtggctcacacctgtaatcctagcactttggaaggtcaaggcaggtggatcacttgaggccaggagctggagaccagcctggcgaacacagtgaaaccctgtctctactaaaaattcaaaacgtagccgggcatggtggcaggcacctgtaatcccagctactcagggggccatggcaggagaattgctagaacccaggagacagaggttgcaatgagccgagatcataccattgcactccagcctgggcgacagtgagactgtctcaaacgaaaataaaacaattaaaattaatcttaaaaataataagatcaggcccaaggtagtcgctaaggcccttctaagcaaaagaaggagcaggaaggttagacaagtgagggccagagtgaggaggttgttggctttgaagatggaggatggggccgtgagtcagaatgtggagctcctctagaagctggaaatagcaaggaaacagattctcccctagatcctccagaaggagcacaggcctgccaacaccttgatgttagcccagtgaaacccactgtggacttctgattttcagcactctaagataataaatgtgtgctgttttaagctgctaaatttgtggtaatttgttatagcagcaatgggaaactacagtatctgttacttcctccttcctgatctaatccaatctaggagtttggggaagtggagggaggaaatctagctaatacccaaattctctttctctactatttccactaccaagtatctgttccattatcagaaactaaccaagtgatggtttatttatctggaaaccactcagcatcatagagtttttaaggctggataaactagaggccatttaagccaagcctctaattttatccaagagggaaagaaaaaaaagaaaaaaggacaaagaagggttcaaggaatgcccttggacaccagttaatgggtgaattttgctggctttctaatccagttctctaaatttctcatctcttgctagtattgtcgacaactcactccttcagaagcattcttcctgccctaagccagttcccttggcaaattttcctttaaaatgaatatttcaattagtaaactacacatattttgcatattccaactagaaagcagcacagactggccagcaaattcatgccaagctagactggctcaaagagcttcagttcatatgacaacatccgttcacaggctcagcccaggtaccacattatcaaagattgaaattttgaaacctggtgaattcagcttctgctgaaatgcagaagatactgtaagcgaatatacaggtttgtcaaggtctatgaatttcatccaaaatactaaggagagtttttactaccctaaactcacagcttttacagggcttgtttttatttatttatttttttgaaccaaaatcatagatttagagttggaagtgacctttgtgatcattatttcaatcctttcagagaattctctctgcaggaatatctatgtaggacttggatttgacccaagcacatacaatgtctcagagggctctctgctcctggccaagagcatcaggtcttgtttttaatataatcagtgttgtaaattatggcacagagaacaggctcattcagctgtggaatgaactgagttaaatggacttgtaaacatccctaaatgaaagaattaaaaagtcaaatgaggaattatatagccgtcccttggtatcctcaagggattggttctaggacccctggggataccaaaatcctaggatgctaaactccctgatataaaacggcatagtatttcaatataatctaagcacatgctcccatatacctgaaagcatcgctatagattacttataatacttaatacaatgtaaatgctatgtaaatagctgttatactatagtttctttatttgtattattttttattggggctcctttgctgaatattttcttttttttttttttttgagacagagtctcactctgttgcctaggctggatggagtgcagtggcgtgatctcggttcactgcaagctctgcctcccaggttcacgccattctcctgcctcagcctcccgagtagctgagactataggtgctcaccaccacgcccggctaattttttgtatttttagtagagacggagtttcaccgtattagccaggatggtcttgatctcctgacctcgtgattcgcctgcctcagcctcccaaagtgctgggattacaggcatgagccacagtgcctggccttttgctgaatattttcaatccaagtttggttgaatccacagatgtggaaaccgcagatatggagggccaactgtatcatgtcaaatgtaattaagttttacttacacagtagtatcctgaatctaaaattaattaattagttaaagccaactagaaactagcaaactagaaaacagatttcaagattctcaactaggttacaaactccttgagggcagatgctgtctaaacatacttctctctcttgcctgctgcaccttatttaaccacaggtgcacaatcagcatgggctgaattcaactggtatacacagttcctgcttagctcccagaaatgaatctagaatacatttcctaggaatctagaaatatgaagcaatatgatgaactgtactttcttgtggccccccaacagaactcacgcttccccagctcataaccacttgcagacataatttaaatttgtcctaatggcccagattcctgtacaaacaccagattcctgtactagtgtttgctccttggtctgaagcttatttttctcagggtacaagaaaggtctgatgccgcagatgttatatctgcgttctgggtcaatagactcaccacacaaaaagaagagtaactcagcctccttgacgtctgatgttcctcaagtgcctggccatgaagacagaacttcctgatcttattttccttgctcttaactcactatgtatttcactgtgactcttgtcactatcacttcagcagagttcatcacacagcagcactccagtggcctagctcagacactgcaaaccaaccaagaataagaaccagaatttacagttttttaagagaactgtactatcctttagaatagccagagccagagtgaacacctgctttgctgcaaatcagaatggcatggtagaatgacatcaggtcggatgtcaaattcaggctgaaacctaactatgccttggtttccttgtatgtttgatagaggcactgtgtctgctgcattaggttattatgaggactagagagaatataggtaaagatgctattattagtagttagatgtttattgtaattttgtttagctctgtcaaagaatattacttttaattaaaacgttaatatagttcatcttgaagattttctttttccttacatttttatctggggccttagctgaaactaaaaacaaacaaacaaacaaacaaacaaaaactctatgcagatttgtcacctctcttataaatcattttcattttcctgaaacctggagacaagaggcaaaatgaaacctaccatctcttctaaagggagggagggaggaaaggacagtctattagcaaaaaaaatatatacatatatattaaggcaagactccagaaaaagaaaaaacacaggcatgaaccaagcactaaccagtgtgcctcaatgttttacttgagggaaatgatctgtatgttgcccccacccccggccaggatgcagccaaaggacctggatagtgaactctgcacttctctaaaaaagatggctctcaagaaggtggaaacctaggatgacagccaggaaaaggttggaaccagaggtggggtctttattgggctgggagcagactaagttgtacccagtagctggcaatcaggatcaaggaagaggctacaaagtcagatcacagtagagatctgggatacacacagaggtcaaggaaaagcaaggttcagaaaccagcaatgcagcctgaaccacaggcagaaagccacagcaacactaagatctgatgcttctaagttttctgctgggggctggagccatccacaaggtaagccaagcccacagtccacaagtggaatcaggtcactgtcctcaggaagtagggcgacaagggttaggaattactcactgggtacaatgtctgtcactcaggtgacggaaaccctaaaatccctgacttcaccactatgcaatataagcaagttacaaaattacacttgtactccatacatttatacaaatattttaaaaaagaaaaagtcttgatacagaggcccattttctctaaccaggaaggagtttccaaactacaagtcaattctttctaaaagcacctctctctccttcactcagatctggagacagaagaggatgcctctgggcagccaacccaagcagagctgggcaagcgagaaaatcgccaccatgtcagtgaccacctgctcacccaggcacttcctccaacagaagaccttctgttgagcctccaccctgcatccggcattcctgaacgtcccctgacctgcaccccctcatcatctggcttaggaaccatttggcctctgacccacccatgttctatattcacagacaaaagaatagggagactgtggattaggatcacagggcctctataattaactctgattcacccttcacactttctgacacacagaatcattgggggaaaactcttctgatttattgagggttgagtgtaaggtactgtcataggttagctgtgaaaattcatttaattctcacacaaccccatgagttagacaggatagtgtccccatcctcactttatagacatgaaaataaaaaaatcagattccagtgagtggcatggtcagaagtaaactcacatttggcctctggttgatcaacagttctcagtaggcagcctctgtagaggaattatgtctcttagggataaaactgagatgtaatctcacagaaagctcttgtgcgttttttaaattcctttaaagaaaaatttgtattgatagttcttcccttgatttagggatttttttaatacctggtttcttgaaaagctttttaagaggatctgccaaattacataagcatttctagtttttcttaattttaattctcattatgagattttctcatcaaaaataattcagatagttctaaaaatgtcccgtaagtaaacaatgtcaggaaaaagtgagatatgttgaaatacgaacaaacgaatgaatgaatggacaaacttcagaacaaactatctaactgcagcaagaactgggactggaaacacctaaccaatgacagccccatagtggtttctggatgctaaatatagacaaggtccaaattcccaaagtctaactctggctttatcacacatacttggcaaaagaatgttatcctgataaagccctcctgtctggccatgcttaagtaaatgtcccaacatggactgtcttccacctagctgccaggggaaaatggatcacttctgtactcttggtgtgtagccagactatattaaaaagtccttcatcctgcctcagcaacaaaaagtgcactgccatcagttacgttaaagctgttgtgtgataaatttgaatattgcataatggaggggaaaaaatcaaggacttacactacagctataaaagggatatgtgaagctatttagtcatgattttgtcatggagtagtgacctagacaactcaaattccaattaatacttgaaaagcccttgggacatagtgtgatatgcattcctataaaatggctcttggctgggcttggtggctcatgcctgtaatcctagaactttgggaggccaaggcaggcagatcacctgtggttgagagttcaagaccagcctgaccaacatggaaaaaccccatctctactaaaaatacaaaattagctgggcatggtgatgcatccctgtaatcccagctactcaggaggctaaggcaggagaatcacttgaacccgggaggcggaggttgtggtgagccaagattgtgccagatagtgccactgtactccagcctgggcaacaagagcaaaactccgtctcaaaaaaaggataaaataaaataaaatgaaataaaatggctcttaaaataatgcatttgaattcctaagtatttatatacaacattgcccccttaattttattttaagcaaagaacaacggtatttttcatttagcagttgtgacttgctacgaggaagtctaggtcaatcagccggtttgcagttcaggcaaatctaagctacctgactccactgtgccatgaggaaatgacagacaagagaacgccctacaggccctgaggttttcctggagtaccttccaaaccatggcctgcattgtgcttatgacctggacaggtcaccgcaagcccctgctggtccaggcagtcaagaagggactccacagtgtcttcacaatcaccgcacttctgcctggcacaacggctttgccaagctaccctcttcgtgcccaccgtttcctttgctgctagaaacactcacaaagcaatagagttcttacagttctctgagctccacctcagcgcctgctcataatggaaaacggctgctgccagagccacttccaccctcacggaagcggggtcacggctgcctttgggagtctgatgaaagctgtaggctgtcttctcaggaaagacaaaaatgaaagaaaggaacagaaatgcagagacgatgagagggattccctgacctccaggttaaggatcctcagctttacaaggctaagggaggaagaatggagggggtggtggaaggagaggcagagagggagagaagggagtacggagtgagccagctccagggaccagccactgaacaaagtgctgcccttgtctcagcctggaatcagacggtatgggttctggctcaggctcgagattcccagtgaaagccacaaagttctatgacttcatcaaaaatgttcccttgcccacagtgccattagctattccacgtgaccacaccaatctttttgaccaaatattctctctcactgattaaactattctactacaaattgttgatgcctttgggcatatacaggatggaaatagcttagaaaaaaaagtattctatttaacaaaactttacagtaatcggtacagtccctcatttagtcaataaacactcggcgaccacatgctatgtgtcaggtcatatgccagctacaattaataacaacttaaaaagtaatcatagctaaacacattgtgcacttaactgtactaaacactttacgcatattagctcatttaatcctcacattaatcctttgaggtacgtattattctttcttttccactattcacaatagacaaaatagagctatccacagctagctggtggcagagcaggggatcagaactcagactatctggttcacagtctgtgttcttaatcattacagttcctgccttcaaccaacccacacaacaaggagaaatgtaacagtaccaaaaagcactgcttgtgtttgacagttcgacagtgaaatgaacacaaccagacttgatcattacacgtcgtatgcatgtaacaaaatattatattatacgtaccctataaaaatgtgcacgtattatgcatcgtttaaaaataagttaaatcatagagttaaatttcttagaaaaagaaaatgaacacaaccataaaatatgcataggtataaaatagttttttcataaaaggggaattctgtttgatgtcttattatacacattggagaaataaaatttattatgaaggatttatatagattgtccaatttcgtgtatctttataatatcaaaagttccataaagagaattcactttgagaataaaattattttcaaaaagaatagcttatagatgttaagtgttttcattggttgtccatagtacacctctttatccaaatatattagcatattgcatataaattactttattaccaagaaattcggaaactgagtatacaaaattatcagtttctgtctcaactattttgagatggcagtgaacagactaactatgatttgatgataaactaaagaaaaatatcacgctttgtcgaatataatcaatttggaattgaagaattaattgtgatgcaattacatactttcttaaaactaaaaaaaaaaaagtcaaattgactatcaaaatgtctttagcagaaatatactcacagctctttttcaaagcaaatgtacaaaatctcctacagccccttgctgtccaagagagtcacgtgacgtaaaacatcttcctcatcacctcggccacaccagttcccaattccatatgctcacctaactgcacccctgtccccaaaggctccagtctccctcaatcttacctgccctttatgcaacatcatttcctccctgaggctctttcttggtctttcactgagctcccaaaatcctagattccaaaaccactctcagcctgttaccattcccaaatccaataagcaaactataggacttatgaactccaaaataaatacctgggtccctaccccaggcactctggatccccagctgattctgggaagcagctaaatttgataagccctggactacaccatagaaataagcatttagttataggcatcactttctctgctgtacattgagggaggtgggctggaaagatgatctctaaggttccttccagacagatctaacagtccaagagtccagactctatagctatttcatggatactggtttctctccacacagactccatgcttcttcagagcaggggccacattactttttcactgtccccaagccagcatggtgtgttatgcatagaaggagctcaataaacttgtgactcgtgggtttctatgactgtgcccgctgactgagggtaactagtaagctgagccaggcactgctgtggcagggctacttggcagatcttgtgcagacactgagttacatcttgctccaaaggaacctcccacaaaggcatcaagatgtcaacactggatttactgtggtcagaaaactgtagaaatcaaactctttcaaattctagtataccaaaatacaacaagttctgactttctgtttatatgttaaggaaaccacagaaagccctcagagataatgtatctggtttgtaagaattatgatgcatactgccatagtgtcataagaattcccatatctggctgggcgccatggctcatgcctgtaatcccagcactttgggaggccgaggtgggcagatcacaaggtcaggagactgagaccatcctggccaacaaggtgaaacccagtctctactaaatatacaaaaattagctgggtgtggtggcacaagcctgtaatcccagctacttgggaggctgaggcaggagaatcacttgaacctgggaggcagaggttgcagtgagccaagatcacaccactaaactccagcctggtgacagagtgagactccatctcaaaaaagagagagagaaaagaaaaaagaattcccatatctaagagaacctaatggtgagaagaacgtatcatggatctttttgctggaatgacagtggggtgatccaggtaacaattcaagtccaggaagtatattaaatgggcttgaatctattaccaaggttattctactattgaaaaaagatgtttctagctggccttctggagttgtccaatgcctggctactaaaccttcttaacaagaaaatcacctttgttgagataatagaaaagctaagatttatacagagaaacaacattccacacatttataaaggacttaatagcttgaatcatttctatctgttatgccatttaaacctcttacaacagcccttagagttaggcaagacacacattatctgcattttacaaatgagaaaatgaagctttggagaaggtaaaaacctaccccacagtggagctgaagctcaaccctagggccttacacttcatcagtgaccccctgaatgagggattctatagaggcagatgtatgatgtctggccaagaaagtacaggtgtgggtgtgtgttgtttactgtattttgcttgttttgcttttcatctgaatgtattgaagcaaggtagtagagcttcaaatggaccacaagccccatcacatccaactgtgatactgtttcagacatttatttggtctacttggccctgaaggtatttgaattttttacccctgtgctaaataattatacttacatacttatataaataattatatcttcccatcatgtaacatcttatgagcatattcactgcatattttatttcttccttataatcctgtttactcattagaggactaagctaaaaaaaattgaatgacttgcacaagatcaggacctaaaatctaaatgtgtcatataagaaattacattatgtgagaatttcttaagcaggtgtcaagttaaaattcttcagaaaatcattacataaaagtttctgaacttgagtactcaagtactcaaatctcttttgagatttgattattcttacttacaggactatcattcagagaatatgcagaaacaatgctttcgtgtttccatgggcatgtcctgagaaagtcatattcctttatttttatctcaagtgttcatgaactttcattatcaaagaagaaaataggcaactgtttctgaaaaaggaagtcattcaacaaaatactagcaaaacaaatccagtgatatataaaaggattacataccataaccaagtgacatagtccaggaatgcaaggttggttcaacatataaaaatcagtcaatgtattaaagtatataaaagtatattaatagattaaagtatattaaagtatattaaagtattaatagattaaaacccatatgaccatctcaatacatgtagaaaagcctttgacaaaaatcacacatccttttgtgcttaaaaacactcaacaaactaggaacagcaggaaacttccttaacctgataaagggcatctatgaaaaaccaacagataatatcacactcaacagtgaatgacaaagctttcctttcaagatgagaaacaaaccaaagatgtctactcactccactactatttaacattctcctggaggtcctagccaggccaatcgggcaagaaaaaaaaattaaaagcaaccagattggaaaggaaaaagcaaaactatctctattcacagatgacataatcatgtgtatatatataaaatcctaaaaaatacacacacaactattagaactcatgaatacactcagcgaggtcacaggatacaaaatcaatatataaaaaagaaagtaaaaatatcagtgatccatgttaccatcactaaataatcactggcacctaaaaagcttcctcttttagttttattactctcaacctgggatatagaaatctaaaatccagagtttactttagcttttaaaactatctatgatatcaggttaaaagaaacatttcctggcagatgcacagctctggaaaattttgttttccaaacgtctggaaaacaaaaggaaagcttcctttgtttacatagccaagaaggttgagtgatgagaatcagaaaagattttgaagcaatacaagatcttctcctagggccattagagatcagctaatctgttcaagttttaattctcttctaatgggtttcctcaaagtactttacagcagttgcaatcagttccaaatattgcatcgtgatactcacataaactggaaagtaacggctacatttccatttatttcatttatatttttactttggccagtctcgtaaagattttaaaaaccattaagtacttcacaatattggtggggactgtttccttcttcattttcattagaataaacacagaagtggtatctatcctaataatacagaacatgcttcttaggtaatataaaccaaacacaaatagaaagaagcattgttatacattttaaaaaagtgttacacttatttttctgcaggcctgaatacagaccctgcctgctctaaaagtcacgaggtataaagtgtgaacctatgctctgggggctcctgataagttccaggaaactcctttcacagcctctatctcagggccacatcaaatacacgttcactcactggcctcaacagtcgattatcactccctatttatttgtaggttcacatatttttgccatttaaattttttcaaaaattaaaacctggctcaagttacaagtaaagcttgggttaaggaaagcattcatgaaacactttgttttctgtaaatcagatagtttattgcctggttcccttccaatatatatgtgggctttactctccattcagaatttgattctaatttttaagtggcaagcaaagtcgaattattaattaaagaatcaagacatataagtataccttactctctacatggtgaaggcaaacactttcaaagacaatttccctaatattttaaacctatcacatgaaaactttagccctttggatggaaacatttcactgactttcttcatcagtcccccttttttgccataaaaattcacgagataataaattccagtaaaaagaaaaccacacagtaaggcacagatctttgatagtataaaagaacattatctaatttaatccccataacaaatcagtgacagtattatctcatttatatataaggaacctgaagctcagagatgctgagttactaaagatggcacagctagtaaatggcatgtcagaatctgaacccattgctggatggctctgaaccctttgcccttcccaacattaattcgtgcctttctggaattttgccagccaagtggattttttttaacctaacttaaaatattcaaaaataactaacgttatttaacgtcttattctctaagattttttaaaaaaacatttaaagttatttttgtcatctgttttaatatgtcccaatcccttaagctaagaatctatcatttttactttacccaactatctcgtgatataaattaagcctgtttactctttccaggtcactgaagcaatgcttctttctagaattagagtcatacaactagaagagatggtctgactttgtacagaccatttgtacaccatgtgtagttccatttctaagaagaaacagcaaaatgatctacatgaaaaaaaaaatcaccttacaatttcagatgactttcatgaagtggttttataaattgtattgctgtaccatcattattgttattaatgaagttacatttaggtgttatggtagatttgaccagatgtggcaaacagttgttaccattgtcttcatccataaaatttgtcaaattagaggttttatggagtatacaactaattgcaagaaattatataggcagtgtatttttaacattttaaatactaacaaaaacagcaggacttaatgacagtgaactacagacaatccatgcacagtgaagcctgtttaattagaattccactagtctaaaatctgtaatagcttgaacacaatatactattcattctgagtttgaaagttcaaaataaatctcaagatgtttttccatatatacctcactgtacctgctggagaccatttacatacatacatacatatatatatatatgtttgtttttgagaaggagtctcgctgtgacacccaggctggagtgcaatggtgcgatctaggctcactgcaacctctgcttcccaggttcaagtgattctcctgcctcaggatcccgatgagctgggattacaggcgtccaccaccacgcctagctaatttttgtatttttaaattttgtatttttagtaggcagggtttcaccacattggccaggctggtctggaactcctgacctcaggtgatctacccacctcggcctcccaaagtgctgggattacaggcgtgagccaccacgcccagcctatatcacatatattttaaggtcgcatgggacctcagtactcatgccctctgattctgtcattaagagatacatattacaggatagtggtgatgtgtaggggctctggagccaggctacctgcattaaattcccagctctgccttactaactatgggaccttgggcaagttaccttgtgcctttgtttccttctctataaaatggggaatagtagaatccaccctacaggtaatgaagattaaaagagataatacatacctgtgaaaggctcaggacacttcttatgtgtaagaaacacaacaccctgaggccagctggcctagatgtctttccaaggaaaatctgccatcaaacgttaggacaacatcgtgggactcctgtcttttctatttgaaaatagtttttaaaaatccatttaaaacagcccacaattagacaagctcactaatttttcctggctatgtaccttcaccaaattacttctcaatcaaaattactttaaattacagatagtatgacatagatgtatgccaaaggggcttatgcggacttttaagtcatatattcaaaaataactaggaagaacctactagtttccctttacaatctgatgtttcatattaccctcttctttgtagttccattctgtgaaacttccatttctcataggtattttgttaaatatcacccctacccacaaggtttatcccaaagtatctacacagattccaccctcgcgttcttcctctgattctgggcctggcctgcccacatctcctctgaggccttcctccatcagtttgcccatctttcccctcaagagtgggaacacgcatagccgccctcccacctcccatccattctttcaccctcactgccaactccaaaaagcagctggtcacagaccccactggctcatggcctcgccctggctgatctttccttttcaaccctcttcaccggctgctttccctcccactacaccgtggtgcctgcagcctacttctcattctctcctcctccgccctagacaatcttgtccaatctcaaggctttcaccagcacctgtatgctgataacgcccacttatttccatcctgaccttttccctaaatgtcaggatctttagtaaacttcctagagacaattttatcttcatggtccaagggcatttacacgcaatacatttaaatccaaagggttcctctttccccactcagcttgctcttcctcctactttccctatctcatcacacaagctagatagcctcaaagcaccctcatccccttctacccagaaaatgagtgaatactgtctgtgtcatgcccccaacagctctctactccctctcctcctctccatcctcaccggcccaggctagtcagccctcactcctcactgacctcctgaccttcagacatggcctctcacaaccaccagactcatccatctatagtgccttctagaaataataaaaaaatgcaaacgtgaccattttgctcccctgcttaaagccctcatgcaggccatcacctactggaaaatgtttgagctccttagaaagccatgcaaggccctctgagagctgctcccagctccactgcccaacctcccatcctgccattcccaacctgaatgccagggacctgaaactgacctgcactggtcactgctattgttcacaacttgctaattttcacctctttgcctttccttacattatcgtacctgccatatccctaccccgctcccagcctggctaactcttatccttcctttaagactgcaatcagatgtcactttctctaggaaatcatccctaaaataccatgctgagtagggtacccccgtacatactccacaggatttggggcaggtaaaaagtctacttagactaatgaaataatctgttcttattaccaggctaaaatataaacatatcaagggctagaaatgtggtctcttcacttctgtgtctggctcaataaaaggatgctcatctcaacccagacacctagaaatccagaggaagaaagttacaaagagcagcttcaagccctctatactgtagacggattgcgttacattattatatattttagggctctaaaacattaccttttttttctttctgagacaaggtctctctctgccatccagactggagtgcagtggtgcaatcatggctcattgcagccttgaccttccaggctcaagcaatcctcccacatcagcctcccaagtagctggaaccacaggcatgcaccacgatggccagctaatatttctgtagagatggggtctccctatgttgcccaggctggtctcaaactcctaggctcaagtcatcctccttcctcggcctcccaaaatgctgggattacaggtgtgatcagcctgtaccaccatgccttgtctaaaatattacttttgtcctgctgaggaataaaagtaaggaaaagaaatcaatttatgtaactaattatttacctaactattagaaaccaacataccctacttcctctcagactccaaagaattttctcaggtgttccattcatattcaaagattaaactctacttattgaaaaaaattaaaggaagtcacttacaaggattggttctcaaaagcagctatgccatgttctggggaaggaactaccttcaatgaaaggaacacaaataagagagtcctggtgttacccgctgagctgtcctctcctgcacgtagacatgcttctgcaaaaaactcagcaggctccaagtcaaactctgtcctgggctctacaatatgccgccgcacgtgatgatcactggtgctcaggcagaacggactttatccacatcactgtaacctgagcccagacttcatcctagacagtcacacagctagggccacaggtggcacaccatggtaaaaacgtgagaccatctgattatccatcaaaacagagggcctactgcacatagacatagatgtgagttggagtagtgtggtcttcccatttctgatgttgccatctatttcctcgagatgacagacagctcatatattttgctcaaagggttgctagagctgtatcctcctttaaggtgaatcctcatttctactcccacaacagaagtggtcctcaacctctttggcaccagggaccagttttgtagacgactttttttccatggaccaggggtggagagatggtttcaggatggttcaagtgcattacatttattgtagacttcatttctattattacattgtaatctataataaaataattatacaactcaccataatgtagaatcagtgggagccctgagtttgttttcctgcaactagagagtcccatctgggggtgatgggagacagttacagatcatcaggcattagattctcataaggagaaacctagatcccacacatgctcggttcactatagggttcatgcttctgtgagaatataatgccagtgctaatctgacgggaggcggagatcaggcagtaatgttagcaatggggagcagctgtaaatacagatgaagcttctcttgctcgccatccactcacctcccactctgcagcccaggtcctaacaggccccggaccaatattgatccacagcccgggggctggggacccctgcactccttaacagaagaggggcctggcaggatgtttcagaaagtggaaggaagtaaacatttgaatcttcggcacactgagaaggcctggcaaggaaagtctacctgcttcttcccaggatgctctgagcttctattttagtaaactacagagtctatggccagtgaagatacctacttcacagcctgagataaagtcctcggcctccaactgtagtttctacctcagcagttctgagaaaggacactagaagcctccctgccatggaatatgattggtgggacaagaagcaagtgggccatgtgggcaacctatcttctcaaccaaggcagggtcccagggcaaaagcccagacaatgcatctaaaggtcagaacctacctgaccatcatcagtagctttttctattcttaaggaactcctgaatgtcgcttcttgggacccaacagagtaaacctctgagtctgacagtcttttttttttggtgtgtggtggggggcgggttgtctgaatcacctgttatttgtactatttattgatagtaaactgtattttcttaaatgtaaaagaaactgtattaatttgatgacactagtactgaagcaataatcaaatacttgcttatcttactacgggcctgacctaccttcaggcttgagggcaactgttttcctctctcctcccccacaatctgaaggaagagttagaacagtggaaagtaatgttgcatattacaagaaatggttaaacacaattagtcagatcatataatggactatgacgtattaaggcagtatcacggctaccaggagtacagataccaactatggccccaaataatgctaaacactattgcaagaacttcatccacgagttcacgtgtctcaagactgcaagatttaaatttgccctactattcgtgaaaattcacctttcttttccaaatctggaataccccccattgtttaaatccagtctgggtttctcttgtcagtagcagtcttcaatgtctacttcagagaatgaaaatgtgtgtatgtgcactcatgtgcttatgtgcacgcacacaccctccttagaaagataaagtcaataaacttcctgtcagtatcacagaacatgcaaagtcaattgtgcaacatttccttgcattatccatcctatatgcaaacattctaatgaaatagaactggaaattacacatggaaactgcagctaagtttggccacctaatggactcagggtactccggtaacggcgcagagagaagaaggttggccgagcggggatgcaaggtccccaactgaagtatctgaaacctactatgggttccacgtagagtcttcagttgtgatttctcgtaggacactaggaaagttgcaatttgcagctatggccacggggtagtgcaataattctgcaaatagctgaccccacccccaacactcccatccccccaaccccagccctcccaaagacagaatggctaggagagaatggggacatttggtctgaatcctgggcatccacaggggttactgagagattctccacaaatccaaaagtgtctgtaagactatacagttactctcagcattcgagcccgatacaacagaaggtcccgggctttgaaggaatgatgagaactgagaggctataaaaagtgattagcctatttattacaaattgtgtttacttaggtttttatgtttacttcccaccatatctccaccagaatacaattaaccaccccctcactcatcagaattgtattagaaagactcacaaaaataaaataaatactgcatctaaacgcaaccgtcaagctttatggaactgtactgttattacacaaaggtgtccccaaaacagggagaaggaaatgcaaattttgaaaggtcttcttttcaaaggaaatttttgtccatttagtccttacaagtcaaagtttggtctgtggaccaaaactaatacttgggagccagttagaaatgtggactcctggttctattagattagaatgtgtattttaacaaggcctctagattatttggatgcacatggaagtttgagaagcattccccgagtgagagctaagcatactgacctatgctctcaaaactattttctacaccctgggtcttttcttcttctacaagcattctacgtgaaaacaaatatattttgaaattttaaaacaaaaacagattatttcccagaactggtggtgatccactacagtaaagcctcttcctatctaaattgccaggtaactaattaacatgtcaatgaacactggctgaaattctgttctgtcacttcataacgcaggtaaacagtacagatatgagaagaaaaatttaagaccaacagactcacatcatggtcctctaggggattttcgaaactaatttcctgcccatataaaaggaaaaataaaattatttccagtatcaagttaagcacataactctctaaatggagttgctatgttaaagtggtctccaaattacagtcatttttgtttacctccgctaacaatgagcctcctgggaagaaattatgtgaagaagtttaagtaccctctatgcctttctccacaggtgagtggggaaattgcagaggaaaaatacacaagtgaatacaattaatgacttctgcactctttgattcctgctaccctgtgaggggaatgatcatagaattttgaagctggaaggaatctcggagatagcctattgctgccgctctgcctacccaggaatgtctttctacaaagtcaggtaattgttaccctttgagacagcccacatcacatcactgttaaatgctctcacacccactgatcttactcgtgcccttgagcaacccagaacaactctattcccacttcccagctaaatgccttcaaacacttaaggcccctatcatatcccgggtggtagtttccttagattgaacccatttagttccttggattgggtggtgtcctcttactctgatataaacactgtgtattttgtttccagtgaaactaaattatgattagcctgacataatttaatgagacccacagtgccaaatgaagtcattcgatgtaatggttggtaatgcaatacattctcagtgaaacataaaagattatgtaatggttaatagatctacatatgtgagtagtaccaccgtaagtaagagcatatttgtctgctggactatgatgcacgactaagaaaagctaccaacctctactcaaaaccgtcccagggtcctgttgccagggacagaacgctgcaccgcatggactgctgaatctgaccttatgcggcctttctgtattcttccttgtttatgaaaaagagacatttttaagaaagcaaagggtatagaagagctacatttggcattcagagcaattgacacttttattacttaacatcacaaccttatgaggtaggccagtctaagtgctgtcattttataagtgattaaaccaagactgagaataggaaatgagaaaaatcatgagctgcccagggccaaacagaaagcaaggttggggccagctgaattcagaaacctcaattaaattccaagacaaaagggaacagccaacattgaaaataagttttatggatttcactttgaaataaaacaacaacaaaaaaattatgttaccattaaatgatattaaaatcgtcttttatggggcctcgattttgccaccaaggctttattcccaaaaattaaaataaaaaaaaaatcaaacaggcaaatctattccaggttaaaaattccacttacacacaaaatcttgcattccatattgagaggtttttttttcttaatttgcctattaatctgtattaagccaaaggtcttcgttcaagttgctcaagtgtcattgattagacccattgtagttaacaaggacattctcccaaaatagattcttagcattttaaaaccctcctacattttcacaaaagagaatctggaacacaggaaggaatcatttccccacacacaatactcatcttcatcgtcatccagatacatttggttaaaaacctatccacacattaaggtgcacactccctgggttcctcctccctggtatcctctggggccccagcccagctggagtccccaagttctcggcgccctgaactaaccagtctctccacccagctttctccaaaacacaccccacacgagggctgagctcctccacagcggatgcaacactccactgcttcccatcgaggccccctgcctcctccaggctgatgagcagccccttccccactgctgcccacagccctagccctggaagcctctcttctgagaaggctttgcctcctcgtacctgccgaggcccctccaggcccatgctgagggccaatgagagccacgcagtcaactacacggtgaccttcggccagtgtgagtacacgcagctctgcagagctgctgtctaccaatcagctccaggacacctggggctcagacaggtgcactctccttctgccctttctttgtactctgttttgacccataaggactgaccaaaaggataggaataggccttaaaatgtttgctttactgcagctggaggaaagggttagaggcacctgaaggtcaagatcagggatctgtagcattttctggcactatgaagtaaagtctaaaaaggcctggaggaagccgcccactggcctgcgcatgccccctggcagttgatttgaagacaagcaaaagcatcagcgggcactactaggcagcatccttagggagactaaactgctagtgcctctgcatccctccctgcctgtgttagcctaccttcaccaaacaagatccacactttattccctccatgtttctattcacagtcttcccaccacgtggttttcctcctttccatttcctcctgaaattctactccaggacccatttcaaatgccaccccaccatgaatatcttactttcaacaggatgtgcccatgccccctcaagcaggcagtgtcagccttggattacaggtatttatgggtatggcttattctcctattaagttcccaaaaaacacactgtcctttgcatcctgtacagcagggtttcctaaactgcaggtttcagcctatgaatgggaaattctaaaaaaaagaaaaaagagaaagaaagaggataggaaatatccaagtgtatcacacatagtaataagcgttatttcatgatgctcttgtttcacttacgtgtatgcatgttcaaggggtggtgggtggcagtgttaaacgtgtatttgttactgggggtcatggtctgaagcatttgaaagtcactgccctgatggtacctctcctctgtctaatattctgtgaatgcttattgaattgaacaggttgatgagtatgaaatgatccatgtattataacttcaaaggctccaacttaaaggaatataaagaataatgcctatctgaacaaaagtgtgtggattctggcttatatgaagctgtggaggaatggggtgagtggtagggaagatcagaatatttattatactgttgtatgttgatagactttctctccaatgattaaaatgtgttaacatttaaggaagatgaaatacaagttcattttggaaaacttttctcattcactgaaactacctcatgactacaaagttctgcatctttaaaagagacagtataggtaattccaccatgatgcataaaatgatcttttagagacaccatgaaagcccttgttcaagttttctttgcccaagatgtctccatgtactctcaatacccccacccacaccatctgtcttccaagacttagttcaaaggccacctatttcatggaagcctttgttttttaactcaatttttcctctttccatcctccacccaagtcccaaatatggtctcttttctgaatcaccagtgttgaaaacttcctttttcatgtgtgttcttgtcttaatttcctcacttgacaataacactaatatgtacaacctacgccttactcatccttgcatctcccacagaaaccagcacaaggtcttctacttaagagatgatcaacaaatatttgttaaacgaattaaatgaaagcaacagttagcctgttaaaagggatggtcattattttaaaggccctgaggaatggcttatatgtctagcacctaatcaaaagctggtggaccacagaaggaagaccagggagtggagggggcagccttgtgcctctgcatatctgctgcccctgtaaactcacggaatgcccaactcttcaagactctacagaacaaagctacagtgttgggtgctgaatgaacaccttaacctttttccaagttctccagtcttgcttcaaaccagaaattggaagtggaattagaggtggaaattagggccatccttttcaactttaaggtatggctgaaaaagttgaaacagccatctggataattcaggctcaaaaaacccatcctgaagagtaagtatggatgtttctgagtggcaggaagagtgtgcaagaaggcaaaggaggtagttgtgaattatcaattgattgtgtatattgattatattcaacagaactgagcttttccctttttattttctataaggacactctctgtgactgcaagaataaactagctcagattcaaagccacagtcaccactaataaattccaatttgttcaattggaaaatgatgtccatcaattagaaaaagttcttagggattaagattctcttttgccattaatctgtacctcctccttcctccttcaaaaaagtttttctatgatcaatcaaaggaagaagttttcaatggtctttaaaatgtatattgctctaatacaataattcataattaacaggtatactttcctaactatggtagtttattttcaaatttttaattttaataccatttagggctctctctctttgttattttagtaggaccttaacttccagtccatcgaggttttgttttgtaattaatttcagagctgtccttataagctgagagatatttgaagtactctagaaaatggcaattgtctgaccggatttgaagtcagatcactgggctttgaagctaatttctggttgaaatatggctgccccatttttagatgtgtgactctgggcaggttaccctatcttcccatcttcaattttcctatctttaaaatggaactaataacagtacttgctttataattaaatgagctaaaacatgtaatgtacccagaacagtgtctgataaataatacgtgttcagcaaatgttagttttaaaaagtctgctgtcatctgttttatgacctcagtaaagtcatttaacagttcaaagcttctatttcctcatctataaaatggaactactaccacttacttaccctttccaggattaagagattcaaataagaaaacaatggatatgaaaatattggacacacagaaagttctcaaatattagttattttgaaccatctataagcttaaaagtaaccataaacttaaaaatttacgtaaaccataaaactgagaacatagcatccaaaaattcatctgtgagaaaatgtctaaacatattagaaatgcatactcaagcttggtttttctttaacttatcagaaacatataagcttttgtaaaatgtaattctacatctgcaaaactagaaaccctcccggtcaagccaaactgtcctagtatattgtgatcaagaaagtctacatgccttcataagccaaaactcgatgcactgattaaaatgtgattgcacgtacatcaactttttaaaaaacgtgtaagtttttgttttttttaaagtaataaatgtactgctaatgtaaatttcaagtcaattcaacagatatttattctgtgacactgctccagggtaattcagctgggaactaaggatgcaaaaggaaacagagctcaggttctgtgcaggaagaccccacaaattacgctgataatctcaaaatattacttatgaaagtcataagggggttcgctttgagtcagcaagcagacaagcagcataaaaatataccgaaacagtaagttcttccctttgactgaaaaactgccttttaaaagcaaacagcattttaaaagtacagttgctatctggaaagctattgaatttgcgccagaaaccaacatttctaaatgtaaacctataaaataataggtatctgtaaatgaaaggctgaaataaccccaggagcagcaacacagtaattagcaacttttacacagtcataacatgtttcatattctttctgccctggctctttgaagtttccagtgcaatacgtaaaagttttattacattagggcccgtccttgtgtgttttacaggcaccaacattatgcagagcaagctgtacttactcatcataggatcttttataagaaaccgtttgataatgtgctagctttgtgtccagtttattttgttacacctgtctttaggaaaataaaagtcactggaaacctaaatcacagaaaatacacacagatccacatatcatctatatgttataaatcataaagcagtttagctttaaaattgtacattgcatattcatgtgcacaccacttgcagttttagacacatgtgaactctttactgaattaaagcaaaaggaaaaaaaaaaaagctcagctctacaataagcgattaccagaggcagaacagagtgcagttaatatgcttgttccagcagatgttcatccccgtaaatattaaacataacacaagttcctccaggaatatgcaggcagtaattttaccacctgaatagtgctggttggaaacatttaagagatagtggggggttggggggagcagagaaagaagggggaataagacagatactaaagcagccaatgggatttttaagacacccgcaactggaattaaactgcttccagcggcgatttacctacagcagctccccagtgtgagatcccccgagaaacggaacctggagtgccccccgggctgcgagctgtgagcgtggcataaagggatacccggggcgcccgggtggggtggggaggaggagtgcaactgtgacgaggtgtgaagaaagggcccagaggaactgtgaaccccgaggaaaggagtctccctgggctaaggcctctggaataccggcacggagaaacactcgtttcctgccctggatgttcacttttccatctcggtggaagtgggtgggagagacagaaaggatgcagccgagaccgggcgcaggcggggaggctggagcatcctctaagggcacttcgcagcagcaccaactccagggggtcggtggtgccagccggaggagggagggggcgcagtcggagggaaaggaagtgagaggagcagggggccgacgggtggatccccaggcattagtgacacagtcttcaaatcgcttcttttcctccccacggctgcgctctgcccctggctacctagatcaccagtccctgggctggggcgggccgccgcgagggaggggaacaggagagggggaaacagacgggcaggcggccacgcatcccacccggggaggcagaaaagggctggcgaggcaggcgcccccgacccaccccacccccacggcggccggccgcccggagcccccggcccaggtgaggacgcgcgggccgccgcggccgcccctcgccgctcccgcccgcccgaagcggccggcacggggacttaccacagtgactcgaggtcccattcctggagcagggctaagtcgaagctgtccatggtgggaggtgtcagcgtcgccgccgccgctaccgccgccgccgaggctcgggccgcccgcgcgctgcaacgaaaggcgccgctcaaggtgcatcccagccgcgccagagcggccgccgcccgcccaccgcccacccccaggtcggggctcccgacgccccccgcccccgactccgggccggccgggctggctgcagcggccggcgcactcacccgctccccggcttgcgcgcaggcacactcaagagagagcagcgagctcgccgcgccgccgccgccccccgcccccggccctgcgcccgcccctcctcccctccctcgcggcggcccggcccgctgctgcagccgccgccgccgccgccgccgccgcggtgctctgcgcccgcccgcccgcctctttctcctccgggaggcgcgtgtgcgcgggcgaggccgaggcgcgcgcgcaccgtgagccccgcgccgcgcccgccccgcgcgcccctgtactccccgcgccgctcctcggggtcccgcggcgctcgcaggccgcgccgccctgccgcccctctctcgtggcttttacggcccgcccgcccctcagcagccctggggtgcccggggcggccctgcaagcgggagagagcggcgaggcggcggcgccgagtgcggggggatgcggagccgtgcccggccctgtcgcatccctcggccgcccgcccgcgcccggccccgcccggccttgcccgggctgcacgcacttctcccgcggcccagaatccacttgaccctgctgggcgctcccgcgggcggcggacccgggtgggtgcgggggaattccccggccgcccaggcgcggggagagtgagctgtgccgcccgcagcagcgccccaaacaaaccgtttaaggtctctggagcccgcaagttcagcgaaataaagcggcggcgcggaggaaacctcttccacccggacctgctctccgttgcggtttggcctccagtggtggtcccacccaccctctagctggccagccctggaaaccaacctcctttctttttatttctcaccgggaagggggacaaactggcctctgggtgtcgacttcaaacttgccgcccgtctccggtctggaaaggcaggtgatcagctagaagggtgataagagtatcatcgtggctcctaaagagtaataataatctccctcattgtaaagacagctcttccccctggcttacttttttagacatgctgagaagcgcatgtctccatcagggccctacctctgcttctccacagttggcctagaaccggaagcccctccaaggccccctgactctcctgacctcttggccacagctccggattctcaccagggattccccagaattcctagagagcagctcagagccctgcagttgtgcctcaccacgcgaaccaaacctcgcactccccgccaaaagggagtcccttccagcactctcccctttgttcctttttctgggcaagaaccgctgactggggctgccagaaatgtaaaccctgggtgcaagtgacgggatccctccagcgtcaagccgaagagtcatcctctcacctcacccacctccgaatgaggattaacaaactcaattcaggacacaggtagaagaccaaaaggccaatgagacttctttcctatttgagatcggatttgagaatgctcagcctggctcccttcttcccccagctctgaatcaatcctttcttcattagcatccataactaatgtgcaaaatgtaaaacgctaaattaagacagagttggcatcaacatagtctgagaaaatgaaattgttattttacaagctgataactctcagccctcaaaaacccctctcattagctgaaggtagcaagtagcaagaagattaggtaaaaacatagagaatatgaatataggaaaaagtacaggtgtgaagggctggctgcccaaatcccaatgcacagtgtatttggaaaaagaaaaaaaagaaaaagaaaatctgtctttctaatatccccttagcatacgccttgttggaaatgtttgctttggcgaaagtgagatcgagacattgagacagcattcccaggaacaaaggctgggggtggagggtggaggagggagcaggaacagcccctgtctggaagaactgcaagttctgaggcctgaacaagaaatgtgtcctgttcccgtgctcctggctgcagctgggaagcttcttcagaaaggagacctcccggccctcaccgggatctggctttccttcccttcccaccacatctgtttatacaaaggagggccgctgaaggacaaacataaccgtgtttactgcgagtcccatgctgggcctggagctcagatacagatttgccctcaccatggaggctgaagataaatagatgatcccagaaaaggaaagagggaaggccctgggatggtatagagctggttgaggggtttactcatgaaaggcctctcccaaaaagccatgtagtaacgggcagatttacgtttgaatttaaactctggtgccttgtgttaatatatgagagtgtgtgcacctaaagcaattgcaaggcgggtatttaaaaatgtttctttaggaatagccatgattttctgtttggggcctctaacatggggatagttggattgattatttccagtgttatgttttcatgtaatagtgtcttggagaatgaggacttttgaggaaacccaaatagtagttgcagatcctgttttttactaagctgtcatggagataaatccaaaatagtttttacaagtaaaatgtagaacagttagtgagagcctttatgggagatctttattatttatctggtttatgaagatgttcctattatcctccagcctctgggtatgcaaaccaaaacaagcacttaatctagttgtcaaaattttaactccttaatacaaagcaaaaaaagggtttggacttttggggattagaatgtcagaactaaaagggaacttttttatgtaaaagagaaagagactctctaaaaataaaaatgttagagtgatgttttctatgaagctgccttagcttttgctcatcctatagtgcttgtgacctgagggtcttttctccccacatggatgcaagcaacacccctgggagctgaatcaaaccacccagctaaggggagggctgctgggggaagctgctaaatgagaggagctgcttggcttcccgggtcaggttggttggttggtgtagactaaatgtaccaaagaaagggactaacaaatgaatcctgctcagtctggggccctactcacattctgccaacctagtgctggaagcctcctaaataaatccagaagcaaacctatagcatctaagatctcccttcagatatgatttgatagaagagaagccttgcatggctttaattcatgccttatcctgaagacgcagctgcaactcagaggtcatttttgtaaccaagtgggattttttttctctctttataatcccaccattcccctagaaaaatatgtctggccaaaagctggctctgcaggtggtactgctggaaggtgataggagcatcatcaagctgcctcagcccctacagcatctcctccagctttgtccctaaggacactactctctcctgttccagcaaagctgcagacgcatgactccatctgcttctccttccagaggcttcttgggtgtttgtaactgtatccagggattgcaggataaaccttctaggctttctccttgcaaattacatgctaatatgttgaaccccaggacagcgtagattttagatccacccaggagttcttgtgtcttcaggcctttccctctctctccacaggtatctctgagtggttctaacctaggattcgaggtgcctttctttctgtattttttcatcattcaccaggtcccgagcagatggtgtggctgtgctgactgtcatcactcctcctatgtttccatggaaacatggggcatagggaccatctccgccttgggctctctgacagtatcctctggcgaagaacttcagtacttgtgcccctccccccagcctgtccactgtcctagggagttggagacctttctggggccctagaagccagggtcatttcagagatcatctaaggacatactccctgcaaatggttttgaactggctgggaaaaggagggagggtagaaagggggccaataccccggtcgagggctgagaactgttttagaaggcaacatatttggactatctgtccctgcagccagcttccataatagctgattattgcccagatgtcaaaagagctgctcctagggttcagtctgctcatcagacaacagatatttattgaatgtaagtagttgctgaggttttatgcttcactgacattctacaccctgggaatgagtgtttctgggaatgtgcatttctttcctttttttttttttttttttttttttttaacaaaaccaggtttttccctaaggaatgcaccttccccaaagtttcccgcatcctcctgcctacataattcacttatatagtcactatgacattaattagattcagaagtctgtggaaacagcagagctcggcagggtcagagggcaagcagggcagagaaaagagaggggaaaatgagctccgggagaggggaaggaagtggagggaagtttttcatgcccttcaagtaccaaacaaaacaaagataatttcaaaagtggtcagccactataacactgcttagagaattaaagtattgacaaattgaagagtgctttaaaataaagtggatggggcataagcatgtatgtcttggtgttagttgctccttatacagccggtactaaaggctggtgggtgaagcttaccacattttaaaaagaaaaaggcaggcacacatactaaagttgaaaatgcaggcaggaaggacatttacttttcataaaagcggatcagaaaagcatctcctatcacagatcatgtattttatgccatgctgaccaatgttgggggataatctcattattttgtgatatgagaagatcctttgatgctggtaacaagaaccaatcatcctgacttaaatcttaatatccccacaggttctttgtcatgcttcttcaagatgtgccctggccattcatgcaagtttcaaggactctgaatctgttgagaataggacataactaatcgtatcattagcaaacatgtctatattactgtcaactgggtgctgttctaaagtatcaactccatttagtcctcccaaaagcacatgaggtatgttgccattgtttttattttgcaggtgagtatgctaaggaacaggtaagtgtcacaaacccaagcatggcagatcaggaattggtatggtattactggtagctgtgataccatactccacctcccacaacttttgccttaattatctatagcattggcgcattctcatgctcacaggcactgaaataatgaaagtaatacagtcccagtcggaaggcgagagagagccctctacccctctctgcaattctcctgccacccagttttgccccttgagttctgccataaccgcacctggagtgaggcgctccttgtctctagcctcaacgtcttcctttgcaacatgagaaggctggattgggtgttctttgtctctgtcagtttttgtctctgacagttctgaaatgttagaggtctgtttttttcagttgttcttcctgagcactgccagacaggaatccctggagtatgtcaagagagtcataaaccttttcttgtttaaaggtaggacctccttcttggcttaaacaaatctcaaggtgttggtctgcttcaaacaggagtgctgtgctatctgtgaagtattagcagacggcaagaggaatgtgttcaggaagaggacacttagcttaggtctgggggaagcatggggaagaagtcacaacacaactgtgggtgtcaggctcttttctctggggcaccagagagtattcaagcatggattggtagtccccatgcagccctcggaggaaaccgaagctgcaaatgcagcaattatggcttacagcctgaaaatggtgacattccaaaattgcatcttaatgggtaaaacattggtggagaaagggcagcagaagatccccacaaggtccttcaggtacaggcatctcccactgctcagagtcctgctgggggtccccaagtcccaaacaagaagaagcagagagcagagttcacctcttcaggagcttaagataaacaagttcatgcagcagacacggctggctgcccacccaacatccatctgcacttgtccttgatagcaaaacctgagtctggtttggggaagtcacaagcccagctgacataactgtattttctagtctctcttattgcaagaactgggcatatgacttagttctggccaataagacacccgtttatgtcagtcaggatttctcagaatgttttgcttccctgcagtagacaccaccccttcctctaggtcactttcttcttcctgtccagaaaggtggagaagccatcatcaattttaggagcaaaagccacagactaaagttggcaagtctgaagttaaaaggaggctaggtccttgatgactgcttcatataaccctaccatctttggaccatcctacccagatctggacttttaggaacaaaataagaccctatgtggctaagccactctagcggtgttttgaatattgcagctaacccattagagaagtcacagtcccttaaatgtgccccgcacattgccgtgtatagtcaggactaccagatatcccagcctatatgccccaatgggggcagcactgccaaagaattaagtgtgatttacaaaaacctgtgattacttccttacatgtaatcttgactacttctgagttcactccaattgtaagcaagttaattaataagaaactcatgctcaattgtctgaagactgattaatctggctccagcattttttgaatattccatattatttgtttctttattttcatgttatttgttaacctggttaagttgctgtgacatcctcacagggataccaacagatggcatttacgaaaaacagtgtaggaataataatagtcagcctttcttgtgtccttgccacatacacaaaaatatgtatgtttcagagtttgtcattgtttctaccaataaactaattatcactgtatgaagctgatttacttcagaagaagtttacgaaaacaactaattaagtacagtatgttgaaatataaactgcattacagggttagaaccctataataagatcgcagaagcttgaaagttgggagaagccatcaagtctctctctagctaacctgctacccattgcagcagttccctccatatcaaccctgctatgggcagtctccacatgaatgtttccagtggtggggagtgcgctctctgaagagcctccctgttttacttttcaagggctcagctctagctggaacaacattcttccttatatttatggatcccaaattgatttccctgtaccttcttaacatgtcacaggctcacagtaagcatgcaattagagctcagctttgctgaactccttctattggtcctccatatattgagacttacgggctcaagtatttcctcagcactttggtaagtgaaagagcaaagaaagaagtctttgctcagtggaataccatacagagagggcgagtcagtctcttaagaggagcacatggccatggagatgagagaaaccccaccttcttctaatttgtagttggtttcttggaagaagggagcttcataaagaagctagagctggccacaagaaggaaaatgcccacaacaagataggaggcaggaaacccctggaaaagaaagatacctacctgctagttctcagggaagaggctgggccaggcatggtggctcatgcctgtaatcccagtactttgagaggctgaggctggaggatcacttaagccaggagttcaagacaagcctgggcgacatggtgagaccctgtccctacaaaaaataaaaaattagctggccatggtggcacacacttgtagtcccagctactcaagaggctgaggtgggaggatcacttgagctccaaagtcaaggctgcagtgagctgtgatcacactgctgcactccatcctaggtgaaagagtgagaccctgtctccaatggaagaaaaaaagaaagaagctgcacaatgggaggtagaaagcaggagcccaaggtcgtgagaggaggaaagtgagtgaaggaaggggctctgattagagctacaggcccgagggcctgccctgctccaccactatctataatgagagcaactctttccagggatggctcccagtgtttttccaaagctcctactcacctgtgatgcttattataattccatatacttggcacagacagttacaattttatgaatttagcattgctttctgtcactctctagacaacaatatgaggtttattacaacataaagggaaattcatcctcttggacttgactgagtgtcagcccaaatccccatgctgtcatctctgtcatcttcccttgaagaatgcaacctcaagtcagggctgaagtcattggggatacattcccaaaccagggtcctggggtcaggcctcaagaggataatctcaatgatcacataagtcatttcagatattgatttactgaacaaacattattgaacacctattacatgccaagcagtgagctaagaaagaagatgagaaagagaagtttgaaaggccaaaaagcccactgtctagaagataatgcacacacatcttaatgcacttactcatccttgaattgaacaaatacttcttgattcagttaggtgcttagaactatgctaggtactgagtttattaccaaagtgaaacagacatggtctcatgaaacaggccatatacaatgttgttttaatatgcttagtgctatgatgagagaagtgcaggtactcagggagatctttccagaaagaacgactgatttgcattccaagtcaagaactgaattatcaagactaagtgaataggggggaatggaatagaacaaacgccgtgtactataacgtattacctgctatgacagaagcatgtctgtggagctacaggagcaaaagaaagtggatgatgaccaaggcactcctaaagggcttaatacagcccctaacattgggttgggtctaacggaatgaaagtcaaagtgagagtgaggaggcagtgatggaagagcattccaggcagagggaaaaccacagaatagagcacagaggccagaagaagcatgccatgttcccctagcagagaaggttctatgtggtcaaagtgttgccttgaggtgggggggttgtagaagtcagtaggtcaaatgggggttaggggaagaagcagaatgaagggagatggaaaaggagccaaggccagggcaagagattggggccagatggtgaagaggcctgtattgatgttgtaaaaacattttcaagtaagcaggaaaccaagatcagagattcagtaaagcagctagtgaacacccagctgccaaacccaggggaacaactgagagttgaaaagaggaaatgtcttctgagaagccagagaaagtatttcacagaggattcagcccaggggtttttcttttcttagttgtaaaatccagcaagtctggaaaccccttccctctgcacagagctggcccagagcacagtgaaaatgtgaagtgccttgttcatcaattattaagaattcaaaatgttgacagcagagctttagacaaagatagcacccttctaagggtacggccctgtgtgactgcacaggtcacaggctcatgaagccagccctgcactgtgtttttctgagacagagtctcgttctgccacccaggctagagtgcagtggtgtgatctcagctcactgcaacctctgcctcccgagttcaagggagtctcctacctcagcctcccgagtagctgggattacaggggcctgccaccacgcctggctaattttgatatttttagtagaaacagggtttcaccatgttggccaggctggtctcgaactcctgacctcaagtgatccacccaccttggcctcccaaagtgttgggattacaggcgtgagccaccacgcctggccagccctgcatttttgcaccatcaggcatcctttcactaacagaaagggtgggtgctggctccctggagcctggagtcacaaggactagatgagcaacacattgagagctcagcactgaactcataacatcatgcaagcccccgtgttgagttcattccaaaatgaaaagcttcttttagttcctgattgtattgataatatacacacaggaagacaattcaagccatgcacagcagtaagtacgtgattggggtggaaatgtcaaattataggtatgtatttcaatttttttctcccctttctatgagagagtcctcaaaaagacttttgtttgttatgcaaggtgatgatcaagatgaatcttagggaaactgagaggaggaggaaatggttgtacaaaattaacatgtgggatttcctggtgatcttcctaaaattggctcatagctcaattgcattgtaatcacagagcagactctttatctatcatttggatactttaagacttgttgagatttgctctgtgatcccacctatagctaattttgtaagtttccatgcatgcttaaaaatatgtgtataccagccaggagtggtggctcacacctgtaatcccagcattttaggaggctgaggcaggcagatcactttgaggcaggagttccagaccagtttggccaacatggtgaaacctcgtttctactaaaaatagaaaaaatagctgggcatggtgataggcacctgtaatttcagctactaggtacttgggaggctgaggcaggagaatctcttgaacccaggaggtggaggctccagtgggttgagatcatacactgtactccatccagcctgggtgacagagggagacgctgtctcaaaaaataaaaataaaaataagtgtatcctgctattgttggtatggtattccttatttgttcatccgttatattttcagctcatttttttcagatctttctattcttactgatatgatgtctgatgtattatgtctatcttatctaagaggtttgtcagaataccagtatttcctatgtttccactggtgaagaattctctgtgtcttttagtatgggaatatcaacttttcttttgtttctttcagtctggaaatatcaattttatgtttataattgaagggtatttttgccaggtttaaaatgacagataaacagttcttttccttaagtactttgagtgctgtcaattttattgttgttcctatgagatgtttgtcaacattttcctctataattgaaggtttttaaaatttcttcttataatttttttcaagttattctttacatatttgaaatcatgctattatgtgcctaagatttagaatagttacaccatcctgttgaactggccctgttaacaatgatgagtggtctctcctaatctctaatgatgatttttgccttaaaaatctacatatctcatacagatataactgcatcagctttccttgggtttatgtttgtaggaaaagtatctttccatacttctcctttttgcctttctatatccttatgttttatatgtgtcatttgtaaacaacatatagctctatgtttgcttttttttttaactcagcctgacaaactttgccttttaattaaagaaattaatctatttacagttaatgtaattacatttatattgggctgtaagtctaccattcgcaaggagctatttgttctgatcgttctgttcctttgtctatttttgtgctgtcctcatttggattatttgagtatacttttattgtcctatgttccttctctattaccttggaacatacatggctttgtttactattctttactgttgaacttgaaagtaaatcatgaattcttgacttatcaaagtccaatattaattgttatttttattttcttccaggaaaattcaaggaccttagaactttttaaatccatttactcttctctatatttgtgtatcattgttgtcatgtacttaattttctatatattaaacccccaaagacattattattttatatagttaattttcattagcattttgcttgcccttcattcattcctgcacctctggtcttccatttaggataatttttcttctccttaaagaataccagtatttcctgtgtttccactggtgaacaattctctgtttcttttagtaagggaacatcaatttttctttgtttctttcagtctggaaatatcaattttacatttataattgaagagtatttttgccaggtttaaaatgacagattaacagttcttttccttaagtactttgagtgctgtcaactttactgttgttccgatgaaaataaaacccctttttcctctgtctgcttttaagattttctttttgtccttgattatcagcagttttaccataatgtacctaggtgtggatttcattttattcatcttatttggaattcatagggcttcttatctaagtttgatagcttcatcagtttgggaagttcttagccattatctctttaattatttattttggcccattgattctctttcctcttcttctgagacttcaattttatgcatgctagaatttttagctgtctttctatcttttactttctcttgtgaaattttacatttttgtcttttgaaagcttctttctgaatattttattctaatgtgtcttccagtcaactagtttcttcttcagctttatgtcatctcttgttaaacccatccactgagttcttaatttggggtatcacgattttttgattctagaatttccacttggttattttttattgtttctaggcctctgccaaattctcaaccttatctttttgccttttggagattgtaagcatagttatcttaaagtttgggtctactgactcttttacgtggagcgcataggtgtctatttctcctatctgttgtttctgctgacaacatttcattaatctccttgtagctagttatttcgaattatgtgatcaacattgtatttgaaaaacagtaatatgcaaaaacatttgagacctagggtgatattatttttctccagagagcatgtccaattctgccaagtacttgggggcattagcaattcaagattatctttacataatttcacaagttcaggggattttaaagtatactgcaatccctttagggacatgtatactttcaagacctcatttcttctagtgtatgctttcagtattccaacccaaatgatagagattcactgtactcgagttttccccattggaccctcacttcattgcctcacctgagctccagaagactgtcaagagcatagtttgcctctcttccaccacctccaaaaccagggaaggccaccaggggaaaagtgatcctaaacaccacatttacttcctttgatttctatcttttctggagcagggtgctgtaattctttactcagttgttagatccttaatgcccttatatcctaattatttgaaaacttcttttagatgaactaaataaatgcatatattgcatttatatgcacatttatccaaataaagttttatttggatttgagtaacttgctcttccactgactttcacaggatgcctgcaaactatcctgtgaatgggctaagagcacaagatttagagtgagcaaatctggttctaatccttgttatgctcctagaagcagtgcaattttaggcagcttacttaaactttctaattaccacttccctgactggtaaagggagctgatggttatagctccattgttgataaatcaatgaaataacattgcaaagttatattacagtgtcagcatctagtgtaagcactcatcaaatagcatctattcttatttgatatgagccatttaaatgtaacatttaccaaggataagtattttagattgaaaatggttataatgatgggattttttttttctggtcgttgtatttcaggaaggaactcttaggtcatcatttttggcccctgggaatacctgcttcataactttcctatgcccaaatcttagcactgtttatgctgtagaactcagccctttggaatacttccttgcattcttggatcaataacaaattccaactaaggaaaattctgactttttttttttttttgagacagagtctcgctctgtcgcccaggctagggtgcagtgatcccagctcactgcagcctctgcctcctaggttcaagccaatctcctacctcccgagtagctgggattacaggcgtgcgccaccacacccagctaatttttgtatttttagcagagacggggtttcaccatgttggccatgctggtcatgaaccccctgacctcaggtgatccgcacacctcggccccccgaagtgctgggattacagacgtgagccaccacacctagccctaattctggatttgtatacacatagtcttaatgcataccttcatgcagagatgtgtgagacccctgcttatgtgtctcagtttctacaattgctccagttgtcttaatgcctttactagctccctttttacccacaggtaaggccaaaagtgcactggtaaagtccctgtgattaccctcaggggctttgttgttacagccctactttaagccacttgtccctgttttacatgtctagagattatccactcttcaggagaccattcctgctaattcccactgttgggcatttgaaagcatgctcatttaaacatcagtaactaggagtcttcattggcctcatgctgcttaattcctaacctggtcttgaccccagagtcaaagccctgtgaaaagtcaatacaagcagcaaacaatggtatgttattcttggccgactttgcaaaacaatgaaagagttcaacaatagttaattatggcttaatagttgctaacaagtattgagtgttaataaagtggcaggcaatgtgcacacattctctcatttgattcacataacaaccaaatgaggtaggcactgtcattatccccattttacagggaagaaagtgtggtttacaggggacaaactatttaatctgaggcctcaagccagcaacagtgttgcatgtcagccattcccggagtctgtgtgctcccccacatagaatacttgcctgagaaacacagaccttcagtgcattatggaggaagccattgtgaagtttttgaaggaatgtctaacagtgaataagtctgtagttattaacagaatcgctctgttagaatggagtagattacgcttctaaagactatcctgatggggatagagcctgaggaccaaattaaagcaaacaggttagcaacatcaaaaccaactcatcacaatagggggagaaaagactggcagcaaagggatatcatctagtcacattagtgatgatgtttaatacatagtccatacgagaagtattatcaggtcttgagaagtagcttcttagagaggcttacgattgacaaaatggaaggcgacacacctgccagtgtatgcctgtgaaaaatcagccttctaggcccagctagaatatgtatttccacaggatctctgactggacacattcagcatgaaaccgtggtcacagaatttacccccattaaggattctaacagctcagtctgaggcttcccacagaaatcattgcatttgagtatcttttatggaggcaaattaaaataagaaaaaaaattggtaagttacttagtggtctggttgccttgccttcttaggaaaggttttcttttttattttgcttctgcacccccaacccccaccctctgccttgtgaatacttatccaaccaaaagcctgtagccaaaaggctgagatccacatttacccaaacagttttggttattacatatctgaggaagggaagaaattctccccttaactttttgaggcaattaaaatgtagcttcagaaaattattatgagattgaagagtcccttcactccaccttagccatttttttttaagagattgggcctagctccatcacccaggctggagtgcagtgatgtgatcatagctcactgtagccttgaactcttgggctcaagcgatcctccatgcctccatgccaccataactggctaatatttcctttaaattttgttagagatgggagtctccctatgttgctcaggctggtctcaaacttctggcctcaagcgatcctcctgcctcagtctccatgagtagctgggattataggcatgagtcaccatgcctggccacctttgccttttatcctagtctcaccaaagtctaagtaaggatagaaatagattcagggactgtgaatgtcaaggtttaggtgtgaaggtgaaaaggtccgaaatatttattacaaatgatagggacaggaggcagagaaattctgggagggcaggtccctggtgagggccccactctcaagctgaaaagcctgataccacagcccaaagtgagaactgacagccctgttttcctgcttgaatgttgccttttccaaaaccacccatggtccaccctgcccaccatccagtgcccatagaaacctcaggctcaaccagcagagagaggagaagcagctgggcttcggagaatatagttgaacatcggagagaagtggtttgacttcagagggacagcttgatagtgtagctttggagaggagtccggccagggatgggaatatcctgcttcacaaagatggtggcaatgaaggagcagtggttatataggctaaagcagtggcttctcacagtgaagatatggaagtgaaattctcaataaactagctctgtacactgccaggcagtaatacctggcacacgaagtgctcaatgaatgcttgctaggtaaataaattgattttgacagtgtctgagctggccaagcttttcagctgaatcttaaaggatgagcttggcaagtggagaggggatgggttcaaatcaaagcatatgcaaaggcacctggggtgaggaagaccttcaagttcttgtccaggcagttaggtgggcagtggtaccattgataaaaaaagatggcagatggaggaggaggtgtcagtcaaattaataacaagcatatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaataaataaataaataaaaaataacaagcatatgctattttgccacaagttggggaaattaatgtttaagagactggtacatcatgacaagtgttactgtctaaagttgcccttctccatattgacacaacttacatcattctacagtcttttttattggtgcattctttgactttcctagagcccatcttttaattttgtcatttagcacaatgggatattatttactaaagattgagatgatcatgagagaaccatccaaaatcagaaactttatttcaaatttatttattatcaccttcctgtaatagctaggctgtcactttatttaatttcttgctaaaacctatgtgttattgtgtcaacattttgtagatgcagaaacaaaagcattaaaataaagcatcactcaaggatgtgcagggcaaattaagagatggtcgcagcagagaggcagagagtgaagactataataataaggttgcccaacccaaagttgtaaaaactgaacatatgagaccctgaattggaaaatgacatgcctgagagtcatggcccaggtgcgtgcaattgagaacaagtatgtctctagagaagagaggaaagcaaaatggctgtttgataaatgaagtcaatgtttctcaaaatgtgagttttctaaaatgagcatttcccaaaatgtacatttttcaaattttaaatctttagagattcacaatgcatactggcaatgagagactctgagaataccggcaacaaagaaaactatttaacttcatttaacccaatgtggatcaaactaatttgaccttggaatgcatttttcatggaacatctattaccacctcccaggaaagtgtgggaaacactgagttaaaaaacgaatgtttaatttggtagatgatcaataaatgcttatttttgaatttttatgagtaattttctaatgaaatctgtatctgttgtcaacagttgttcaaaaatggatgtaaaaaagtgaagtagccatgaccttcagaatgagaagaaaaccttagaagtaggaggaatatggctttactaacatccactaaaataatgcaaaaatgtctaccatttggcttggccaacccagggataaattattccctcaatttttgtagcatgtagttcctctgaaactgctaattctgcttagatgccttctgactgtaagcgaagtttaattatttcattttctttaatagcagagggttggtaaattgtttaagaggaacaaacaatgtcttgttacataggtggaaggatgcagagtcctggtgtgctcctggtgacatgactgtcaaggcatatgaaagtcgatattaacaaaaaatagagctaatgattcatataacaccatttttcactttacattgaaatgtgttgggtttgtagaatgagaatatatgtgattattgggcatactccagttcaaattttggcttcattacttgtagctctgtaatcataagtctctgtgcttccgttttgtatttgtaaaacggcatcgatagtgttgaatagtgtagaataaaggcctcctcattttgactcttagaaatctccaggagagcatagctcatcatcatcctaccctgaagcaaaatatcctagcagacatgccccaccccatcccactcacagttctaaaggagagaggtcagagccaaaacatagacctgctaacagtaagcacgtgaaacacagtcacttaatcccactcccttagatagaaatgcaaagccaaggaaccaccaggcacataaagagaatggcagcatgaaagaagaagaaacaagaatgccttcccccctgaaaaaaatgacaaccgaggaacagaagacaacattaaaagtgctctaattaatatgccagggggatttgggagaaaatattacactcttaaaagcagaacacaatgctaagaaaaagaaacaaagaataaaagagagtgttcacaggtttaaaacagggactaattacattttaaaaatttaaaatatttggaaaataagcccaagaactctctttcctctctcagaatgtagggagagaaagacaaaggaatcgaaaactatgagagagatccttgaagatgcgtctaggagatttaacatacaaggctggagttgaaaaaaattatcaaagaaatacttgaagaaaaaatttccaaagctgaaggacaaaattcttcagacttaaaagggtttcctgagtgcacagaacaattagtgaaaagaaagcttgcctaggcacagctttgatgtgtcagagtaccaaggataaaaacaaacatctaaaggcttttatacccagccagatatcaatcaagtgtgaaggcagaataatggtattttcagaaagaaagatctcagaaagtttattttttatacatccttttttaaagggtattatagacatattccagaaaaacaagactgagataggaagttgtgggctccagcaaattgtggttccaatccagacccctgatagcagttagaagaaatttacaacatggcaattgcattgctgacatagagggcagccagtacaggtggagcagaaggggggagatgggggggtgtatcaggtcttcaggaaaagggacttaaaaaaatgacttggggaaaattaatcaagggcaactaatgcaagaaaacaacatcagctggaaactctgaaaatcaggtggatgaatgtataataaacctgaatgtataataaggtcataattcatatatgaagcaaactaaaatgtggcaaaattagagcataaagacagagagaaattccactgaatcatgattctgggaaccttgatcagcccaggggtcatgaccttaagacatattaaaaagaacacattcctaatacatgacttcatcagtcaatgacagaatcatagcaacttggttgcaatttcaacacaaaaacaaaaggtaaacatgtatctggaaatgggacatgaatggtggggatagaacgtggagaagaggagagggccatcaataactttatcttttaaagtgggaaataaagagacatattgttgaaagttgataaaatgagaaatggagatttagcataacaccttacattacaacaataaacacaagaagaacagagataaaaatgcaaatgtcagaccctggcaatgtccaagattctgggaggagaggggtggtattatggagctatatcctcaattttcatattatggagtctgtaaatatcatctattattgacagattaaaaaaaaatagaggtataagcatgttgtctatgtgaaggcaagaccagaagaatagagaatggaaaaatggaaacaagctcgcagagtggggcccatgcctgtctcatttgttcaacgttgtatccctagagcctagaatggttgggtgccgggaatacctgcttaatgaatgcatgaaaagaagttcaccctgggcaatggtactggaggtgaagagaagggccaggggctgttgctttccaacactgagtagttgcagatggaggtattattttggttaaaaaaaaaatctgtaattgtgaaaactatggaagaatgaggcatgctgtaaagggggtggtcaccttggggaggggaatgtaggaagaactctggaggaggagccagccaaggaaggagaggaggtgttcccagctgaggaaatagtgtggagactccaagtggaaggaagacagatccagctggctggagcacagcagggggtgggtgacaggctccgcgtgagcctggggaggtaggcaggggccaggtttacacaggcatggtaggccacattcaggatgctgatgaactgctcaagaaatgctctgtgcacacacttgggaccagggtgccatggcattctgttcttaactgatcaggaatggcctggacctttggatttgatgtatgggatctaattactttgagcaaccaaaaaaagagaagaaaatgctacctattagataactgaataaatagagcgtggccaacttctcacacccatcctgtgcttattgcatgaggcgaatgagatgtgctgggaatgccggggaaatggctggattttctcctcaccaaggtgttgctacttgtcaggaagttgtgacactggtttagcacggaggcagagaaacacgatcaggacaatttaggcattgatcagtggcaaagcatgttctgttcgagaagccagaggagtgtttactgggctctcaggagcatgaggccgggccagctgccaaggataattgtaaagatatgggctctattctgaagaagtgcccattcttagaagacagaaatagatgtggatgcacacagatccagattctcacagagcacaaatgctgcacggggattaggcttggtgctctgggaagctgaattaactcttccaacccactagggtccttgttagtgcatcgaagcagtaatttactcaatgacaagagttcacgtcgctttctaaggcacttaacttactcccaggatgttggttgcacaccaggggaatctggctcactaatctttaatacttgtcataattatttttctttcaataatactatttcccccttgagaaactcaaaattattacataagaaatgtagaaatataagtgtgtgatattttttaataaaatgtagtcagtggccccagggaatttttgtagcaaaagcctctcaaatcaattatgttttctcatttctgtttccaataattgaatattttatttctatatttatttaagttctttcaaaatgaaaaggtggagttgtgttgacacactgggaaaggagggtattattaattaaacttgtttaaagtctaagatggaaacagtgctgatgcatatacatttgcttcaatgagctgttggctgctctgtgaggttacagaaatattattggcagttgcgggtggtggcaccattatatgcatcattccatcctctctgggaggtccctggtggtggccctccaagaggcatcattccatcatctctaggaggtaactctgcaatcacagttcatccagtcagagaaaaaatgaccgaggctcccctaggtgtttagtgtccatgactcagcggtttagaaaatccaggattacggactgcatttgtctcattttaatctggatgttcagtcctgctccctccctctgtcacttcaactggccctcactgtcatgtgcctccattgtctcatctgattctaacattcctgctgtgatgtgggtgggggtgaaggtcattcccctttcataggtaaggaacacaaggttcagaaaggttgaggacatttgcccagggtcacaaggctgcttggtgtcggagtcagaactagcctggggtggggaaatggggtcttctggttccttgcggtcacttcctgtggagtccctgacctccggtcctgttttgcctgacctctcagcttcaactgctcttccatgccactgctgcacaaatgctctgaatgtttgaataaacaacccctgagaagagtagcccaaggaagtccctgcccagagactgatgagttgttacccagaggcctggagagctcccaggatggcagacactgcctgcaggagttggcattcatcagaaaacagttcttcacggagtaggtagatcttcaaccctgtctggctagctccctttctaagctggaggtgtcagaggcgtgtgaaccagagcaactccatcttgaataggagctgggtaaatgaggctgaaatctactgggctgcattcccagacatttaaggcattctaattcacaggatgagatgggaggtcagcacaagatacaggtcctaaagacgttgctgataaaacagattgcagtaaagaagccggctaaatcccaccaaaaccaagatggccatgagagtgacctctgatcgtcctcactgctacactcccaccagcaccatgacagtttacaaatgccatggcaacatcaggaagttactctatatcatctaaaaatgggaggcacgaataatccaccccttgtttagcgtatcatccagaaatagccataaaaatgggcaaccagcagccctcggggctgctctgtctatggagtagccattcgtttattccttcacgtttttaataaacttgttttcacttgactctgtgaactcgccctgaattctttcttgcgtgagatccaagaccccctctcttggagtctggatcgggaccactttcctgtaacagaggctcctttaaaacaggtatggataataccacccctagttctctctctttcctctagcccagcctcatggggaaacctctccagaggcctctgattttttctgtggttggttaaggaagaccagagtgacctactcaaggaagttaatttcagaggtcaagcaatgactttcccagagtctgcctcttcaaactcatgccactggagattaataaacgttggttattgttatttggccccaaggaggctttgaatgcggagaattgcgacctgcatgcctaggtcaaccccatagccttagatcgagccactgtgacaccagaaggtgaaatgggacacaagggtagaaattacaaagaggctgccttcagtttgaaataaaggactttcaagtaattagaactctttcaaaaaggaatggccctgtcaaaaggtttcgttgccagaagtagttaaagagttgttgactacatgtctaagtgtgctgggaagggagaggatggttagaatagatgacctctaaggtctcagcacggagatatttaatttgtatatccttcctgtggacacatttctgtgtcctggagtacacagggagggagtggggtcagaggtcagggccaatggtcagggggctccagagcatctgcctctggacacaacacaggcccacagctcataggcctggctaccttctcagttcccctggtttcatcaacattgtcaccattgactgggttagcagcagcaaccgcttaacgtaactaaaatatctattctgatgagattctggaacaaaaatcccaaatgacttttcccctcgaatcataggaaactgcagcagagatatcactgtatcacttgaatgtgtacctgcttgccagttactccggattgatgcttcccgatgtaaacaatggctgatcgtaaggtctaaatcatatgtgtgaaactttctgcaaaacaaaagcgattgggtatttaggcaaaaacatcagtttagtagtttccctggcaaatgtcctataactctgtgtgtgtgtgtgtgtgtgtgtgtgtgtgtgtgtatacatattcatgtataaaacagtttgctttacaagcaagtaatggtcaggtcattctgctgggcaatttactctctaggaacccaaaggggcctgtgttacatgcatgcttttttacaggttactcagagccatttagaaaattactattgtgcttcacaaaatgccccaccagcctgaggaattaaccctcttcccaatacgtctaattcacttgttcttcaggtaatcggcacattaaagctgatgcagatccagtgtctatataataaaaacagctaatttttactgagcgcttagcatgttcccggaactctaaatgaattggatacagcttcaataaatcctcacaacaacccagatgagagttccattattgtccccattttaactgaagagtaaattgagactcagagagaaaagtaatttgctcatggtcacatagcttctagtgcctggcatgtatgaggcctgcaatgagtgatgattaatattattttatagtgggaggcacagttgggatttcagtccaggtctaacactcaatgaagcctttacacgtggcctctatgtagtcctgcctcatagaattcatattgtgcatgaaaaggaggcatgccatggccaagtgctgccagcgggaatccctgtcctaagggaggcatattgtgtatgtcacactttcagtagctccctgtcagttgacagcgtgtggcacgtaaagcagaatgattgagataggagtctccaaactcaggtaggatgcgtgaagtttccagaagttcatgaatacattcagtgttagtgcaaactatggctaggttcatagcttgcagatgtcatccttcctaaaactgatgtgcccgagaatgctctgcaggcaaggctccatgccagctccacgtttctgcaccccaggtttctgccagaccagatactcacctcatctgggcctgtcctctgcgcaaaagtaagagacacccgctctgaagagtgcaccccatgggcacagggctcgatgagatgccaatgcatttgtgagaattagaaaacagatttccctttctctgagcaagagaagtgtgggctggattttagtctccatccacgggctcagccgtgtgcccacaggcacatcactgcctgcccaaatcttatagcagtgcgttgcctaagtaataaaagcccctgggcaccaaaggggcagtttcaaatactgatttccaggaagcttcggagtatggagtttcctgtagttcttttaggaggtttgtgagcaaaatcactggctgcagtgtgggttgatgagatcactgggctgccatcgcaggtccctggggcatgagctacctccaggacagccccacagagacagccccacagagacagagacactagcagtaccacaggcttctcagctgagatgacagagggcacctgctaggccagaaggttaaccactcactcttcatttccaaacaaagatagtcaagcatctcttaaagtacaaaaatataactgcaggccagacaacaataaagattgaataatagactcataaaattaatggtcagaaactccatagcaatattttcagctccacgtttctctagccccagattataaacaccatacttaaaacaacaaaaaagatgcactcaactttccagccactgcttaagaacggggcagcttactaatcctgggaaacttacacctggggacaaagtttattattggtttaaccaaactgagaaagtgctggtttagtctctctatggtactttctcatcccttaagctacttgaatgagtatgattttcaggttagtattaatgatatgatgtgagtgcagttttcgtgggagaggctgccttttaatataggtttctcaagaattaaagaacttctgcagcaccctctccattatatatatgagtcaaatgttgatataaagcagtgttgccaccaaagactaccacacaccccagggatctagggatgaatgagtgaaagaataaataaactttttttaaatttttttatttttattttttttagaggcagagtcttgctctgttgcccaggctggagtgcagtggtgcagtctcagctcactgcaacctctgcctcccgggttcaagtgattctcctgcctcagcctcccgaggagctgggattataggcatgtaccaccacacccggctaatttttgtatttttagtagagacggggtttcaccatgttgggtaggctggtcttgaactcctgacctcaagttatccacctgcctcagcttcctaaagtgctgggattacaggcgtggataaacatttttaaagttccatctgtgtgtcatacatggcattagaagataatagtaatgttaaaagctaatgtttgttgagcacccactatatcctagaccttgttctaagaagggttcatatctttgctcattgaatctgccatccccttttacagaacaggtaactggctcaccctcactcagccaggacataaaggagtcagggtgggatggagtgcctgccttgaggggtacattgctcccagctccgagggaggaccggcccgccacacactccacctcctttggcagaacatttttagttccacatcttggagaattggttccccatctaaacccacaggttgtacctaggattctgctgttgaaattgaaggatgcctcagttagacaggaggaataagttcaggagatccatcgtacagcatggtgactatacttaagaacaatgtgttatatgcttgaaaattgcttagagagtagattccaagtatcctcacaacacacacaaaataagtaaatgacaagtaatacatatgaatacatatgttaaatggcttgatttagccatcccacaatgtatacctatatcaaagcatcatgctatgtgccataaatatacacatttttgtcaatcagaaaataactctagaaacaacaaaacaaagccaacactactaaaaagacaaagaatgtagttaagtcttttttctgcttaatcaagagaaagatcaataagatataataacttaatgaagagagaaaaaagaaaaagactagagaaatttagaaaagtttcttgaaaaacaaagggtgcggtatcttttttcctcttcatcctcagctttagttgaaaattaagtgaagtataaggcagtatacatacactaatgccaagtgaataaccagactctcgctgtccactatggtaaccactaaccacatgtgactgctgagcatttgaatcatagctaatctaatttgaagacttagtactcaaaaaaatgttaaatatctcatttcctgtttttatattgattacacattgaaatgataatattttttcttgttttggattaagtaaaatatattattaaaaattttaaaaaattgaatgatgctggccttttcaaatttgaaagaagaaattaggtcaatgggttgggttttctcaatgttctgtttttgttttttttttttagatacggggttttgctttgtcttgcaggctggagtgcagaggtgtgatcagctcacggcagcttcgaactcttggggctcaagtgatccttccacctcagcctcccaacagctgggattacaggcatgcactaccatacctggctctcatattttaaaagactatattgctgtctgggtgcggtggctcacacctgtaatctcagcactttaggaggttgaggtgggaggatcacttgagcccaggagttggaggctgcagtgaactgtgatcaccactgcactccagcctgggtgacagagccagaccctgtctctaaaaaataaaataaaatatgagaagtaaaaacaattaaaaaaaaacaccctgcactcatccacaattccatcactggaaatattcactttaatgtttgaaaatgtatctcctagtatgtatgtttcgttgtttgttttttaaccagagtgcagtcatactacacatactacttttttttttcttttagaggcagggtttcacagtgtagttcaggctggagtgcagtggccactcacaggcatgatcatagtgacttacagcctggaactcctggactcaagcaatcttcctttctcagcctcccagctggaattacaggcacatgccactgtgcctggctctcatgtactactttttatccaactttttttcacttaataaaataggccgggcacagtggctcatgcctgtaatcccagcactttgggaggctgaggtgggcagatcatgaggtcaggagatcgagaccatcctggctaacacggtgaaaacctgtctctactaaacatacacaaaaattacccaggcatggtggcggacgcctgtagtcccagcttctggggaggctgaggcaggagaatggcatgcacctgggaggcggagcttgcagtgagctgagatcgcgccactgcactccagcctgggtgacagagcgagactctgtctcaaaaaaataaataaaataaaataacaataataatataaaggggccatctttatatttcaaaagaaatatatatcaggattttacatgactgcatagtatttcactggactaatatggtacaatttgctcaagccactctctatctttggaaatgtagcttgtttcctcatttttgctatgatgaaacacattatgataaatatctttgcacatacacccatcaggagaaatatctagtttttaaggcttttgacagctactacaggggattacccacaggaaagtttgtaccaacatgaattcatataagccttgtataaaaatatgcattttccaacactaatactagcattaaaatttcatcaatattattgtatttcaatgtgtagctttggtttactaataaagtaaaatttttcttcccaactgcttattaggcatctgtattttttttctgaatttatttgacagagctccttatatatgaaggatagtaagctgtcattatatattgaagtatttttccaggtttgccattcatctttttatgtttttgtggcattttcgacagagtcaaagctatctttattttcatttatactttatttatttggtatcaggcttacaaaaaactatcatcccaagatcatttaatctttacctgaatttttccctagcaattttacagctttattatctcacatgacgatccttttagaatttattttgatttaatacactaggtttgcatctagcttttactctcctctccaccacccatagcagttagacagcgtctcaatatcatttactgaaaagttatccaatcgttcatttattcagtaaacagtttatctaagacccataggaccaggcattgttctaggtccttgggatacaagaaggaactttcattctaatggaaacagcagataatggcaactaaatatatatggtaaatggagctaaatgcagtgaacagggagaggctggctattttatacaaggtggtcagggaagctctctctgaaatggtggcattgggcagagacctaaagggagtgagaggtgacctatgcatctggggaagagctccaaggtgctaggccatgacataggagtgttcaagaaatgatgaagagaccactctactggagcagtaccacaaataagggagagagcaccagaacagttcagaggggtgacaggagccagatcatgtagcccctgataggtcacagtgaagaccttggattttgcactgggtgagggtagtggattgtatttcccaaagatggccacagcagtgtgtgtgagatcttttgcaatgtgacattgtcacgcctccctcaggaggtggaacctattcctcaacctctttgagtcttagcaggcctggtgactgcttttgtcaatagaagacgggataaaggctgctgtgtattttaggagcaactcttaactgctgtggcagcttctgcttcctgcctcttagaaaccaatcacaatgcaaaaagtgcaaccaccaaaacatggccattctgtgagaagcccaaggcacagggagagcctgggagaatgagatgccacatgaagagagagagcgcccaaggagctccaaggcaccagacgtgtgagtggaaggggatcctcctgctcagccagcccagacaaccaaatacccagattcatgacccatgacatcttgagcaaatgcggaaggttgttttgagccaccatggtttagggtagttggttatgcggcaagggacaactggaactgtgaaatagggacccataggagagttctgagcagtcatatattttgacttaagtgttataagaattcctccagctctgcgctaagaacagtgtgaaggagggagagtgtggaaagaagattactttggagagcaggggagagaccataggatctaggaccagggaggcagaggctaaagtgctaagaagcaattcaattctggatgatttcaaagaacacacagatgggatttgctgatggattagctatgggttgtgaaggaaagaagtgaaggatggcttcaaggtcctaggctgacactggaagaatgaaggggcttcgtggggatgtgagaaaactgtgggaggaacagggctggagttagagaaattagcaattctgcttcggacatgttaagacgtaaggttgaacacacattcaaaaggagagactgagtgttgtgcgagagctgggtctgtagttgggaaagaagtcagggctgggagatgtaagtttgggcatcgttggtgtttcagtggtcacagtggaccagatcatctgggagcgaatgcagataaagcagggccatcgggggactggggcgcttcaccacccggagatgtgggagaggtggagaaggcacccaaaagggaggccgagaaggcgcggccagtgtggtaggaagagaggaagagaatgatgatctgggaggcagaggaggaaggtttccagaaggaagaagtgaatgtgtcaaatcagctgaagaatcaagtcaaatgaagactgacaattctcactatgactgtcctcattcttgaaattactgatttgaaaaggggcttttcccatattctaaatggacacatgtgggagtgtgtgtgcactttcacactttcccttctcccccattgatctgtttatccatttggagctatgtgaccgctgaagcttttgtatctgacaaaacaagtagcacacttcctctttttctcatctttttttcaaaagtatcctggttattcttatctaaaattaatttgaaatttgacatttgaattttatcaagtcctctccctccccaaatgcattggaattttaatttaatcttttaaaataaaaattggtttcctgagagttgatattgagttttctatgtggtatatgtttccatttatgtatgttttacatcgctaagtagattttatagattctttttatataggtcttgtggtgtttcctcttaaattcttttctaggtatttaacttttgatgccttttatgaattgcatcccatttccccattgcattttcttactgacctttttctttttgccataaggaatctatttatatataaagaattctattattttgaattattttactgctgatacaaacagattgcaacacctttattattttcaccgcgtgggatcccacatgtatgaagttatataaccgatgtataaggctgtcctaatctctgctagtaaaatcgttcctagtttggaggatgggatttaatatgacaggatttcatggtgtttcccaaagaacttcatgatttccaggtgctctgggaatgactgtagccacacatctcagaatgtcccagatattcccaatttcaaagatttttccctttgttaacccatgagtcagaccatatgtcctttgatctttgcttcaaaaaatattgccatggtatttagaaacagggacagcccaggcaaagttgtaacacatgggatgtttttcctctgagcccctaacttacccctcagtactcttcctggttatgtgtgcctggtgcgtgcatgtgtgcacgtgcacacgtgcatacacacacacacacacacacacagacacacagaggcatcctggaggaaagggattttattcaaatacaaccacatgaactgcctgtacagcctagactcaggatcgccctaagggagttggcatggaagatttcagagctgggcagactgggcggggacctctcatctgtgtttcctgagggtcacctagcctctttgagcctccgttctccataggtgaaaggagtgtatcatatctgccttgcaggggtgttgtgggactcagaagatgtccataacatctatgcccagtgtagagtaggaactgggaaataatatccattactgtgattttgtgaggagttccagataactgctcaggtctttaagagaattccttggtcttcatactccactcccagctgtggaagcaaagcaatcagaatgaggatgcaggaagcatggggtggccatctgccagttctcccttttgtatgcctatttctgcaaacaaacccaccaacgattagattgcccatgataacaagccagcctccactcagagctcaccgtgcaatgactgtgtggaagacatttgtgatttttttgctgtcaccaccaactatcttcccttcctgttaccaccgcagtcttccttctggggatgcctcaccatgcatagatgtgggagataggccggaagtctaatggagggtctacctttcctcaaggggcaagcatgtgatctaaacaggggtcatcactctctcccctctttctgggattttaaataagtgacatcccaatatggggacaattgaggtcatatctgtcactgtggcagccacatcatgtggcccagactgttgccacatttccattcctgtggttcttaacggtgttcttacctttgcttgctgctctattttaagtcaatcagcccccaatattgttctgctagattgacattttgttcagcatagcctgattcagtttctgtcttttgcaacaggagcactatctgatacaaccagactccaagaggaaaatagaaaaagggagctcataccacttaaaaagatttctctttactgtggtcatcatccagggcttgggagaaaggtgaaatcttaaaagataccagtaggccgggtgcagtggctcatgcctgtaatcccagcagtttgggaggccaacggggggcgcatcacctgaggtcaggagttcgagacaagcctggccaatatggtgaaaccccatctctactaaaaatacaaaaattagccaggcgtgacggtgggcgcctgtaatcccagctcctcaggagactgaggcaggaaaatcacttgaacccaggaggcggaggctgcagtgagccgaaatcatggcactgctctccagcctgggtaacagagcaagactctgtctcaaaaaaaaaaaaaaaaagacaccactaaatgggacacaacaactgagttgaagttatgcatcattacattagagaggatttgggggtagaatgcctttctgtttgccaatttatcatcaaaggggcaagaggatgaagggcggaagggaagtggtgaatatcaacttatacaaccaccactcaaacacaaactctttgcatgcttttaggagaacttgaaacaatttcaattttcaggatggggaaaagtaaaagccctatttgccctttctctcttcattatccatggtctccacattgctccttggtcctgagaaagctgccacaaagcattttactagttatctgattgtcattccatttaacatgtcccctggtctgctggctgatggtagtttaagcaggatctaattggtaacatattgccgattgaattaagtgccatatgatagagatttaaaccatggtaatttttccataaagaaaaatctgtcaacaggctataggggaggaacagcaataaatcaaattgtcgtgtttattagttattgcaggagtctagttgtcttgtattcattataaccccccatttttagtgcagataaaaactacaaagaggaatatctgtgcaagatgctttttaataggtttgtatttgtacacaaacacctgcttgtattttaatgatgagaacaatggtgccatttcactttgaaaggagcatgtatttttggctgttttctggatgaagaataatgtttttagtttttgtcaaagctatgttttaaaacattgagaatcaactcactaataaccaaaaaaaaggcaaatgaaagcagaaatgagatatgacttgtttgtcagacttggaaatactaaaagaacagataggatgattgcactaaaggatttctagaacagtcattgcaatttaacttgtgatattcaaaaaccggaaatcaactaaattttcatatatgggaatggttgcacaaattatggaacatcagctccagagggtgcaaatgggtcatttgaaagaacaagttaaatcatacctaatgacatgtcattaagaaccaacattatttatacttttcatttccatttaacttgcctttaccgaaggtggatttcaacacgttttccttacatgactcggaaataatataacagcattttacgtatgtagactcattgagccctcataaaatcctgtgaactctgtaggacaggacattacacccacttcacagaaaaagatgtggaagtgcagaagataaaagttatttatggaagggtccatagctgtcaaccttgataggcaagacatcaggtccttcctctgagtagtggtgtagaaaaaatggttggaatttagaaaccagcatccagctcctcaccatgccttcagctttctctgtgactttgaacttgtttcttaaactctctgaaactggacgtcctcactggtcacgttttgttactacttgctttgtattctgggtgtgatgggtgggggattgggacacagaatctggagatggtcagatcccaacgctgctatttccctgctctgcactcttaggctacctaccaatctctcctctaaaataagcataattgcaatggctcagatacaataacaaaatgtgtgtaaaatgccgagcaccacgtctcacacctgagaggcactgaatgcatgttatatactatcatttggatgtcaccgttccatgtgcctatttcctggtttgctgtacaagatgtgtatgagtacatgtcatcaagcccacagagctccagaacatgttcctctcacaagcaggcctcatagggaggggtgttctgtgctgttcctctttcctgctcactacttgtctgtagctacagtgtaaggactgtaatgtcactgctctggccttaagtgtcaccccccaaacccattttacacacaccacctcccacctttcacctttcccaaactcttaccatgtcccttcaagtttgatggcttaattgtacaaaaggtagtgatgatgatgatgatgatgatgacaatgataacagctgctaatacttactgagccctttcaatgttccaggcacttgtctaagcactttacatgtattagcttatttaattcttaagaggaagggattactatctactattgtacttgtgttacagatgtgggaactccgatgcagagatgtatagtgacttgcctaaaaccatcatgttagagtgggaatttaaaccttgaaatctggaaaataagcaatgtatatatttttctattttctaaatgcaaatcaaatatacatatgcataacaccactaaacactaagtgcagttacgcctagaacaagggaatagcagttgacagaaacacaaccaaaactaagaatattaaatgtctgtattactttcactgtaatcacttcacttcaacagtgagatgggatagccctaggtaaaggaaggtgctcttgtagttagaacattcttaaattttgcaccaaggaacacatgcttttaataatggcagagacaacattttttgatggattatttagtttgtacgatcaacattcaaagaatgagtttaccaccactttgttattgtaaacacttgacctttagctacctgaatgatcccctctttgaataaaaggaattatgaaacacatgtgtagacatatttcatttttatatatgtgagactcgaatagcaaggaaatcacatattaggaaaaaaacccctttgtcttgctattagttctctttggtttcaaaaatctggtcactgtgtatattgcattatatcatatgtgtgtgtacatatatatacacacataaacacacatacacacaatgtcatgtgtataaatacatgatgtgtttatgcacatacacagacacacacacacaaatacacacatatacaatgttccatccaagaaatacaaatatagtgctgttagcccctaacagtgaggaggtcattattccaagtcatttctgcagaagtgacggtggccttaggtggaactgcccatgatctctccttgcaagctcactcactggggccattgactgggatccagtctgtggccatgtcatggtttctatttttgaggttatagctaatgagcaacatgaggttaagacacacttttcataaggccccagccagcatcataaatatgtgtgtgagcatgttcacactcaggttatgtcttctttatgtgcaccctctaccacacacacacacacacatgcacacgcacacacactgacggcttcagtgaccaactttggtcacatcccatctcttccttctcaatccctctggctgttcaccagggcctggaccatctcggtgaggctgaccaagaatgctccccctgccctgaccagcggagcatgggcacagctacttagagcgccacccttcaggacacaaagtcggggctacctctcttccaggcaaggcatcctagagggcccgcacaccctccagtttgatcttacctctcagctcccgttccttttctttctctccccagtaagtcgttgaacgtctttcttctgaggctgagcgtggagctctcttctcgctggcg
